United States Patent 8,343,764 (GENES ENCODING GLUTAMINE SYNTHETASE AND USES FOR PLANT IMPROVEMENT) - sequence listing, part 2

SEQ ID NO: 3922 - protein, 542 aa, Glycine max
  misc_feature (140)..(140): Xaa can be any naturally occurring amino acid
  misc_feature (158)..(158): Xaa can be any naturally occurring amino acid
MKSLCLGPFLAASAPVGRRAYGGHLSRKCFQKQLHFHSRCVAFSSFICSATISVMPELEEKQVFDGEKANLLVKDLRKSFDSGMTKSYGWRVSQLEAIAKMLEEKEKEITEALYKDLGKPRLEAFITEISQAKSSCSEAXKELKEWMKPEKVNTSITXTYPSSAEIVPEPLGVVLVISTWNFPFLLSMDPVIGAISAGNAVVLKPSEISPATSSLLANLIEQYLDNSTIRVVEGAIPETSALLDQKWDKILYTGSARVGRIVMAAAAKHLTPVILELGGKCPAVVESDVNLQVTARRIIAGKWACNSGQACISVDYIITRKEFAPKLVDALKEELEQFFGKDPMESKDMSRIVSPNQFARLVNLLDEDKVSDKIVLGGQRDEKKLKIAPTIILGVPEDAMIMQEEIFGPIMPIVTVDNIEDCYSIIKSKPKPLAAYLFTNNEQLKKDYVDKISSGGMLINDAVIHVATRGLPFGGVEESGMGCYHGKFSFDSFSHRKSVLYRSFDADSTIRYPPYTPQKEKLLKALISGNIVQIILSLLGWS

SEQ ID NO: 3923 - protein, 381 aa, Glycine max
  misc_feature (130)..(130): Xaa can be any naturally occurring amino acid
APPPEFLLGKDKFPPAESNKKSKLNGKKHVEGEMGHGMGSKLLKSCSALLEKLMKHKHGWVFNAPVDVEGLGLHDYFSIITHPMDLGTVKSRLNKNWYKSPKEFAEDVRLTFHNAMTYNPKGQDVHIMAXQLLNIFEERWAIIESNYYREIRYGLDYGAPSPVSRKAPPFRPPPIDMRRILDRSESMTQPPKIMGITPSSRTPAPKKPKAKDPHKRDMTYEEKQKLSTHLQSLPSEKLDAIVQIIKKRNAALSQHDDDLEVDIDSVDTETLWELDRFVPNCKSRLSKDKGKAELAIRAREQAEQNAQQNSQAPVAVEIARETQADERNVPPSLPEQGQIPVDNGSKTSSSSSSSSDSGSSSSDSDSDSSSASGSDAGSPKT

SEQ ID NO: 3924 - protein, 336 aa, Glycine max
  misc_feature (272)..(272): Xaa can be any naturally occurring amino acid
MADESVVESPVKRQRDDDEENEVSVSMDVEGGKDPLSNGLSSVIPGWFSEISSMWPGEAHSLKVEKILFQGKSEYQNVMVFQSSTYGKVLVLDGVIQLTERDECAYQEMITHLPLCSIPNPKKVLVIGGGDGGVIREVAHHSSVEKIDICEIDKMVVDVSKQYFPDVAVGYDDPRVTLHIGDGVAFLKEVPEGTYDAVIVDSSDPIGPAQELFEKPFFSSVAKALRPGGVVCTQAESIWLHMDIIEDIVANCRQIFKGSVNYAWTTVPTYPXSGMIGFMLCSTEGPPVDFKHPVNPIDENESQKSVRPLKFYNSEIHTAAFCLPSFAKRKIGSKAN

SEQ ID NO: 3925 - protein, 450 aa, Glycine max
  misc_feature (39)..(39): Xaa can be any naturally occurring amino acid
  misc_feature (67)..(67): Xaa can be any naturally occurring amino acid
  misc_feature (127)..(127): Xaa can be any naturally occurring amino acid
  misc_feature (136)..(136): Xaa can be any naturally occurring amino acid
  misc_feature (143)..(143): Xaa can be any naturally occurring amino acid
  misc_feature (365)..(365): Xaa can be any naturally occurring amino acid
  misc_feature (415)..(415): Xaa can be any naturally occurring amino acid
MSQHHGDEMEYAADDNEMAEVEEDMYFRGRAFGESDSEXDDDYEYDPLENRISDTTAAEARRGKDIXQGIPWDRLSISREKYRQTRLEQYKNYENIPQSGEKSEKECKPTDKGGKYYDFWQNTRSGXRTILHFQLXNLVWATXSKHDVYLVSNYSIIHWSSLTSKRSEILNVSGHVAPCEKHPGSLLEGFTQTQISTLAVRDNLLIAGGFQGELICKYLDRPGVSFCSRTTYDDNAITNAVEIYEHPSGAVHFMASNNDSGVRDFDMERFQLSKHFCFPWPVNHTSLSPDGKLLVIVGDNPKGLLVDSQTGKTVTPLRGHLDFSFASAWHPDGRIFATGNQDKTCRVWDVRNLSKSVAVLKGNLXGAIRSIRFTSDGQFMAMAEPADFVHVYDAKHGFENEQEIDFFGEISGVSXFSPDTESLFIGVWDRTYGSLLQFNRRRNYMYLDCL

SEQ ID NO: 3926 - protein, 497 aa, Glycine max
MAAGTGLFAEILDGDAYKYYADGEWKKSASGKSVSIINPTTRKTQYKVQACSQEEVNKVMDLAKSAQKLWAKTPLWKRAELLHKAAAILKEHKTPIAECLVKEIAKPAKDAVMEVVRSGDLVSYTAEEGVRILGEGKFLVSDSFPGNERTKYCLTSKIPLGVILAIPPFNYPVNLAVSKIAPALIAGNSIVLKPPTQGAVSALHMVHCFHLAGFPKGLINCVTGKGSEIGDFLTMHPGVNCISFTGGDTGISISKKAGMIPLQMELGGKDACIVLEDADLDLVAANIIKGGFSYSGQRCTAVKVVLVMESVADALVEKVKAKVAKLTVGPPEDDCDITPVVSESSANFIEGLVLDAKEKGATFCQEYKREGNLIWPLLLDNVRPDMRIAWEEPFGPVLPVIRINSVEEGIHHCNASNFGLQGCVFTKDVNKAIMISDAMETGTVQINSAPARGPDHFPFQGIKDSGIGSQGITNSINMMTKVKTTVINLPSPSYTMG

SEQ ID NO: 3927 - protein, 373 aa, Glycine max
  misc_feature (180)..(180): Xaa can be any naturally occurring amino acid
  misc_feature (311)..(311): Xaa can be any naturally occurring amino acid
MSAGGKKRNTLKFTTTCAVAAGRSMIIDASYAGERDLHYGGKILKRKNQKPLYEALQKIKEELMLLGFISLLLTITQNGIIRICVPVGWTHHMLPCSLKDHGKEESTKTTSHFQTFFSFSDISGTARRLLAESESENEDHQPATGEKLGPWKGKVPLLSVEALHHLHTFIFVLAVAHVTXCVLTGVFGGLKIREWKHWEDSIGNDNKNETQPVLEPTVTHVHQHAFIQNRFTGLGKDSAVLGWVKSFFKQFYGSVTKLDYVTLRLGFIMTHCKGNPKFNFHKYMIRTLEDDFKKVVGIKLVFFGIFVVIFXLLNVHGWHAYFWISFIPLILLLAVGTKLEHVIIQLAHEVAEKHSAIEGELVVQPRDDHFWFN

SEQ ID NO: 3928 - protein, 558 aa, Glycine max
MGNTCRGSLKGKYIQGFSQPEDHSKRSTTHSDPSSTKQQDDNDNNNNNNNNNNNNNNNNNNLPFNAKREAIMRRGLDNQAYYVLGHKTPNIRDLYTLGRKLGQGQFGTTYLCTENSTSIEYACKSISKRKLISKEDVEDVRREIQIMHHLAGHKNIVTIKGAYEDPLYVHIVMELCSGGELFDRIIQRGHYTERKAAELTKIIVGVVEACHSLGVMHRDLKPENFLLVNKDDDFSLKAIDFGLSVFFKPGQVFTDVVGSPYYVAPEVLLKHYGPEADVWTAGVILYILLSGVPPFWAETQQGIFDAVLKGHIDFDSDPWPLISDSGKDLIRKMLCSQPSERLTAHQVLCHPWICENGVAPDRSLDPAVLSRLKQFSAMNKLKKMALRVIAESLSEEEIAGLREMFQAMDTDNSGAITFDELKAGLRRYGSTLKDIEIRDLMEAADVDKSGTIDYGEFIAATFHLNKLEREEHLIAAFQYFDKDGSGYITVDELQQACAEHNMTDAFLEDIIREVDQDNDGRIDYGEFAAMMQKGNAGIGRRTMRNSLNLSMRDAPSAQ

SEQ ID NO: 3929 - protein, 315 aa, Glycine max
MAPPRGRGGSRGGGGGGFRGGGRGDRGRGRGGGGRGGDRGTPFKARGGGRGGGGRGGGRGGGRGGGRGGMKGGSKVVVQPHRHDGIFIAKGKEDALVTKNLVPGEAVYNEKRITVQNEDGTKEEYRVWNPFRSKLAAAILGGVDNIWIKPGARVLYLGAASGTTVSHVSDVVGPTGVVYAVEFSHRSGRDLVNMAKKRTNVIPIIEDARHPAKYRMLVGMVDVIFSDVAQPDQARILGLNASYYLKTGGHFVISIKANCIDSTVPAEAVFESEVNKLKADQFKPFEQVTLEPFERDHACVVGGYRMPKKKKDAAE

SEQ ID NO: 3930 - protein, 419 aa, Glycine max
MKHTCGRTKQQNPGKRESVGKAVADSNNILNLGEAGGLGNASHVKGESGVTIEESLAATQNRIRVQQNNPQVPICFFCGLNTLVRSFTPSLPSTVTATTTAINQSLCAKCCCRGGFGGGGGFRGGGRGDRGRGRGGGGRGGDRGTPFKARGGGRGGGGRGGGKGGGRGGGRGGMKGGSKVVVQPHRHDGIFIAKGKEDALVTKNLVPGEAVYNEKRITVQNEDGSKDEYRVWNPFRSKLAAAILGGVDNIWIKPGARVLYLGAASGTTVSHVSDVVGPTGVVYAVEFSHRSGRDLVNMAKKRTNVIPIIEDARHPAKYRMLVGMVDVIFSDVAQPDQARILGLNASYYLKAGGHFVISIKANCIDSTVPAEAVFESEVNKLKADQFKPFEQVTLEPFERDHACVVGGYRMPKKKKDAAE

SEQ ID NO: 3931 - protein, 522 aa, Glycine max
  misc_feature (170)..(170): Xaa can be any naturally occurring amino acid
MAGGGFTSGGGAGDFEAKITPIVIISCIMAATGGLMFGYDVGVSGGVTSMPPFLKKFFPTVYRKTVEEKGLDSNYCKYDNQGLQLFTSSLYLAGLTSTFFASYTTRRLGRRLTMLIAGVFFICGVVLNAAAQDLAMLIVGRILLGCGVGFANQAVPVFLSEIAPSRIRGXLNILFQLNVTIGILFANLVNYGTNKIKGGWGWRLSLGLAGIPAVLLTLGALFVVDTPNSLIERGRLEEGKTVLKKIRGTDNIELEFQELLEASRVAKEVKHPFRNLLKRRNRPQLVISVALQIFQQFTGINAIMFYAPVLFNTLGFKNDASLYSAVITGAVNVLSTVVSIYSVDKVGRRILLLEAGVQMFLSQVVIAIILGIKVTDHSDDLSKGIAILVVVMVCTFVSSFAWSWGPLGWLIPSETFPLETRSAGQSVTVCVNLLFTFVIAQAFLSMLCHFKFGIFLFFSGWVLVMSVFVLFLLPETKNVPIEEMTERVWKQHWFWKRFIDDAADEKVAHVSNGNGFDPTSRL

SEQ ID NO: 3932 - protein, 166 aa, Glycine max
MAFVTTAEVCDANPQLILSGELRALQPVFQIYGRRQVFSGPIVTLKVFEDNVLVREFLEEKGNGRVLVVDGGASLRCAILGGNPVVQAQNNGWAGIVVNGCIRDVDEINGCDIGVRALASHPMKANKKGMGEKHVPVNIAGTRISDGDWLYADTDGILISRTELSV

SEQ ID NO: 3933 - protein, 235 aa, Glycine max
MGGGNGQKAKMARERNMEKNKPAKVRGQQEGHEHPVQGVHADIHMYHIGRNALHALRSRISDPNNVLQSWDPTLVNPCTWFHVTCDSNNHVIRLDLGNSNVSGTLGPELGQLQHLQYLELYRNELTGKIPKELGNLKSLISMDLYDNKLEGKIPKSFGKLKSLKFLRLNNNKLTGSIPRELTRLTNLKIFDVSNNDLCGTIPVEGNFESFPMESFENNRFSGPELKGLVPYDFGC

SEQ ID NO: 3934 - protein, 212 aa, Glycine max
MAPFVSLSLLLLFLNHPLLSLSTNPEGNALHALRSRLSDPNNMLQSWDPTLVNPCTWFHVTCDSNNHVIRLDLGNSNVSGTLGPELGQLQHLQYLELYRNEITGKIPKELGNLKSLISMDLYDNKLEGKIPKSFGKLKSLKFLRLNNNKLTGSIPRELTRLTDLKIFDVSNNDLCGTIPVEGNFESFPMESFKNNRFSGPELKGLVPYDFGC

SEQ ID NO: 3935 - protein, 250 aa, Glycine max
YFFPSLSHQNNLLTKEEKWHLSFPSLCCFSFSTTPSFPSQPTLKLASRLKLGLNSFDLIQIICVGNALHALRSRLSDPNNMLQSWDPTLVNPCTWFHVTCDSNNHVIRLDLGNSNVSGTLGPELGQLQHLQYLELYRNEITGKIPKELGNLKSLISMDLYDNKLEGKIPKSFGKLKSLKFLRLNNNKLTGSIPRELTRLTDLKIFDVSNNDLCGTIPVEGNFESFPMESFKNNRFSGPELKGLVPYDFGC

SEQ ID NO: 3936 - protein, 501 aa, Glycine max
MARKMLIDGEAELAQGGGEEVSNFDFDLFIIGAGSGGVRAARFSSNFGAKVGICELPFHPISSETIGGVGGTCVIRGCVPKKILVYGASFGGDLEDARNYGWELSEKVDFNWKKLLQKKTDEINRLNGLYKRMLSNWGVKLFEGEGKIVGPNEVEVTQLDGTKLSYTAKHILIATGSRAQRPNIPGQELGITSDEALSLEDLPKHAVVLGGGYIAVEFASIWRGMGSTVDLVFRKELPLRGFDDEMRAAVARNLEGRGINLHPRTNLTQLIKTEDGIKVITDHGEELIADAVLFATGRAPNSKRLNLETVGVELDNTGAIKVDEYSRTSIPSIWAVGDVTNRMNLTPVALMEASYFAKTVFGGQTIKPDYSNIPYAVFSIPPLSVVGLSEEQAIEQTNGDLLVFTSTFNPMKNTISGRQEKTVMKLVVDAETDKVLGASMCGPDAPEIMQGIAVALKCGATKAQFDSTVGIHPSAAEEFVTMRSVTRRVAGTGSVKPKTNL

SEQ ID NO: 3937 - protein, 440 aa, Glycine max
MNGGDEVVAAPAGPPQPLEWKFSQVFGERTAGEEVQEVDIISAIEFDKSGDHLATGDRGGRVVLFERTDTKDHHGSRRNLERMDYSTSRQGKGRYKTAIQSHESRPYLANGGSPDRYNYISNDFSFPPGGIPSLRLPMVVSSHETSLVARCRRVYAHAHDYHINSISNNSDGETFISADDLRINLWNLEISNQSFNIVDVKPANMEDLTEVITSAEFHPTHCNTLAYSSSKGSIRLVDLRQSALCDSHAKLFEEQEAPGSRSFFTEIIASISDIKFGKDGRYILSRDYMTLKLWDINMDSGPVATFQVHEYLRPKLCDLYENDSIFDKFECCLSGDGLRVSTGSYSNLFRVFGCVPGSTEATTLEASKNPMRRQVPTPSRPSRSLGNSITRVVRRGAESAGVDANGNSFDFTTKLLHLAWHPTENSIACAAANSLYMYYA

SEQ ID NO: 3938 - protein, 554 aa, Glycine max
  misc_feature (490)..(490): Xaa can be any naturally occurring amino acid
MLVLFETPAGFALFKVLDEGKLSKVEDLWKNFSSADTARQVVKLKAFSKFENTSEALEAATLLIDGKASKGLRKFLRVHCENETLGVADSKLGNVIKEKLKIDCIHNNAVMELMRGVRNQLTELISGLAVQDMAPMSLGLSHSLSRYKLKFSAEKVDTMIVQAIGLLDDLDKELNTYAMRVREWYGWHFPELTKIIQDNILYARAVKLMGDRVNAASLDFSEILPEEVEAELKEASVISMGTEIGELDLANIRELCDQVLSLSEYRAQLYDYLKSRMNTIAPNLTAMVGELVGARLIAHGGSLLNLAKQPGSTVQILGAEKALFRALKTKHATPKYGLIYHASLIGQAAPKFKGKISRSLAAKTALAIRCDALGDSQDNTMGLENRAKLEARLRNLEGKELGRFAGSAKGKPKIEAYDKDRKKGAGGLITPAKTYNPSADSVIGQMVNSAMDEDAQEPSVADKKKEKKEKKKKKKKDKNEGDETVQADGXEEPEPEVVKKDKKKKRKETESAELQNGNDDNAGEKKKKRKKQGEQEESPEMPSKKKGKKKKSED

SEQ ID NO: 3939 - protein, 494 aa, Glycine max
MLVLFETPAGFALFKVLDEGKLSKVEDLWKNFSSADTARQVVKLKAFSKFENTSEALEAATLLIDGKASKGLRKFLRVHCENETLGVADSKLGNVIKEKLKIDCIHNNAVMELMRGVRNQLTELISGLAVQDMAPMSLGLSHSLSRYKLKFSAEKVDTMIVQAIGLLDDLDKELNTYAMRVREWYGWHFPELTKIIQDNILYARAVKLMGDRVNAASLDFSEILPEEVEAELKEASVISMGTEIGELDLANIRELCDQVLSLSEYRAQLYDYLKSRMNTIAPNLTAMVGELVGARLIAHGGSLLNLAKQPGSTVQILGAEKALFRALKTKHATPKYGLIYHASLIGQAAPKFKGKISRSLAAKTALAIRCDALGDSQDNTMGLENRAKLEARLRNLEGKELGRFAGSAKGKPKIEAYDKDRKKGAGGLITPAKTYNPSADSVIGQMVNSAMDEDAQEPSVADKKKEKKDKLETSSKKKKKKKKKKKKKKKKGRP

SEQ ID NO: 3940 - protein, 531 aa, Glycine max
MASAYRNEPNWPRHRSGGAGFMGKVPFSNPNPNPNSNPKLANGKKTQSASDDASSINRRSNDAATHSQYVTFNVASCTKKELNDFKNRLVSELEQIQKLRNQIGSSEFQPGQSLNGHPKKPLGKKISGNKRPLPSNSAKDLKRSHSEVGNLMKCCSQVLQKLIKHKHGWVFKAPVDVVGLKLHDYCDIIKQPMDLGTVKSNLSKNVYATPADFASDVRLTFNNALAYNPKGHDVYTMAEQLLARFEELYRPVHEKFEGSIVHDRESEEELQASSWSQVEPERVKKKENPIPPAKLHKEPPPQHPASSSNPPLVQSPVRTPSPMRAPPVKPLKQPKPKAKDPNKRDMSLEEKHKLGLGLQSLPPEKMEQVVQIIRRRNGHLKQDGDEIELDIEAVDTETLWELDRLVTNYKKMVSKIKRQALMGNIDNNNNDVQSNKGNGELPSSEKVDGGPVEVKKPKKVEAGDEDIDIGDEMPTSMFPPVEIEKDKDVVGGHASSSSSSSGSSSSDSSSSSDSDSGSSSGSDSEADNGHS

SEQ ID NO: 3941 - protein, 534 aa, Glycine max
  misc_feature (277)..(277): Xaa can be any naturally occurring amino acid
  misc_feature (426)..(426): Xaa can be any naturally occurring amino acid
MASAYRNEPNWPRHRSGGAGFMGKVPFSNPNPNPNSNPKLANGKKTQSASDDASSINRRSNDAATHSQYVTFNVASCTKKELNDFKNRLVSELEQIQKLRNQIGSSEFQPGQSLNGHPKKPSGKKISGNKRPLPSNSAKDLKRSHSEAGNLMKCCSQVLQKLIKHKHGWVFKAPVDVVGLKLHDYCDIIKQPMDLGTVKSNRSKNVYATPADFASDVRLTFNNALAYNPKGHDVYTVAELLLTRFEELYRPLHEKFEGSVGHDRESEEELQASSWSXRCSPERVKKKENPTPPPPPPPEKLQQEPPQPPASSSNPPLLQSPVRTPSPMRAPPVKPLKQPKPKAKDPNKRDMSLEEKHKLGLGLQSLPPEKMEQVVQIIRRRNGHLKQDGDEIELDIEAVDTETLWELDRLVTNYKKMVSKIKRAGXMGNIYNDNVQANKGNEELPAREKVERAAVEAKKPKKVEAGDEDVDIGDEIPTSMFPPVEIEKDKDVAGGHASSSSCSSGSSSSDSSSSSDSDSGSSSGSDSEADNGQS

SEQ ID NO: 3942 - protein, 236 aa, Glycine max
TRPISAKGKKVVVIGGGDTGTDCIGTSIRHGCSSIVNLELLPQPPQTRAPGNPWPQWPRIYRVDYGHQEGAAKFGKDPRSYEVLTKRFVGDENGVVKGLEVIRVRWEKDETGRFQFKEIEGSEEIIEADLVLLAMGFLGPESTIAEKLGIERDNRSNFKAEYGRFSTSLKGVFAAGDCRRGQSLVVWAISEGRQAAAQVDSFLTNEDLEHNVAGSPDELIKKKQQPRDTVAVANKQ

SEQ ID NO: 3943 - protein, 1240 aa, Glycine max
PRVRSKLIHELNKACNLRGLLKFKEAAVKVSLDEVEPASEIVKRFCTGAMSYGSISARAHTALATAMNKIGGKSNTGEGGEQPSRMEPLSDGSRNPKRSAIKQVASGRFGVTSYYLTNADELQIKMAQGAKPGEGGELPGHKVVGDIAVTRNSTPGVGLISPPPHHDIYSIEDLAQLIHDLKNANPAARVSVKLVSEAGVGVVASGVVKGHADHVLISGHDGGTGASRWTGIKNAGLPWELGLAETHQTLVANDLRGRTVLQTDGQIKTGRDVAIATLLGAEEFGFSTAPLITLGCIMMRKCHKNTCPVGIATQDPVLREKFAGEPEHVINFFFMIAEEMREIMSQLGFRTVNEMVGRSDMLEVDKEVIKSNEKLENIDLSLLLRPAAELRPEAAQYCVQKQDHGLDMALDNKLISLSNAALEKGLPVYIETPIHNVNRAVGTMLSHAVTKKYHLNGLPTDTIHIRFNGSAGQSFGAFLCPGITLELEGDGNDYVGKGLSGGKIVVFPPKESTFDPKQNIVIGNVALYGATSGEAYFNGMAAERFCVRNSGAKAVVEGVGDHGCEYMTGGIVVVLGNTGRNFAAGMSGGIAYVLDMDGKFLSRCNHELVDLDKVEEEEDITTLRMLIQQHQRHTNSVLAKEVLADFENLVPKFIKVFPKEYKRVLASIKSKEASKDAAESASKHGEEQDEIELVEKDAFEELKKLATASVNGKPIEAESFKRPSQVIDPVKHRGFVAYEREGVQYRDPNARINDWNEVMKETKPGPLLKTQSARCMDCGTPFCHQENSGCPLGNKIPEFNELVYQNRWREALERLLETNNFPEFTGRVCPAPCEGSCVLGIIENPVSIKSIECAIIDKAFEEGWMVPRPPARRTGKRVAVVGSGPSGLAAADQLNKMGHTVTVYERADRIGGLMMYGVPNMKTDKVDIVQRRVNLMAEEGINFVVNANIGHDPLHSLDRLREENDAIVLAVGATKPRDLPVPGRELSGVHFAMEFLHANTKSLLDSNLQDGNFISAKGKKVVVIGGGDTGTDCIGTSIRHGCSSIVNLELLPQPPQTRAPGNPWPQWPRIYRVDYGHQEGAAKFGKDPRSYEVLTKRFVGDENGVVKGLEVIRVLWEKDETGRFQFKEIEGSEEILEADLVLLAMGFLGPEPTIAEKLGIERDNRSNFKAEYGRFSTSLKGVFAAGDCRRGQSLVVWAISEGRQAAAQVDSFLTNEDIEHNVAGSPDDKLQHKFAVPNKQ

SEQ ID NO: 3944 - protein, 295 aa, Glycine max
  misc_feature (12)..(12): Xaa can be any naturally occurring amino acid
  misc_feature (108)..(108): Xaa can be any naturally occurring amino acid
FLPTRVEAQDEXELAEKDSFEELKNLATASVNGKPIEAESFKRPSQVIDPVKHRGFVAYEREGVQYRDPNARINDWNEVMKETKPGPLLKTQSARCMDCGTPFCHQEXRVAVVGSGPSGLAAADQLNKMGHTVTVYERADRIGGLMMYGVPNMKTDKVDIVQRRVNLMAEEGINFVVNANIGHDPLYSLDRLREENDAIVLAVGATKPRDLPVPGRELSGVHFAMEFLHANTKSLLDSNLQDGNFISAKGKKVVVIGGGDTGTDCIGTSIRHGCSSIVNLELLPQPPQTRAPGNP

SEQ ID NO: 3945 - protein, 368 aa, Glycine max
  misc_feature (328)..(328): Xaa can be any naturally occurring amino acid
MATTNPFDLLGDDAEDPSQLIAAEQLKAAAAAATAPPKKDQAKPGARSGAPAQLPSKPLPPSQAVREAKNETSYGGRGGGRGGGRGFGRGRGGGGGFGRDFSNDDNSSAPANQGSFEGDSGNPSERRGYGGPRGPYRGGGSGRGRRGGFSNGETGDEGRPRRAFERHSGTGRGNEFKREGSGRGNWGTQNDDIAEVTEEVVNETEKVLADEKPVGEEDAAEGNKDSPANENEEKEPEDKEMTLEEYEKVLEEKRKALQAQKTEARKVDIKEFASMQPLSNKKENDEIFIKLGSDKDKRKDALEKEEKSKKSVNITEFLKPAEGERYYXGGRGRGRGRGSRGGYSGNAYSNAPAPSIEDPGHFPSLGGK

SEQ ID NO: 3946 - protein, 479 aa, Glycine max
MNSDQFQKNSMFVETPEDGGKNFDDDGRVRRTGTWITASAHIITAVIGSGVLSLAWAIAQMGWVAGPAVLFAFSFITYFTSTLLADCYRSPDPVHGKRNYTYSDVVRSVLGGRKFQLCGLAQYINLVGVTIGYTITASISMVAVKRSNCFHKHGHHVKCYTSNNPFMILFACIQIVLSQIPNFHKLWWLSIVAAVMSFAYSSIGLGLSVAKVAGGGEPVRTTLTGVQVGVDVTGSEKVWRTFQAIGDIAFAYAYSNVLIEIQDTLKSSPPENKVMKRASLIGILTTTLFYVLCGCLGYAAFGNDAPGNFLTGFGFYEPFWLIDFANICIAVHLVGAYQVFCQPIFGFVENWGKERWPNSHFVNGEHALKFPLCGTFPVNFFRVVWRTTYVIITALIAMMFPFFNDFLGLIGSLSFWPLTVYFPIEMYIKQSKMQRFSFTWTWLKILSWACLIVSIISAAGSIQGLAQDLKKYQPFKAQQ

SEQ ID NO: 3947 - protein, 147 aa, Glycine max
MFKSKLDWWDYVGDMFTEEQNELIESAAEMLYGLIHARYILTSKGMAAMLDKYKNYDFGRCPRVYCSGQPCIPVGQSDIPRSSTVKIYCPRCEDIYYPRSKYQGNIDGAYFGTTFPHLFLMTYGQLKPQKPSQSYVPRVFGFKLHKP

SEQ ID NO: 3948 - protein, 176 aa, Glycine max
MELSEGECIILALTLTTIFSILELCFRDNRAGMYKERERGGVSVSASKSEDRKRINDVLDKHLERSSPSTSRPINTASKNSNLQVEESETESEESDVSGSDGDDTSWISWFCNLRGNEFFCEVDDDYIQDDFNLCGLSSQVPYFDYALDLILDVESSHGDMFTEEQNELIESAAEC

SEQ ID NO: 3949 - protein, 234 aa, Glycine max
  misc_feature (148)..(148): Xaa can be any naturally occurring amino acid
MYKERERVGVSVSASKSEDRKRINDVLDKHLERSSPSTSRPITSASKNSNLQVEESETESEESDVSGSDGDDTSWISWFCNLRGNEFFCEVDDDYIQDDFNLCGLSSQVPYYDYALDLILDVESSHGDMFTEEQNELIESAAEMLYGXLIHARYVLTSKGMAAMLDKYKNYDFGRCPRLYCSGQPCLPAGQSDIPRPSTVKFLPPGCLALYYPRSKYQGSILISITLPFFCGGI

SEQ ID NO: 3950 - protein, 375 aa, Glycine max
MSKTSEIITCKAAICWGIGKPVTVEEIQVDPPKATEVRVKMLCASICSTDISSTKGFPHTNFPIALGHEGVGIIESVGDQVTNLKEGDVVIPTYIGECQECENCVSEKTNLCMTYPVRWTGLMPDNTSRMSIRGERIYHIFSCATWSEYMVSDANYVLKVDPTIDRAHASFISCGFSTGFGAAWKEAKVESGSTVAVFGLGAVGLGAVIGSKMQGASRIIGIDTNENKRAKGEAFGITDFINPGDSNKSASELVKELSGGMGADYSFECTGVSTLLSESLEATKIGTGKAIVIGVGIEITLPLGLFAILLGRTLKGSVFGGLRAISDLSILADKGHKKEFPLQELFTHEVTLADINKAFELLKQPNCVKVVINMP

SEQ ID NO: 3951 - protein, 434 aa, Glycine max
MVLSWTRRNVFRRAKKEKEQSQLLEVEVVIPNHFRCPVSLELMTDPVTLSTGITYDRVSIEKWIEGENRTCPVTNQVLTTFDLIPNHAIRMMIQDWCVQNSSYGIERIPTPRIPISSYEVSDTCTRILSACQRGDDERCQELVGKIKVWSRESERNKRCIVGAGAGAVLAYAFDCFSSNSIDKHVVVLEEVLEVMTWMIPFGEEGVSKLSSRASLNSLVWFLEGKDLASRQSAALLLKEVCVQELAKVGNVVEALVKMLREPIGSSTSTKACLATIFNLVSLAANREGIAQRFVELGLVSLLLEAIVDGEKGVCEKALGVLDCICDCEKGKEVVKSNALALPLVVKKLLRVSPLASGFAVSILRKICDKREEGILVEALQVGLFQKLLVLLQVGCDESTKENATRLLKLLNGYRNKAECTDSSSLDFKHLKKPF

SEQ ID NO: 3952 - protein, 281 aa, Glycine max
  misc_feature (226)..(226): Xaa can be any naturally occurring amino acid
MAATSSLCSSTLQSQINGFFLHKTSLSHTPSLTFSRRKISTTVKATSRVDKFSKSDIIVSPSILSANFSKLGEQVKAVELAGCDWIHVDVMDGRFVPNITIGPLVVDALRPVTDLPLDVHLMIVEPEQRVPDFIKAGADIVSVHCEQSSTIHLHRTVNQVKSLGAKAGVVLNPGTPLSAIEYILDVVDLVLIMSVNPGFGGQSFIESQVKKISDLRRLCAEKGVNXPWIEVDGGVGPANAYKVIEAGANALVAGSAVFGAKDYAEAIRGIKTSKRPEVVAV

SEQ ID NO: 3953 - protein, 280 aa, Glycine max
  misc_feature (174)..(174): Xaa can be any naturally occurring amino acid
MAATSSLCSSTLQSQINGFCLHKTSLSHPRSLTFSRKKISTTVKATSRVDKFSKSDIIVSPSILSANFAKLGEQVKAVELAGCDWIHVDVMDGRFVPNITIGPLVVDALRPVTDLPLDVHLMIVEPEQRVPDFIKAGADIVSVHCEQSSTIHLHRTVNQVKSLGAKAGVVLNPXTPLSAIEYILDVVDLVLIMSVNPGFGGQSFIESQVKKISDLRRVCAEKGVNPWIEVDGGVGPANAYKVIEAGANALVAGSAVFGAKDYAEAIRGIKTSKRPEAVAV

SEQ ID NO: 3954 - protein, 325 aa, Glycine max
MSSGAGKVVCVTGASGYIASWIVKFLLNRGYTVKATVRDTSDPKKINHLVGLDGAKERLHLYKANLLEEGSFNSVVQGCHAVFHTASPFYHNVKDPQAELLDPALKGTLNVLKSCVNLPTLERVVLTSSVAAVAYNGKPRTPDVVVDETWFSDPGFCRESQMWYTLSKTLAEDAAWKFVKENNIDMVTINPAMVIGPLLQPVLNTSAASILNVINGAQTFPNASFGWVNVKDVANAHILAYENASANGRYCLVERVAHYSEIVKILRDLYPTLQLPEKCADDNPYVPIYQVSKEKAKSLGIEYTPLEVSLKETVDSLKEKKFTNF

SEQ ID NO: 3955 - protein, 662 aa, Glycine max
MEGENASNKVIELMNEIASISDYRPPVKKQYCNLARRLKLLIPMFEEIRDMNKDALPDNTSNAVLAFKEALESAMELLRFGSEGSKLYLVLERDEIMNKFYKVTAQLEQSLGGISYDKLDISDEVKEQVELVLAQFRRAKGRVDEPDVRLYEDMLSVYNNSSDAATDPSVLSQLAEKLKLMGIADLTQESLALHEMVASSGGDPGARIEKMSMLLKKIKDFVQIENLVKDDNLGGKGIFSKVYGLGTNEKSHQAPVIPDDFRCPISLELMKDPVIVSTGQTYERTCIEKWLQAGHGTCPKTQQTLTSTVLTPNYVLRSLIAQWCEANGIEPPKRPSGSQPSKSASAYSPAEQSKIGSLLQKLISVSPEDQRSAAGEIRLLAKRNADNRVAIAEAGAIPLLVSLLSVPDSRTQEHAVTALLNLSIYENNKGSIVSSGAVPGIVHVLKKGSMEARENAAATLFSLSVIDENKVTIGSLGAIPPLVTLLSEGSQRGKKDAATALFNLCIYQGNKGKAVRAGVIPTLMRLLTEPSGGMVDEALAILAILASHPEGKVTIRASEAVPVLVEFIGNGSPRNKENAAAVLVHLCSGDQQYLAQAQELGVMGPLLELAQNGTDRGKRKAGQLLERMSRLVEQQQEVPTQTETQAQNEDTEPPLITNPDDS

SEQ ID NO: 3956 - protein, 453 aa, Glycine max
  misc_feature (403)..(404): Xaa can be any naturally occurring amino acid
MEIGSPAFLTLEDYSSFFFPDMDPIPNSNVNKRRANNDQFDLNDSAFSHLLNSIMDPNHFQHQSKPIQFDSSPTKRARRDLLVLEDSHLNPASAPQQQRRLWVKDRSKDWWQRCNSPDFPEEEFRRHFRMSKATFDMICQHLDSAVTKKNTMLREAIPVRQRVAVCIWRLATGDPLREVSKRFGLGISTCHKLVLEVCSAIKSVLMPKFLHWPNEAEMKPITEKFESLSGIPNVGGSMYTTHIPIIAPKSNVNAYFNKRHTERNQKTCYSITVQGVVDPKGIFSDVCIGWPGSLSDDQVLEKSALYQRATMGNLKDVWVVGNSGHPLMEGVLVPYTHQNLTWTQHAFNQKVGEIQSIAKDAFARLKGRWSCLQKRTEVKPEPLPVLLGACCVLHIICEHDPPXXLNPECRCAIPTDDQMLPQNNNVRSNAAEQARDQIAHYLLHHGRAGTNFF

SEQ ID NO: 3957 - protein, 451 aa, Glycine max
MEIGSPAFLTLEDYSSFFFPDMDPIPNSNVNKRRANNDQFDLNDSAFSHLLNSIMDPNHFQHQSKPIQFDSSPTKRARRDLLVLEDSHLNPASAPQQQRRLWVKDRSKDWWQRCNSPDFPEEEFRRHFRMSKATFDMICQHLDSAVTKKNTMLREAIPVRQRVAVCIWRLATGDPLREVSKRFGLGISTCHKLVLEVCSAIKSVLMPKFLHWPNEAEMKPITEKFESLSGIPNVGGSMYTTHIPIIAPKSNVNAYFNKRHTERNQKTCYSITVQGVVDPKGIFSDVCIGWPGSLSDDQVLEKSALYQRATMGNLKDVWVVGNSGHPLMEGVLVPYTHQNLTWTQHAFNQKVGEIQSIAKDAFARLKGRWSCLQKRTEVKLEDLPVLLGACCVLHNICEMRDEEMKPQWNFDIFDDQMLPQNNNVRSNAAEQARDQIAHYLLHHGRAGTNFF

SEQ ID NO: 3958 - protein, 454 aa, Glycine max
  misc_feature (104)..(104): Xaa can be any naturally occurring amino acid
  misc_feature (182)..(182): Xaa can be any naturally occurring amino acid
  misc_feature (240)..(240): Xaa can be any naturally occurring amino acid
  misc_feature (301)..(301): Xaa can be any naturally occurring amino acid
  misc_feature (338)..(338): Xaa can be any naturally occurring amino acid
  misc_feature (377)..(377): Xaa can be any naturally occurring amino acid
  misc_feature (381)..(381): Xaa can be any naturally occurring amino acid
  misc_feature (426)..(426): Xaa can be any naturally occurring amino acid
  misc_feature (439)..(439): Xaa can be any naturally occurring amino acid
ISHKRGMKLRLMNGIAYNETWFGSWGYKFGRGCFGVTQSMYHKAIQAIRSMSLYLIIHHIANSSHGIPLIFSRNQTLSDQSSYIVPPPFCYMLDLKSCLPRETXISSYKTNALVETNCRWSPKRIEMATRVIVEALKRTEFKWVSRQEVRDAARAYISDTSLVDFVLRSLGNHVEGNYLVRXSLNLVTKVLEYCLEDISDVYPYNEGLVMSNKVKDKYKITRAQLMKDMLYLYKYILIDXKPIMRSEFLSAIPLAARIILGTKYFIKDYFGDIPHQVELGSDDKLNIYCTIWLRNNVGSGXYLNKAIMPPHECITLKRNATINDLKLEVERDFREICXELRSFMVESFGNLSVNNETMAFGLIEVGGKVVLEGWHGXHMNXMIEQICESDMNNGIMDCTCGTIEDDGERMVSCDICEIWQHTRCVXIPNDEEIPHIFLXCKKCEQEIVLFPSLP

SEQ ID NO: 3959 - protein, 432 aa, Glycine max
MASKEFSGLCSLAPSLSESILCTTGLKMYMLESKGGAIACMFLSLFFLGTWPALLTMLERRGRLPQHTYLDYSITNFLAALLIAFTLGGIGKGTHDQPNFLVQLAQDNWPSVLFAMGGGLFLSLGNLSCQYAFAFVGLSVTEVITASITVVIGTTLNYFLDDKINKAEILFPGVGCFLIAVFLGSAVHSSNAADNKAKLNNFTGDYKNGDTSLKDGDIVKSKDLEGGSSSADNVEAGTAVFLVELEEKRAIKVFGKSTLIGLALTFFAGLCFSMFSPAFNIATNDQWNTLKKGVPHLTVYTAFFYFSISCFVIAMILNITFLYHPVLNLPKSSFKAYLADSDGRVWALLAGLLCGFGNGLQFMGGQAAGYAAADAVQALPLVSTFWGVILFGEYRKSSRRTYILLGSMLFMFIVAVAVLMASSGQRNSTAKE

SEQ ID NO: 3960 - protein, 286 aa, Glycine max
MYRERGGVGSKSEVTSVDRKRINDVLDKQLERSSPSTSRAAGAINGKDRSSSSLLAAAKDSRSASVTAPISKNSNASDEESETDSEESDVSGSDGDDTSWISWFCNLRGNEFFCEVDDDYIQDDFNLCGLSSQVPYYDYALDLILDVESSHGDMFTEEQNELIESAAEMLYGLIHARYILTSKGMAAMLDKYKNYDFGRCPRVYCSGQPCIPVGQSDIPRSSTVKIYCPRCEDIYYPRSKYQGNIDGAYFGTTFPHLFLMTYGQLKPQKPSQSYVPRVFGFKLHKP

SEQ ID NO: 3961 - protein, 325 aa, Glycine max
MSSSAGKLVCVTGAAGYIASWIVKFLLERGYTVRATVRNPNDHTKVEHLLKLEGAKERLHLFKADLLGENSFDSIVEGCDGVFHTASPFIINVKDPQADLLDPAVKGTLNVLKSCVKSPSVKRVILTSSVAAVAYNKRPKSPEVVVDETWWSDPDYCRELKLWYLLSKTLAEDAAWKFAKENDLDLVVVNPAMVVGPLLQAELNTSAAIILNLINGSETFSNDTYGWINVKDVANAHIQAYEIASASGRYCLVERVAHYSELARILRDQYPTYQIPEKSADDKPYVPTFQVSKEKAKTLGIEFIPLEVSLRETVETLKEKNFANF

SEQ ID NO: 3962 - protein, 386 aa, Glycine max
MAKPVSIEVWNPSGKYRVVSTKPMPGTRWINLLVQNDVRLEICTEKKTILSVEDIIALIGDKCDGVIGQLTEDWGEQLFSTLSKAGGKAFSNMAVGYNNVDVDAANKYGVAVGNTPGVLTETTAELAASLTLAAARRIVEADEFMRAGLYDGWLPHLFVGNLLKGQTVGVIGAGRIGSAYARMMVEGFKMNLIYYDLYQSTRLEKFVTAYAAFLKANGETPVTWKRAATMDEVLQEADIISLHPVLDKTTYHLVNKERLAKMKKEAILINCSRGPVIDEAALVEHLKQNPMFRVGLDVFEEEPYMKPGLAELKNAIVVPHIASASKWTREGMATLAALNVLGKIKGYPVWFDANRVEPFLNENAQPPAASPSIVNAKALGLPTSKL

SEQ ID NO: 3963 - protein, 687 aa, Glycine max
MTTSFGPATTSAPLKDHKVQIPSFHGLRSSSASALPRNALSLPSSTRSLSLIRAVSTPAQSETATVKRSKVEIFKEQSNFIRYPLNEDILTDAPNISEAATQLIKFHGSYQQYNREERGSRSYSFMIRTKNPCGKVSNQLYLTMDDLADQFGIGTLRLTTRQTFQLHGVLKKDLKTVMGTIIRNMGSTLGACGDLNRNVLAPAAPLARKDYLFAQQTAENIAALLAPQSGFYYDIWVDGEKILTSEPPEVVQARNDNSHGTNFPDSPEPIYGTQFLPRKFKIAVTVPTDNSVDILTNDIGVVVVTDDDGEPQGFNIYVGGGMGRTHRLETTFPRLAEPIGYVPKEDILYAVKAIVVTQRENGRRDDRKYSRLKYLISSWGIEKFRSVVEQYYGKKFEPFRALPEWEFKSYLGWHEQGDGKLFYGLHVDNGRIGGNMKKTLREVIEKYNLNVRITPNQNIILTDVRAAWKRPITTTLAQAGLLQPRFVDPLNITAMACPAFPLCPLAITEAERGIPNILKRIRDVFDKVGLKYSESVVVRITGCPNGCARPYMAELGLVGDGPNSYQIWLGGNHKQTSLARSFMDRVKILDLEKVLEPLFYYWKQKRQSKESFGDFTNRMGFEKLKEYIEKWEGPVVAPSRHNLKLFADKETYESMDALAKLQNKTAHQLAMEVIRNYVASNQNGKGE

SEQ ID NO: 3964 - protein, 342 aa, Glycine max
MAAENVVEFTDLPVKRPREEEEEEEEQTNGVSNDAVSTLPNDPQYPGISAVIPGWFSEISPMWPGEAHSLKVEKILFQGKSDYQNVMVFQSSTYGKVLVLDGVIQLTERDECAYQEMITHLPLCSISNPKKVLVIGGGDGGVLREVARHASVEKIDICEIDKMVVDVSKQFFPDIAVGFEDPRVTLTVGDGVAFLKNVPEGTYDAVIVDSSDPIGPAQELFEKPFFASVAKALRPGGVVCTQAESIWLHMHIIEDIVANCRQIFKGSINYAWTTVPTYPSGMIGFMLCSTEGPLVDFKHPVNPINENDSQQSRPLKFYNSEIHTAAFCLPSFAKRKIGSKTN

SEQ ID NO: 3965 - protein, 344 aa, Glycine max
  misc_feature (60)..(60): Xaa can be any naturally occurring amino acid
  misc_feature (143)..(143): Xaa can be any naturally occurring amino acid
  misc_feature (152)..(152): Xaa can be any naturally occurring amino acid
MAAENVVEFTDLPVKRPREEEEEEEEQTNGVSNDAVSALPNDPQYPGISAVIPGWFSEIXSPMWPGEAHSLKMEKILFQGKSDYQNVMVFQSSTYGKVLVLDGVIQLTERDECAYQEMITHLPLCSIPNPKKVLVIGGGDGGXVLREVARHXSVEKIDICEIDKMVVDVSKQFFPDIAVGFEDPRVTLTVGDGVAFLKDVPEGTYDAVIVDSSDPIGPAQELFEKPFFASVAKALRPGGVVCTQAESIWLHMHIIEDIVANCRQIFKGSVNYAWTTVPTYPSGMIGFMLCSTEGPLVDFKHPVNPLSENDSQQSRPLKFYNSEIHTAAFCLPSFAKRKIGSKTN

SEQ ID NO: 3966 - protein, 394 aa, Glycine max
MASPPPPPSLLLLFLTLVAATASSLTCTTQKLTDSKNNLYSNCLDLPALDSFLHWTHDPTNASLSVAFAAAPPNSGGWVSWGINPTAIGMQGAQVLAAYKADNGAVTVKTLDLKSYTAIVPGKLSFDVWDVRGEEVRGVIRIFATVKVPEKAESVNQVWQVGPSVTAGRIDRHDFGPSNMNSKGVLSFNGAQVGGGAVDPITIKKNIHGILNAVSWGVLFPLGVIIARYMRTFPSADPAWFYLHVGCQVSAYAIGVAGWGTGMKLGSESVGIQYRSHRYIGIALFCFATLQIFALFLRPVKDHKYRYIWNIYHHSVGYSIVILGIINIFRGFSILHPDQKWKSTYTAVLIALGAVALFLEVITWIVVLKRKSYKSTKTYDGYNNGQSREEPLNI

SEQ ID NO: 3967 - protein, 203 aa, Glycine max
  misc_feature (23)..(23): Xaa can be any naturally occurring amino acid
  misc_feature (43)..(43): Xaa can be any naturally occurring amino acid
  misc_feature (120)..(120): Xaa can be any naturally occurring amino acid
  misc_feature (176)..(176): Xaa can be any naturally occurring amino acid
MATIGHNNLNAKLVLLGDMGAGXSSLVLRFVKGQFLEFQGINXIAAAFFSQTLAVNDATVKFEIWDTAGQERYHSLAPMYYRGAAAAIIVYDITSSDSFTRAKKWVQELQKQGNPNMVMXALAGNKADLEDKRKVTAEEARVYAEENGLFFMETSAKTASNVNDIFYEIAKRLPKXASPAQNPAGMVLVDRPAEGTRAASCCS

SEQ ID NO: 3968 - protein, 497 aa, Glycine max
MAKKRKLRSSDPEPTKPIEPQQQDQEPVELDQQQQQPNPEQTLEDPNTMAVDEPKQEEEEEEEDEEPQNAESEEEEEEAEEQQEERPPETLEEQQDPETLAAANHAEVNGGNEGNNEEEEEEDLTLEEEPVEKLLEPFTKEQLHSLVTQAVDMFPEFVDSVRRLADVDPAHRKIFVHGLGWDATADTLTAVFGKYGEIEDCKAVTDKVSGKSKGYAFILFKHRDDARKALKHPQKKIGNRTTSCQLASAGPVPAPPPNVTPVSEYTQRKIFVSNVNAEIDPQKLLEFFKQFGEVEDGPLGLDKNTGKPKGFALFVYKSVESAKKALEEPNKNYEGHTLYCQKAVDGPKGSKGYHHQQHSHSHHHHHHHQPHYQRKEKNKYSSGGGGPSHGSGHLMAPSGSAVGGFNPGVPAQGLNPVLGQALTALINQGAGLGLGNLLGGLGGAPVNQAGPPAPYANQPAMGYGNQPAMQPGYQNPQMGQGSGVRPHPGAGAPYMGH

SEQ ID NO: 3969 - protein, 215 aa, Glycine max
MAQDLALDLEELRRLHSIAKRPRTLSLLSSEIRNLEKLSSEEASAQIPAPISTGTKVAPSPALKYAALASFSWDQDSDKVKIYVLMEGIDENKVESEFKSMSFDVKFHDVQGKNYRCAISKLHNEIVPEKCKVVVKPKRAIITLVKASKGNWLDLHFKEDKLKPNLDKEKDPMAGIMDMMKNMYEDGDDEMKKTIAKAWTDARTGKTADPLSSYR

SEQ ID NO: 3970 - protein, 75 aa, Glycine max
  misc_feature (48)..(48): Xaa can be any naturally occurring amino acid
SKAALKGFQWEDSPYVKYKDLEDYKRQGYGTQGHQEPKTGRGAGATEXAPTLSGAAVSSDAQVAATDAINSKGVP

SEQ ID NO: 3971 - protein, 386 aa, Glycine max
MEGEEGSQQPQLVLADKLFLLRQPDVQDIDKVRYKEDVFTHVKENDMVPLYETLVADSVLDLDRALLDSMRAKIDDELTKLDEKIADAEENLGESEVREAHLAKSLFFIRIMDKEKALEHLKVTETKTVAVGQKMDLVFYTLQLGFFDMDFDLISKSIDKAKNLFEEGGDWERKNRLKVYEGLYCMSTRNFKKAAKLFLDSISTFTTYELFPYDTFIFYTVLTSIISLDRVSLKQKVVDAPEILTVIGKIPYLSEFLNSLYDCQYKSFFSAFAGLTEQIKLDRYLHPHFRYYMREVRTVVYSQFLESYKSVTIEAMAKAFGVTVDFIDVELSRFIAAGKLHCKIDKVEGVLETNRPDAKNALYQATIKQGDFLLNRIQKLSRVIDL

SEQ ID NO: 3972 - protein, 386 aa, Glycine max
MEGEEGSQQPQLVLADKLFLLRQPDVQDIDKVRYKEDVFTHVKENDMVPLYETLVADSVLDLDRALLDSMRAKIDDELTKLDEKIADAEENLGESEVREAHLAKSLFFIRIMDKEKALEHLKVTETKTVAVGQKMDLVFYTLQLGFFDMDFDLISKSIDKAKNLFEEGGDWERKNRLKVYEGLYCMSTRNFKKAAKLFLDSISTFTTYELFPYDTFIFYTVLTSIISLDRVSLKQKVVDAPEILTVIGKIPYLSEFLNSLYDCQYKSFFSAFAGLTEQIKLDRYLHPHFRYYMREVRTVVYSQFLESYKSVTIEAMAKAFGVTVDFIDVELSRFIAAGKLHCKIDKVAGVLETNRPDAKNALYQATIKQGDFLLNRIQKLSRVIDL

SEQ ID NO: 3973 - protein, 252 aa, Glycine max
GFVFGRVGGRVGGRVGGRVGGAKNVIIAAAEAKVRRVVFTSSIGAVYMDPKRSIDLVVDESCWSDLEFCKNTKNWYCYGKAVAEEAAWDTAKEKGVDMVVVNPVLVLGPLLQPSINASTIHILKYLTGSAKTYANATQAYVHVRDVALAHILVYEKPSASGRYICAESSLHRGELVEILAKYFPDYPVPTKCSDEKNPRAKPYTFSNQKLKDLGLEFTPVSQCLYEAVKNLQEKGHLPVPARQQEDSTTVKP

SEQ ID NO: 3974 - protein, 146 aa, Glycine max
MEVYGKSMVAGPANVIFLSSILGQEGPVPGHKCDWKCQNEHVCGNMYRCKLTGLTHICDKNCNQRILYDNHSSLCRASGQIFPLSPAEEQAVRGVRRKLDAENSPSESCGFKRRRGDAQIHPSPFERSFSAVSPICSQVGDGMDMS

SEQ ID NO: 3975 - protein, 554 aa, Glycine max
QLRRPPPPKFAAARRRQKGEIEFTQEMASPLLTPYKMGKFNLSHRVVLAPLTRQRSYDNVPQPHAILYYSQRTSNGGLLITEATGVSDTAQGYPQTPGIWTKDHVQAWKPIVDAVHAKGGVFFCQIWHVGRVSDSVYQPNGQAPISSTDKPLTPQIRSNGIDQVQFTPPRRLRTDEIPHIVNDFRLAARNAIEAGFDGVEIHGAHGYLLEQFMKDKVNDRTDEYGGSLENRCRFALEVVEAVVNEIGADRVGIRLSPFAEYSESGDSNPKELGLYMMNALNKYGILYCHMVEPRMKTVGEKTECPHSLVPMRKAFNGTFIAAGGYDRQDGPNTNVSNTLPNTTIISMAVQIVGFDGVEIHGAHGYLLEQFMKDKVNDRTDEYGGSLENRCRFALEVVEAVVNEIGADRVGIRLSPFSEYSESGDSNPEQLGLYIINALNKYSILYCHMVEPRMKTVVERVECPQSLVLMRKAFNGTFIAAGGYDRQEGIDAISENRADLVAYGRLFLANPDLPKRFALNAPLNKYHRETFYTHDPVVGYTDYPFHAEESNVVAS

SEQ ID NO: 3976 - protein, 401 aa, Glycine max
  misc_feature (298)..(298): Xaa can be any naturally occurring amino acid
MEGGEEVLPSATATSAATGNPTASPPPLADLVGAPDLAAASDDVVTQPEIHALISDEEHDHEHEHDDDLEHEHDQHEHDHHHEDRDDHAAVAAVSLEDLKLKIIKQAEYYFSDENLPTDKYLLGFVKRNKEGFVPVSVIASFRKIKKLTRDHAFIVAALKESSLLVVSGDGRRVKRLNPLRFNESRDHKLYTVLVENLPEDHSKKNIQQIFHEAGNIKRITIHDPHSTSESAKQHNKQEMLISNKLHALVEYETMEAAEKAVAMLNNEQDGRNGMRVKLLKGMGKYGHKKTSLERTSXEKNSSRHAEQTGDEENHGSNEHHEDAHEEEDGDHLSKDKGGQRYRNQGRSRKHKYRAGNGMGHGSTPSTHAAEASKPPPGPRMPDGTRGFAIGRGRFPVPASN

SEQ ID NO: 3977 - protein, 99 aa, Glycine max
  misc_feature (61)..(61): Xaa can be any naturally occurring amino acid
MEAKIAKALDRVALNLKRKRATRYAAHLSGASQPMLGHWSSFTSQTSRAVKRMRLGGYRNXLTNAGPHIGRSLARRYLNYKKSGRLERMMFYENGEWMD

SEQ ID NO: 3978 - protein, 583 aa, Glycine max
  misc_feature (22)..(22): Xaa can be any naturally occurring amino acid
MEAKIAKALDRVALNLKRKRGXRYAAHLSGASQPMLGHWSSFTSPTSRAVKRMRLGGYRNRLTNAGPHIGRSLARRFLNYKKSGRLERLMFYENGSWLDFPKDVVDLVKKDLEIKRAAVEIESHGYHLLFDFLRLHKMDLKTGLQQPIALIDEAGCCFFPEIYAASDEEPYNLSKQEGGKSPDSYASNEIKLHLEVEINGVDQSRLSECSGESNALVKGIQIDTKENCCQYDVEVEDSINKKDCGNVGEDIQQHQDISLDAYTESVYGKLDLNSVQKMFLKGMCSFGSTDSDIVEIYHCSGASMQARWELFQKQAEITKKNHGEANIRYAWLASSKGELSTMMNYGLSHYGLSGSKCTYGIGVHLAAVTCPDASVRYCDVDENGVRHLALCRVIMGNMEILRPGTDQFHPSSCEYDNGVDAIECPQYYVVWNMNMNTHIYPEFVVSFKVSSDAEGHFCGSEGKNVSGVNTACDGPHGLLNSESSTVDNGKAPSMVSSTPKVPKSPWMPFPVLLDAIRDQVPPTGMDVIKTYYEQFRSKHISRDDFVKMLRLIVGDGLLRTTITNLQYKIPSGGELKDSIKKED

SEQ ID NO: 3979 - protein, 138 aa, Glycine max
  misc_feature (50)..(50): Xaa can be any naturally occurring amino acid
STRLDVAIDMGNPFLNLTVDGFLKIGSVAATRSAAEDTYHIIQKGNISIXDFEKTLKKMCKEGVYWGTIAGVYVGMEYGVERIRGTRDWKNAMIGGAVTGALVSAASNNKKDKIAIDAITGAAIATAAEFINLPYLNE

SEQ ID NO: 3980 - protein, 143 aa, Glycine max
MPSARLSGSPRLDVAIDMGNPFLNLTVDGFLKIGAVAATRSAAEDTYHIIRNGNISSHDFEKTLKKMCKEGVYWGTLAGVYLGMEYGVERIRGTRDWKNAMIGGAVTATLLSVATTNNKDKIVPDAITGAAIATAAEFINYLT

SEQ ID NO: 3981 - protein, 247 aa, Glycine max
  misc_feature (142)..(142): Xaa can be any naturally occurring amino acid
THARVQQRIRPSPTVLYDIFFEQGGKRLGPVGLGDDDQCIEDDFTAWKEELWPALDELLRDEDDATVSTPYTAAVLEYRVVIHDPLEASVDEKKWHNVNGHAIVDAQHPVRANVAVRKELHTPASDRSCTHLEYDISCTGVXRYETGDHVGVYCENLSEAVEEAIRLIGLSPDTYFSIHTDDEDGKPLGGSSLPPTFPPCTLRKALAQYADVLSSPKKSALLALAADASDPSEADRLRHLASPAGKV

SEQ ID NO: 3982 - protein, 657 aa, Glycine max
  misc_feature (387)..(387): Xaa can be any naturally occurring amino acid
RIYSSKFVCISILSCSASPPPLPSLSSLPKRVIEKLPEIEVDDGTKKVTIIFGTQTGTAEGFAKATAEEAKARYEKATFRVVDMDDYAADDDEYEERFKKETHVLFFLATYGDGEPTDNAARFYKWFTEGGEKGEGWLQNLHYGVFGLGNRQYEHFNKVAKVVDDMLVEQGGKRLVPVGLGDDDQCIEDDFTAWKEELWPALDELLRDEDDATVSTPYTAAVLEYRVVIHDPLEASVDEKKWHNVNGHAIVDAQHPVRANVAVRKELHTPASDRSCTHLEFDISGTGVTYETGDHVGVYCENLSETVEEAIRLIGLSPDTYFSIHTDDEDGKPRSGSSLPPTFPPCTLRTALTRYADVLSSPKKSALLALAAHASDPSEADRLRHLXASPAGKDEYSEWVIASQRSLLEVMAEFPSAKPPIGVFFAAVAPRLQPRFYSISSSPRMVPNRIHVTCALVHEKMPTGRIHKGVCSTWMKNSVPLEKSQDCSWAPIFVRTSNFRLPSDNKVPIIMIGPGTGLAPFRGFLQERLALKEGGAELGPSVLFFGCRNRQMDYIYEDELSHFVNTGALDELILAFSREGPTKEYVQHKMMEKASEIWSMISQGAYIYVCGDAKGMARDVHRALHTILQEQGSLDSSKAESMVKNLQTTGRYLRDVW

SEQ ID NO: 3983 - protein, 190 aa, Glycine max
MVLFNVSRVETTPFDGQKPGTSGLRKKVKVFVQPHYLHNFVQSTFNALTVEKVRGATLVVSGDGRYFSKEAIQIITKMSAANGVRRVWIGQNGLLSTPAVSAVIREKLGADGSRATGAFILTASHNPGGPNEDFGIKYNMENGGPAPEGITDKIYENTTTINEYLIASDLPDVDITSTGVTSFTGPGGPF

SEQ ID NO: 3984 - protein, 582 aa, Glycine max
MVLFNVSRVETTPFDGQKPGTSGLRKKVKVFVQPHYLHNFVQSTFNALTVEKVRGATLVVSGDGRYFSKEAIQIITKMSAANGVRRVWIGQNGLLSTPAVSAVIRERVGADGSRATGAFILTASHNPGGPHEDFGIKYNMENGGPAPEGITDKIYENTTTINEYLIASDLPDVDITTTGVTSFTGPEGPFDVEVFDSASDYIKLMKSIFDFESIRKLLSSPKFTFCYDALHGVGGAYAKSIFVDELGAQESSLLNCTPKEDFGGGHPDPNLTYAKELVARMGLGKSEPQDDPPEFGAASDGDADRNMILGKRFFVTPSDSVAIIAANAVEAIPYFSAGLKGVARSMPTSAALDVVAKHLNLKFFEVPTGWKFFGNLMDAGLCSVCGEESFGTGSDHIREKDGIWAVLAWLSILAYKNKDKLEDKLVTVEDIVRQHWATYGRHYYTRYDYENVDAGAAKELMAYLVKLQSSLSEVNQIIKGIRSDVSNVVHGDEFEYNDPVDGSISSHQGIRYLFEDGSRLIFRLSGTGSEGATIRLYIEQYEKDPSKIGRLSNEALAPLVEVALKLSKMEEFTGRSAPTVIT

SEQ ID NO: 3985 - protein, 535 aa, Glycine max
MANERDLFSAEIVNRGIESSGPNAGSLTFSVRVRRRLPDFLQSVNLKYVKLGYHYLINHGIYLFTIPVLLVVFSAEVGSLSKEDLWKKLWEDARYDLATVLASFGVFVFTLSVYFMSRPRPIYLIDFACYKPDDELKVSREQLMEVARKSGKFDEASLEFQKRMLMSSGIGDETYIPKAVIASTENTATMKEGRAEASMVMFGALDELFEKTRVRPKDVGVLVVNCSIFNPTPSLSAMIINHYKMRGNILSYNLGGMGCSAGIIGVDLAKDILQANPNNYAVVVSTEMVGYNWYQGKDRSMLIPNSFFRMGCSAVLLSNRRRDYSRAKYRLEHIVRTHKGADDRSFRCVYQEEDEQKLKGLKISKDLIEIGGDALKTNITTLGPLVLPFSEQLLFFSTLVWRHLFGSKNDGNSPSMKKPYIPDYKLAFEHFCVHAASKTILDELQRNLELSDKNIEASRMTLHRFGNTSSSSIWYELAYMEAKESVRRGDRVWQLAFGSGFKCNSVVWRAMRRVTKPSRNPWLDCINRYPAPLNN

SEQ ID NO: 3986 - protein, 112 aa, Glycine max
  misc_feature (52)..(52): Xaa can be any naturally occurring amino acid
KASVEKTKRRFDNYAKQGLLCSGDGLPHLIVSGDQRHWGEFITPGILFLYIXGWIGWVGRSYLIAIRDEKKPTMKEIIIDVPLASRLLFRGFSWPVAAYRELINGDLIAKDV

SEQ ID NO: 3987 - protein, 504 aa, Glycine max
  misc_feature (343)..(343): Xaa can be any naturally occurring amino acid
MSALSNSSSSHGNSFLKMPAIKFTKLFINGDFVDSISGRTFETIDPRKEEVIARVSEGDKEDIDIAVKAARQAFDSGPWPRLPGSERAKIMMKWADLVDENIEELAALDTIDAGKLYYINKVAEIPSATNALRYYAGAADKIHGDVLKMNGDFHAYTLLEPIGVVGHIIPWNAPSLSFFIKVSPSLAAGCTMVLKPAEQTPLSALFYAHLAKLAGIPDGVLNIVPVFGPTAGAAISSHMDIDAVSFTGSIEVGREVLQAAAWSNLKPVSLELGGKSPLIIFNDADIDKASELALFGIMSNKGEICVAGSRVFVQEEIYDEFEKKLVEKAKSWVVGDPFDPKSXQGPQADRNQLEKILSYIEHGKREGATLLTGGNTVGNKGYYIEPTIFSNVKEDMLIARDEIFGPVLALMKFKTMEEAIKSANNTKYGLAAGIVTKNLDTANTMSRSIRAGIVWINCYFTVGSDVPFGGYKMSGFGRDLGLQALHKYLQVKSVVTPIHNSPWL

SEQ ID NO: 3988 - protein, 390 aa, Glycine max
SGDSNLISFISMATQGQVITCKAAVAWEPNKPLTVQDVQVAPPQAGEVRVQILFTALCHTDAYTWGGKDPEGLFPCILGHEAAGIVESVGEGVTNVQPGDHVIPCYQAECGECKTCKSGKTNLCGKVRSATGVGVMLNDGKSRFSINGKPIYHFMGTSTFSQYTVVHDVSVAKIDPKAPLEKVCLLGCGVSTGLGAVWNTAKVESGSIVAIFGLGTVGLAVAEGAKTAGASRVIGIDIDSKKFDVAKNFGVTEFINPNEHDKPIQQVIIDRTDGGVDYSFECIGNVSVMRAALECCHKGWGTSVIVGVAASGQEISTRPFQLVSGRVWKGTAFGGFKSRSQVPWLVDKYLKKEIKVDEYITHTLTLSEINKAFDLLHEGGCLRCVLSTQE

SEQ ID NO: 3989 - protein, 391 aa, Glycine max
  misc_feature (182)..(182): Xaa can be any naturally occurring amino acid
  misc_feature (224)..(224): Xaa can be any naturally occurring amino acid
LCSALISFIFISMATQGQVITCKAAVAWEPNKPLTVQDVQVAPPQAGEVRVQILFTALCHTDAYTWGGKDPEGLFPCILGHEAAGIVESVGEGVTNVQPGDHVIPCYQAECGECKTCKSGKTNLCGKVRSATGVGVMLNDGKSRFSINGKPIYHFMGTSTFSQYTVVHDVSVAKIDPVAPLXKVCLLGCGVSTGLGAVWNTAKVESGSIVAIFGLGTVGLAVAXGAKTAGASRVIGIDIDSNRKERAKNLGVTEFINPNEHEKPVQQVIVELTDGGVDYSFECIGNVLVMRSALECCHKGWGTSVIVGVAASGQEICTRPFQLVTGRVWKGTAFGGFKSRSQVPWLVDKYLKKEIKVDEYITPSLSLAEINKAFDLMHEGGCLRCVLAMNV

SEQ ID NO: 3990 - protein, 174 aa, Glycine max
  misc_feature (23)..(23): Xaa can be any naturally occurring amino acid
  misc_feature (62)..(62): Xaa can be any naturally occurring amino acid
VGLAVAEGAKTAGASRVIGIDIXSKKFDIAKNFGVTEFINPNEHDKPIQQVIIDRTDGGVDXSFECIGNVSVMRAALECCHKGWGTSVIVGVAASGQEISTRPFQLVSGRVWKGTAFGGFKSRSQVPWLVDKYLKKEIKVDEYITHTLTLSEINKAFDLLHEGGCLRCVLSTQE

SEQ ID NO: 3991 - protein, 509 aa, Glycine max
  misc_feature (66)..(66): Xaa can be any naturally occurring amino acid
  misc_feature (128)..(128): Xaa can be any naturally occurring amino acid
  misc_feature (267)..(267): Xaa can be any naturally occurring amino acid
MGSDNHQNLEFLKEIGLGSSNIGSYINGQWKATGSSVTSVNPSNNQSIAQVTEATLQDFEEGLRAXSEAAKTWMTIPAPKRGEIVRQIGEALRAKLDPLGRLVSLEMGKILPEGIGEVQEIIDMCDYXLGLSRQLNGSIIPSERPDHMMFEVWNPLGIVGVISAFNFPCAVLGWNACIALVCGNCVVWKGAPTTPLITIAVTKLVAEVLERNKLPGAIFTSFCGGADIGQAIAKDTRIPLVSFTGSSKVGLMVQQTVNERFGKCLLXLSGNNAIIVMDDADIKLAVRSILFAAVGTTGQRCTTCRRLFLHESIYTDVLDQLVEVYKQVKIGNPLEKGTLVGPLHTRTSVENFQKGISVIKSQGGKILTGGSVLESGGNFVQPTIVEISPDAPVVKEELFGPVLYVMKFQTLEEAIALNNSVPQGLSSSIFTQRPGTIFKWIGPRGSDCGIVNANIPTNGAEIGGAFGGEKATGGGREAGSDSWKQYMRRSTCTINYGSELPLAQGINFG

SEQ ID NO: 3992 - protein, 690 aa, Glycine max
  misc_feature (566)..(566): Xaa can be any naturally occurring amino acid
MASNSELVRTVVESVLGVSVSDSVMVIAATSVALVIGLLVFVWRKSSDRSKEQKPLAVPKLLVKEEEEDEVDAGSGKTRVAIFFGTQTGTAEGFAKALAEEIKARYEKAAVKVADLDDYAMDDDQYEEKLKKESLAFFMLATYGDGEPTDNAARFYKWFTEGKDERGIWLQQLTYGVFGLGNRQYEHFNKIGKIVDEELSEQGAKRLVPLGLGDDDQSIEDDFVAWKESLWSELDQLLRDEDDVNTVSTPYKAAIPEYRVVIHDSTVTSCNDNHLNVANGNAVFDIHHPCRVNIAAQRELHKPESDRSCIHLEFDISGTGIIYETGDHVGVFAENGDETVEEAGKLLGQDLDLVFSIHTNNEDGTPLGSSLPPPFPGPCTLRFALAHYADLLNPPRKASLVALAAHTSEPSEADRLTFLSSPQGKDEYSKWLVGSQRSLLEVMAEFPSAKPPLGVFFAAVAPHLQPRYYSISSSPRFSPQKVHVTCALVCGPTPTGRIHKGVCSTWMKNAIPLEKSRDCSWAPIFIRTSNFKLPADHSIPIIMVGPGTGLAPFRGFLQERLALKEXDAVQLGPALLFFGCRNRQMDFIYEDELKNFMEQGALSELIVTFSREGPEKEYVQHKMMDKAANLWNLISQGGYLYVCGDAKGMARDVHRTLHTIVQQQENVDSSKAEAIVKKLQMDGRYLRDVW

SEQ ID NO: 3993 - protein, 141 aa, Glycine max
  misc_feature (28)..(28): Xaa can be any naturally occurring amino acid
MIKDALIALNEKGGSSPYAIAKYMEEKXKAVLPANFKKILGLQLKNQAARGKLVKIKASYKLAEAAKKVKESTAKATKESRPKRNKIATAVAPKKTEAVKKPAKKVGPKKTKKVSTPAKPKQPRSIRSPTKRARKAAVAAA

SEQ ID NO: 3994 - protein, 197 aa, Glycine max
MSAAAEEANAPAVEKPVEEVKAPNPAKEKKPKAPKEKKPKQAKTASHPPYFQMIKEALIALNEKGGSSPYAIAKYMEEKHKAVLPANFKKILGLQLKNQAARGKLVKIKASYKLTEAAKKENTAKVTKANAEKKESRPKRSKTATAAAPKKTEAVKRAAKKVGPKKTKKVSTPAKPKQPKSIRSPTKRARKAAVAAA

SEQ ID NO: 3995 - protein, 202 aa, Glycine max
MNPEYDYLFKLLLIGDSGVGKSCLLLRFADDSYLDSYISTIGVDFKIRTVEQDGKTIKLQIWDTAGQERFRTITSSYYRGAHGIIVVYDVTDQESFNNVKQWLNEIDRYASENVNKLLVGNKCDLTANKVVSSETAKAFADEIGIPFMETSAKNATNVEQAFMAMAAEIKNRMASQPVNNARPPTVQIRGQPVNQKAGCCST

SEQ ID NO: 3996 - protein, 203 aa, Glycine max
  misc_feature (90)..(90): Xaa can be any naturally occurring amino acid
  misc_feature (139)..(139): Xaa can be any naturally occurring amino acid
MNPEYDYLFKLLLIGDSGVGKSCLLLRFADDSYLDSYISTIGVDFKIRTVEQDGKTIKLQIWDTAGQERFRTITSSYYRGAHGIIVVYDXVTDQESFNNVKQWLNEIDRYASENVNKLLVGNKCDLTANKVVSYETAKXFADEIGIPFMETSAKNATNVEQAFMAMAAEIKNRMASQPVNNARPPTVQIRGQPVNQKAGCCST

SEQ ID NO: 3997 - protein, 150 aa, Glycine max
  misc_feature (53)..(53): Xaa can be any naturally occurring amino acid
  misc_feature (120)..(120): Xaa can be any naturally occurring amino acid
MDTGGKIKKGAGGRKGGGQKKKPVSRSVKAGLQFPVGRIGRYLKKGRGAQRVXGTGAPVYLAAVLEYLAAEVLELAGNAARDNKKNRIIPRHVLLAVRNDEELGKLLAGVTIAHGGVLPXINPVLLPKKTERASKEPKSPSKATKSPKKS

SEQ ID NO: 3998 - protein, 148 aa, Glycine max
MDAGGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTQVAKEPKSPSKATKSPKKA

SEQ ID NO: 3999 - protein, 149 aa, Glycine max
MDADGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKSERASKEPKSPSKATKSPKKA

SEQ ID NO: 4000 - protein, 203 aa, Glycine max
  misc_feature (82)..(82): Xaa can be any naturally occurring amino acid
  misc_feature (115)..(115): Xaa can be any naturally occurring amino acid
  misc_feature (124)..(124): Xaa can be any naturally occurring amino acid
  misc_feature (143)..(143): Xaa can be any naturally occurring amino acid
  misc_feature (167)..(167): Xaa can be any naturally occurring amino acid
  misc_feature (172)..(172): Xaa can be any naturally occurring amino acid
  misc_feature (175)..(175): Xaa can be any naturally occurring amino acid
  misc_feature (178)..(178): Xaa can be any naturally occurring amino acid
  misc_feature (180)..(180): Xaa can be any naturally occurring amino acid
  misc_feature (182)..(184): Xaa can be any naturally occurring amino acid
  misc_feature (186)..(190): Xaa can be any naturally occurring amino acid
  misc_feature (193)..(193): Xaa can be any naturally occurring amino acid
  misc_feature (197)..(197): Xaa can be any naturally occurring amino acid
  misc_feature (199)..(201): Xaa can be any naturally occurring amino acid
GVLLLENPRFYKEEEKNDPEPAKKLASLADLFVNDAFGTAHRAHALTEGVTKYLKPSVAGFFLQKELDYLVGAVSSPKRPFXAIVGGSKVLFKIGVIESLLEKSDILLFGGGMIXTFYNAHGFXVGSFLVEEDKLVLATSLTXKAKEKGVSLLLPSDVVIADKFAPXANSKXVPXSTXPXGXXXPXXXXXLKXFQEXLXXXPH

SEQ ID NO: 4001 - protein, 321 aa, Glycine max
  misc_feature (200)..(200): Xaa can be any naturally occurring amino acid
MASAASPTTFSLLHSATPSSSSTATSASPSPSRVQLTSSLRARPLRRLGFAAADPLLAASVAARVAAVRGGGKGARGVVSMAKKSVGDLSAADLKGKKVFVRADLNVPLDDNQNITDDTRIRAAIPTIKHLIQNGAKVILSSHLGRPKGVTPKYSLAPLVPRLSELIGIQIVKAEDSIGQDERWRHVLHMQVGRGVVFRXVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 4002 - protein, 350 aa, Glycine max
  misc_feature (247)..(247): Xaa can be any naturally occurring amino acid
MTQAQIQPVKLGTQGFEVSKLGFGCMGLTGAYNDPLQEQDGISVIKYAFSKGITFFDTADVYGANANELLVGKALKQLPREKIQIATKFGIASRGFPDMKIKGSPEYVRSCCEASLKRLDVEYIDLYYQHRVDTSVPIEETVGELKKLVEEGKVKYIGLSEASPDTIRRAHAIHPITAVQIEWSLWTRDIEEEIVPLCRELGIGIVPYSPLGRGFFGGKGVVENVPTNSSLKAHPRFQAENLDKNKXYIWNIYERIEGLAKKHQATPAQLALAWVLQQGEDVVPIPGTTKIKNLDQNIGALAVKLSEKDLREISEAVPIGDVAGGRYYNGLDHFSWKYANTPPKDSKIST

SEQ ID NO: 4003 - protein, 367 aa, Glycine max
MATTNPFDLLGDDAEDPSQLIAAEQLKAAAAAAAATAAPKKAPAQQIKPAQLPSKPLPPAQAVRDARNESVRGGRGGGRGGGRGFGRGRGFSRDSSNDENSFPTSGAPYNQVSFEGDAGKSSERRGYGGPRVPYRGGGGRRGGFSNGETGEAEEGRPRRAFDRRSGTGRGNEFKREGSGRGNWGAQTDELAQVTDEVANETEKNLGDEKPAVEEDVADGNKDSPTNETEEKEPEDKEMTLEEYEKVLEERRKAFQALKTEERKVDTKEFESMQALSSKKDNHDIFIKLGSDKDKRKEAFEKEEKSKKSVSITEFLKPAEGEAYYNPGRGRGRGRGSRGGGGYHGSATNNAPAPSIEDPGHFPTLSAK

SEQ ID NO: 4004 - protein, 518 aa, Glycine max
MPAVGGINTGGGKEYPGSLTLFVTVTCIVAAMGGLIFGYDIGISGGVTSMDPFLLKFFPSVFRKKNSDKTVNQYCQYDSQTLTMFTSSLYLAALLSSLVAATVTRKFGRKLSMLFGGLLFLVGALINGFAQHVWMLIVGRILLGFGIGFANQSVPLYLSEMAPYKYRGALNIGFQLSITVGILVANVLNYFFAKIKGGWGWRLSLGGAMVPALIITVGSLVLPDTPNSMIERGDREKAKAQLQRIRGIDNVDEEFNDLVAASESSSQVEHPWRNLLQRKYRPHLTMAVLIPFFQQLTGINVIMFYAPVLFSSIGFKDDAALMSAVITGVVNVVATCVSIYGVDKWGRRALFLEGGVQMLICQAVVAAAIGAKFGTDGNPGDLPKWYAIVVVLFICIYVSAFAWSWGPLGWLVPSEIFPLEIRSAAQSINVSVNMLFTFLIAQVFLTMLCHMKFGLFLFFAFFVLIMTFFVYFFLPETKGIPIEEMGQVWQAHPFWSRFVEHDDYGNGVEMGKGAIKEV

SEQ ID NO: 4005 - protein, 515 aa, Glycine max
  misc_feature (40)..(40): Xaa can be any naturally occurring amino acid
  misc_feature (78)..(78): Xaa can be any naturally occurring amino acid
  misc_feature (159)..(159): Xaa can be any naturally occurring amino acid
  misc_feature (170)..(170): Xaa can be any naturally occurring amino acid
  misc_feature (177)..(177): Xaa can be any naturally occurring amino acid
  misc_feature (192)..(192): Xaa can be any naturally occurring amino acid
  misc_feature (202)..(202): Xaa can be any naturally occurring amino acid
  misc_feature (231)..(231): Xaa can be any naturally occurring amino acid
  misc_feature (238)..(238): Xaa can be any naturally occurring amino acid
  misc_feature (332)..(332): Xaa can be any naturally occurring amino acid
  misc_feature (377)..(377): Xaa can be any naturally occurring amino acid
  misc_feature (446)..(446): Xaa can be any naturally occurring amino acid
RQDVHPNSPSCLLFIDGDWKVPVLKNRIPIINPSTQHIIXGDIPAATKEDVDLAVAAAKAALSRNKGADWASASGSVXRARYLRAIAAKITEKKPELAKLEAIDCGKPLDEAAWDIDDVAGCFEFYADLAEKLDAQQKAHVSLPMDTFKSYVLKEPIGXVVALITPWNYXLLMATWXKVAPALAAGCACNIXKPSELASVTXLELAEICKEVGLPPGVLNILTGLGPEAGXAPLAAHXNVDKISFTGSSATGSRIMTAAAQLTKPVSLELGGKSPIIVFEDVDLDKTAEWTIFGCFFTNGQICSATSRLIVHESIATEFVNRLVQWAKNIKXISDPFEEGCRLGPIVSEGQYKKVLNCISTAKSEGATILIGGSRPXEHLKKGYFVEPTIITDVTTSMQIWREEVFGPVLCVKTFSTEEEAIELANDTHYGLGSAVMSKDLERCEXRISKAIQAGIVWINCAQPSFIQAPWGGVKRSGFGRELGEWGLENYLSVKQVTKYISDEPWGWYQSPSKL

SEQ ID NO: 4006 - protein, 221 aa, Glycine max
MAAATRTSLRFLLSVSVTLTLAHLAASNSEGDALYTLKRSLSDPDNVLQSWDPTLVSPCTWFHVTCNQDNRVTRVDLGNSNLSGHLVPELGKLEHLQYLELYKNNIQGTIPPELGNLKSLVSLDLYNNNISGTISPSFGKLRILLFTFFRRLNDNRLTGPIPKELAAVSSLKVVDVSNNDLCGTIPTSGPFEHIPLNNFENNPRLEGPELLGLVSYDTNCS

SEQ ID NO: 4007 - protein, 663 aa, Glycine max
MASNGNGSVANGNGTARNGLAKIQTHKKHNGICHDDSGPTVKAQTIDELHSLQKKKSAPTTPVTGFQAPFATLTEEERHKQQLQSISASLASLTRETGPNLVKGDPARKSDTQKVTHVHHHHVSTPTIAVSDSALKFTHVLYNLSPAELYEQAIKYEKGSFISSTGALATLSGAKTGRSPRDKRVVKDDLTKNDLWWGKGSPNIEMDEHSFMVNRERAVDYLNSLDKVFVNDQFLNWDTENRIKVRIVSARAYHSLFMHNMAPPPSSSPLQRNNITLLIACTSSYGCFLCFSLAVLVFVLVLHLSSFSRIHHPHGTQYAGEMKKGLFSVMHYLSCLSPQILSLHSGCNMGKDGDVALFFGLSGTGKTTLSTDHNRYLIGDDEHCWGDNGVSNIEGGCYAKCIDLSREKEPDIWNAIRFGTVLENVVFDEHDREVDYSDKSVTENTRAAYPIEYIPNAKLPCVGPHPKNVILLACDAFGVLPPVSKLNLAQTMYHFISGYTALVAGTEEGIKEPQATFSACFGAAFIMLHPTKYAAMLAEKMQKHGATGWLVNTGWSAGSYGNGSRIKLQYTRKIIDAIHSGSLLNAEYKKTEIFGLEIPTEVEGVPSEILDPMNTWSNKKAYKETLLKLAGLFKNNFETFTNYKIGKGNNNLTEEILAAGPIF

SEQ ID NO: 4008 - protein, 560 aa, Glycine max
  misc_feature (261)..(261): Xaa can be any naturally occurring amino acid
MASNGNGSVANGNGSARNGLAKIQTQKKHDGICHDDSGPTVKAQTIDELHSLQKKKSAPTTPVTGFQAPFATLTEEERHKQQLQSISASLASLTRETGPKLVKGDPARKSDTQKVTHVHHHVSTPTIVVSDSSLKFTHVLYNLSPAELYEQAIKYEKGSFITSTGALATLSGAKTGRSPRDKRVVKDDLTENELWWGKGSPNIEMDEHTFMVNRERAVDYLNSLDKVFVNDQFLNWDTENRIKVRIVSARAYHSLFMHNMXGKTTLSTDHNRYLIGDDEHCWGDNGVSNIEGGCYAKCIDLSREKEPDIWNAIRFGTVLENVVFDEHDREVDYSDKSVTENTRAAYPIEYIPNAKLPCVGPHPKNVILLACDAFGVLPPVSKLNLAQTMYHFISGYTALVAGTEEGIKEPQATFSACFGAAFIMLHPTKYAAMLAEKMQKHGATGWLVNTGWSAGSYGYGSRIKLQYTRKIIDAIHSGSLLNAEYKKTEIFGLEIPTEVEGVPSEILDPVNTWSNKKGYKETLLKLAGLFKNNFETFTNYKIGKGNNNLTEEILAAGPIF

SEQ ID NO: 4009 - protein, 661 aa, Glycine max
MASNGNGSVANGNGTARNGLAKIQTHKKHNGICHDDSGPTVKAQTIDELHSLQKKKSAPTTPVTGFQAPFATLTEEERHKQQLQSISASLASLTRETGPNLVKGDPARKSDTQKVTHVHHHHVSTPTIAVSDSALKFTHVLYNLSPAELYEQAIKYEKGSFISSTGALATLSGAKTGRSPRDKRVVKDDLTKNDLWWGKGSPNIEMDEHSFMVNRERAVDYLNSLDKVFVNDQFLNWDTENRIKVRIVSARAYHSLFMHNMCIRPTPEELENFGTPDFTIYNAGQFPCNRYTHYMTSSTSIDLNLARREMVILGTQYAGEMKKGLFSVMHYLMPKRQILSLHSGCNMGKDGDVALFFGLSGTGKTTLSTDHNRYLIGDDEHCWGDNGVSNIEGGCYAKCIDLSREKEPDIWNAIRFGTVLENVVFDEHDREVDYSDKSVTENTRAAYPIEYIPNAKLPCVGPHPKNVILLACDAFGVLPPVSKLNLAQTMYHFISGYTALVAGTEEGIKEPQATFSACFGAAFIMLHPTKYAAMLAEKMQKHGATGWLVNTGWSAGSYGNGSRIKLQYTRKIIDAIHSGSLLNAEYKKTEIFGLEIPTEVEGVPSEILDPMNTWSNKKAYKETLLKLAGLFKNNFETFTNYKIGKGNNNLTEEILAAGPIF

SEQ ID NO: 4010 - protein, 137 aa, Glycine max
MASSSWEYFGEIANVAQLTGIDAVKLIGMIVKAANTARMHKKNCRQFAQHLKLIGNLLDQLKISELKKYPETREPLEQLEDALRRSYILVNSCQDRSYLYLLAMGWNIVYQFRKAQSENDRYLHLVPLISLVDNNRL

SEQ ID NO: 4011 - protein, 164 aa, Glycine max
FGSSKVSDVELDQISLLPNAEYLLTSFLSIWEKADLIKVSDVELEFLTGSDKIDDESALSLWHPNLKLLLVTLGEHGSRYYTENFKGSVDAFHVNTVDTTGAGDSFVGALLSKIVDDQSILEDEPRLREVLKYANACGAITTTQKGAIPALPKEEDALKLIKGA

SEQ ID NO: 4012 - protein, 356 aa, Glycine max
  misc_feature (144)..(144): Xaa can be any naturally occurring amino acid
MHSKAALLSFLANKCSKIQTHTLSPMALNNGVPATGTGLIVSFGEMLIDFVPTVSGVSLAEAPGFLKAPGGAPANVAIAVSRLGGKAAFVGKLGDDEFGHMLAGILKENGVRADGITFDQGARTALAFVTLRADGEREFMFYRXNPSADMLLKPEELNLELIRSAKVFHYGSISLIVEPCRSAHLKAMEVAKEAGCLLSYDPNLRLPLWPSPEEARKQILSIWEKADLIKVSDVELEFLTGSDKIDDESALSLWHPNLKLLLVTLGEHGSRYYTENFKGSVDAFHVNTVDTTGAGDSFVGALLSKIVDDQSILEDEPRLREVLKYANACGAITTTQKGAIPALPKEEDALKLIKGA

SEQ ID NO: 4013 - protein, 331 aa, Glycine max
MALNNGVPATGTGLIVSFGEMLIDFVPTVSGVSLAEAPGFLKAPGGAPANVAIAVSRLGGKAAFVGKLGDDEFGHMLAGILKENGVRADGINFDQGARTALAFVTLRADGEREFMFYRNPSADMLLKPEELNLELIRSAKVFHYGSISLIVEPCRSAHLKAMEVAKESGCLLSYDPNLRLPLWPSAEEARKQILSIWEKADLIKVSDAELEFLTGSDKIDDESALSLWHPNLKLLLVTLGEHGSRYYTKSFKGSVDAFHVNTVDTTGAGDSFVGALLAKIVDDQSILEDEPRLREVLKFANACGAITTTQKGAIPALPKEEAALKLIKGGS

SEQ ID NO: 4014 - protein, 170 aa, Glycine max
  misc_feature (3)..(4): Xaa can be any naturally occurring amino acid
  misc_feature (16)..(17): Xaa can be any naturally occurring amino acid
  misc_feature (27)..(27): Xaa can be any naturally occurring amino acid
  misc_feature (36)..(37): Xaa can be any naturally occurring amino acid
  misc_feature (41)..(42): Xaa can be any naturally occurring amino acid
  misc_feature (48)..(49): Xaa can be any naturally occurring amino acid
  misc_feature (77)..(77): Xaa can be any naturally occurring amino acid
RSXXVFHYGSISLIVXXCRSAHLKAMXVAKESGCLXXYDPXXRLPLWXXAEEARKQILSIWEKADLIKVSDAELEFXLGEHGSRYYTKSFKGSVDAFHVNTVDTTGAGDSFVGALLAKIVDDQSILEDDPRLREVLKFANACGAITTTQKVAIPALPKEEVALNLIKGGS

SEQ ID NO: 4015 - protein, 232 aa, Glycine max
  misc_feature (189)..(189): Xaa can be any naturally occurring amino acid
EEIQKQILEPAIKGTVNVLKAAKEAGVERVVATSSISSIMPSPNWPADKIKAEECWTDLEYCKQKGLYYPIAKTLAEKAGWEFAKETGFDVVMINPGTALGPLLPPRINSSMEMLVSVLKGGKETYEDFFMGMAHFKDIALAHILALENKKAAGRHLCVESIRHFSDLVDKVSELYPEYDVVKLPKDTXQPGLLRASTKDASTKLIDLGLEFTPVDQIIKDAVESLKSKGYV

SEQ ID NO: 4016 - protein, 484 aa, Glycine max
  misc_feature (214)..(214): Xaa can be any naturally occurring amino acid
  misc_feature (368)..(368): Xaa can be any naturally occurring amino acid
MSTVGEGKVSSNGHGCCKSGPGYASPLEAISGPRESLIYVTSVYTGTGIEKPDYLATVDVDPNSPTYSKVIHRLPVPYLGDELHHTGWNSCSSCHGDPSADRRFLIVPALVSGRVYVVDVKTNPRAPSLHKVVEPADIIQKTGLAYPHTSHCLASGDIMISCLGDKDGNAAGNGFLLLDSEFNVKGRWEKPGHSPLFGYDFWYQPRHNTMISTXWGAPSAFTKGFNLQHLSDGLYGRHLHVYSWPGGELRQTMDLGDSGLIPLEIRFLHDPAKDTGFVGSALTSNMIRFFKTQDESWSHEVAISVKPLKVQNWILPEMPGLITDFLISLDDRFLYFVNWLHGDIRQYNIEDVKNPKLTGQVWVGGLIXKGSPVVAITDDGETWQAEVPEIQGNKLRGGPQMIQLSLDGKRLYATNSLFSTWDKQFYPELVQKGSHIIQIDVDTEKGGLKINPNFFVDFGTEPDGPSLAHEMRYPGGDCTSDIWI

SEQ ID NO: 4017 - protein, 402 aa, Glycine max
  misc_feature (26)..(26): Xaa can be any naturally occurring amino acid
  misc_feature (123)..(123): Xaa can be any naturally occurring amino acid
  misc_feature (199)..(199): Xaa can be any naturally occurring amino acid
MATKRSVGTLKEGDLKGKRVFVRVDXNVPLDDNLNITDDTRVRAAVPTIKYLTGYGAKVILSSHLGRPKGVTPKYSLKPLVPRLSQLLGIEVTMANDSIGEEVEKLVTQLPEGGVLLLENVRXFYKEEEKNDPEFAKKLASLADLYVNDAFGTAHRAHASTEGVAKYLKPSVAGFLMQKELDYLVGAVSNPKRPFAAIXGGSKVSSKIGVIESLLEKVNVLLLGGGMIFTFYKAQGYSVGSSLVEEDKLSLATTLLEKAKAKGVSLLLPTDVVIADKFAADANSKTVPASSIPDGWMGLDIGPDSIKTFGEALDTTQTIIWNGPMGVFEFDKFATGTEAIAKKLAELSGKGVTTIIGGGDSVAAVEKVGLADKMSHISTGGGASLELLEGKQLPGVLALDDA

SEQ ID NO: 4018 - protein, 401 aa, Glycine max
MATKRSVGTLKEGDLKGKRVFVRVDLNVPLDDNLNITDDTRVRAAVPTIKYLTGHGAKVILSSHLGRPKGVTPKYSLKPLVPRLSQLLGIEVTMANDSIGEEVEKLVAQLPEGGVLLLENVRFYKEEEKNDPEFAKKLASLADLYVNDAFGTAHRAHASTEGVAKYLKPSVAGFLMQKELDYLVGAVSNPKRPFAAIVGGSKVSSKIGVIESLLEKVNVLLLGGGMIFTFYKAQGYSVGSSLVEEDKLSLATTLLEKAKAKGVSLLLPTDVVIADKFAADANSKTVPASSIPDGWMGLDIGPDSIKTFGEALDKTQTVIWNGPMGVFEFDKFATGTEAIAKKLAELSGKGVTTIIGGGDSVAAVEKVGLADKMSHISTGGGASLELLEGKQLPGVLALDDA

SEQ ID NO: 4019 - protein, 253 aa, Glycine max
MGRKFFVGGNWKCNGTTEEVKKIVTTLNEAKVPGEDVVEVVVSPPFVFLPFVKSLLRPDFHVSAQNCWVRKGGAYTGEVSAEMLVNLGIPWVIIGHSERRQLLNESNEFVGDKVAYALQQGLKVIACIGETLEQREAGTTTAVVAEQTKAIAAKISNWDNVVLAYEPVWAIGTGKVATPAQAQEVHADLRKWVHDNVSAEVAASVRIIYGGSVNGGNCKELAAQPDVDGFLVGGASLKAEFVDIINAATVKKN

SEQ ID NO: 4020 - protein, 334 aa, Glycine max
  misc_feature (29)..(29): Xaa can be any naturally occurring amino acid
  misc_feature (207)..(207): Xaa can be any naturally occurring amino acid
VNHSFIFGFKKGTDLSYHQVFFFSFVLGXLALTSVLANLDMQIDPETKEYKAFTELLPLILVLVLIAILLCPLNIVYRSSRMFFLTCLIHCICAPLYKVTLPDFFMADQFTSQVQALRSFEFYICYYGWGDFKQRETSCKSNRIFIAFSFIVAVIPYWSRFLQCLRRLFEEKDKMQGYNALKYFLTIAAVCLRTAYTLHQGMGLKVXAWIFSISTAIFSTYWDLVLDWGLLQRHSKNRWLRDKLLVPQKSVYFAAMVLNVLLRFAWLQTILNLNFSSLHRQAMVSIVANLEIIRRGIWNFFRIENEHLNNVGKYRAFKSVPLPFNYEEEEDKDE

SEQ ID NO: 4021 - protein, 158 aa, Glycine max
MAEEHRCQAPRFCANNCGFFGSPATQNMCSKCYRDFQLKEQQSSNAKMVLNQSLVPSPPPAVISQPSSSSSAAVDPSSAVVDDAPREAEEVKAPQQNRCMTCRRRVGLTGFKCRCGMMLCGTHRYPEQHACEFDFKGMGREQIAKANPVVKGEKLDKI

SEQ ID NO: 4022 - protein, 265 aa, Glycine max
  misc_feature (93)..(93): Xaa can be any naturally occurring amino acid
MPQDVHIMAEQLSKIFEDRWAIIESDYNREMRYGFDYGAVAPALSPLSRRVSAFTPPPLDMRRILNRSESMTQTSRLMSITASSRTPAPEKPXANEPHKRDMTYEEMHTLSTNLQSLPSEKLDAIVQIIKKRNSALNQHDDEIEVDIDSVDAETLWELDRFVTNYKKSLSKNKRKAELAQARAEALQQNAIQKSQAPAMAEIPKETLTDERNLPQPLPAQRGNQGDNGSRSGSSSSSSSDSGSSSSDSDSDSSSASGSEAGSQGT

SEQ ID NO: 4023 - protein, 404 aa, Glycine max
  misc_feature (60)..(60): Xaa can be any naturally occurring amino acid
  misc_feature (86)..(86): Xaa can be any naturally occurring amino acid
  misc_feature (108)..(108): Xaa can be any naturally occurring amino acid
  misc_feature (145)..(145): Xaa can be any naturally occurring amino acid
  misc_feature (157)..(157): Xaa can be any naturally occurring amino acid
  misc_feature (224)..(224): Xaa can be any naturally occurring amino acid
RFNNGPLASATLLKSSPVLDKCEWVKGQTLRQPLVRCNPSSASALTIKAASYADELVKTXAKTVASPGRGILAMDESNATCGKRLXASIGLENTEANRQAYRTLLVTXPGLGEYISGAILFEETLYQSTVDGRKIVDVLVDQNIXVPGIKVDKGLVXPLAGSNDESWCQGLDGLASRSAAILPGKVPRFAKWRTVVSIPNGPSALAVKEAAWGLARYAAISQEXGLVPIVEPEILLDGEHGIDRTFEVAQKVWSEVFFYLAENNVLLEGILLKPSMVTPGAESKDKATPLQVADYTLKLLHRRIPPAVPGIMFLSGGQSEVEATLNLNAMNQSPNPWHVSFSYARALQNTCLKTWGGLPENVKAAQDALLFRAKSNSLAQLGKYTAEGESEEATRGMFVKGYSY

SEQ ID NO: 4024 - protein, 399 aa, Glycine max
MASASASLLKSSLVLDKSEWVKGQTLRQPSAASVVRCNPTTPSGLTIRAGSYADELVKTAKTVASPGRGILAMDESNATCGKRLASIGLENTEANRQAYRTLLVTVPGLGQYISGAILFEETLYQSTTDGRKIVDVLLEQNIVPGIKVDKGLVPLAGSNDESWCQGLDGLASRSAAYYQQGARFAKWRTVVSIPNGPSALAVKEAAWGLARYAAIAQDNGLVPIVEPEILLDGEHGIDRTFEVAKKVWAEVFFYLAENNVLFEGILLKPSMVTPGAESKDKASPQTVADYTLKLLHRRIPPAVPGIMFLSGGQSEVEATLNLNAMNQSPNPWHVSFSYARALQNTALKTWGGRPENVKAAQDALLFRAKSNSLAQLGKYTGEGESEEAKKELFVKGYSY

SEQ ID NO: 4025 - protein, 115 aa, Glycine max
  misc_feature (31)..(31): Xaa can be any naturally occurring amino acid
  misc_feature (97)..(97): Xaa can be any naturally occurring amino acid
SKQTLKRRRGIRSEADANLMNQLTWRLGLTXTRDAECYDVYGLHEEQVVMVTKPGTAVLVLYHTTTQTEETMLLSENYDIDYYMRTYFMKQTGGHAXKTIVLLNALWYLTCEDKL

SEQ ID NO: 4026 - protein, 193 aa, Glycine max
ITTGYGAAVITAGRGGVEKGSQVAIFGAGCVGLSVIQGAVKQGASKIIVVDVNDSKKEWAKKFGATDFVNPAKDLKEGENIQSRLIDMTDGGCDYTFDCTGNVHVMRSALEACHKGWGESIIIGVAAAGQEISTRPFQLVTGRVWKGCAFGGVKGRSQMGSLVQDYMDNKLKVDEFITHRQPLSGINDAFHDM

SEQ ID NO: 4027 - protein, 160 aa, Glycine max
SQVDRIRDQEYHHLNPSNVCFDYTGYGLFSHAQQQKQTASVASSSSCPPPSLPEPPFFVISYKPVTLHSQILYGGQESELESKIRERIMAFMSISEADYTLVFIANEVSAFKLVADSFQFHPDGELLTVYDHKSEAVDEIIETSFKCYWNTLFVYLLEPN

SEQ ID NO: 4028 - protein, 202 aa, Glycine max
CSRWLQRNASHKPFLLAMHSHIERILWSEDQISRRVSELAAEISADFGGQSPAPVVVGVATGAFLFLADLVRKIDLSIAVDFVRVESYGFGTVSNGAPTISFDLKVDVNARHVIVVEDIVDTGHTLSKVIGHLKSKGVSSVSVCTFLDKPARRKVHFQLLGEGKYYRGFECPDYFVVGYGLDFAELYRNLPYIGVLKPELYK

SEQ ID NO: 4029 - protein, 306 aa, Glycine max
MNNEEVPSLPSTSATPGTPGAPLFGGLRFEKPNGSVVRKSSFLKSCKCFSVAEWTLEDGAMPRVSCSLPSPHIPLAKKIGAEFIGTFILMFAAIGTAIVNQKTHGSETLIGCAAANGLAVMIIIFSTGHISGAHLNPAVTISFAALKHFPWKNVPVYIGTQVLASVSAAFALKVVFHPFMSGGVTVPSVGYGQAFATEFIVSFILMFVVTAVATDTRAVGELAGIAVGATVMLNILIAGPTTGSSMNPVRTLGPAIAANNYKGIWVYLIAPILGTLCGAGAYTVVKLPEEEATKTPSSAPNGSFRR

SEQ ID NO: 4030 - protein, 101 aa, Glycine max
MCGIFAYLNYDVNRDRRYILQVLFNGLSRLEYRGYDSAGIAIDDSNFSPLVFRQEGNIESLVKSVYQEVGETELNLGECFGTHAGIAHTRWATHGEPAPRN

SEQ ID NO: 4031 - protein, 53 aa, Glycine max
  misc_feature (10)..(10): Xaa can be any naturally occurring amino acid
  misc_feature (17)..(17): Xaa can be any naturally occurring amino acid
PIDWDYYRIXNSHLLIXMYKEHYHSIAVRKFVDTVTGQYMTKFDALLIELKEA

SEQ ID NO: 4032 - protein, 95 aa, Glycine max
  misc_feature (85)..(85): Xaa can be any naturally occurring amino acid
MEMFSSMISFPAVATVNRAGAGMVAPFTGLKSMAGFRTRKTYYVITSIASVGVRVQCMHVWPLIGWKTFATFHYLPDLDDALFAXVVAFLVRKGW

SEQ ID NO: 4033 - protein, 72 aa, Glycine max
SSSQVLRTRNRAGAGMGAPFTGLKSMAGLKTRKTNDDITYIASNGCRVQCMHETTPIGMKNLETLDYLPDDL

SEQ ID NO: 4034 - protein, 288 aa, Glycine max
  misc_feature (178)..(178): Xaa can be any naturally occurring amino acid
  misc_feature (190)..(190): Xaa can be any naturally occurring amino acid
MAAEVYYQAIGTLQSHSYLNNLNHHQKHQNNLVTLVSRDFISSNGLSTRRSNCTGQRNCSVIRSLASQTSVVDPVLSPSRSNAGDTYKKSNEAALILIRHGESLWNEKNLFTGCVDVPLSKKGIDEAIEAGKRISSIPVDVIFTSALIRAQMTAMLAMTQHRRGKVPIMMHNESEQAXSWSQVFSEDTKXQSIPVIASWQLNERMYGELQGLNKQETADRYGKEQVHEWRRSYDVPPPNGEGLEMCAERAVAYFRDQVCGSLEFCNLAISLSSFSPFMLFFMVYDYNS

SEQ ID NO: 4035 - protein, 130 aa, Glycine max
MGYGRSRASSVLDGFSLNPVPYPVLLILSLILLFLGISWYLSYEEVVEAAEEQLGWMLLATPVVLILVVRWLSSVDTSEWFFFNSSPWERRRRTHHFPSEGSSPWGVAALILLVLVLLHYHSTFLDAWFV

SEQ ID NO: 4036 - protein, 158 aa, Glycine max
HIFQAKLYCSNVLFKAELLDPALNGTLNVLKSCVNFPTLERVFLTSSVASVAYNGKPLTPDVLFDETWFSDPCFCMESHILYTLSKTLAEDAAWKFVKENNIDMVTINPAMVIGPLLQPVLNTSAASILNVINGAQTFPNASFGWVNVKDVANAHILA

SEQ ID NO: 4037 - protein, 106 aa, Glycine max
  misc_feature (10)..(10): Xaa can be any naturally occurring amino acid
  misc_feature (66)..(66): Xaa can be any naturally occurring amino acid
  misc_feature (81)..(81): Xaa can be any naturally occurring amino acid
ISSPTITRCXHSQAGMRTPFTVLKYMASFPTIKTNNDITSITTNGGRVQPMHVMTPLLMNKFKTTXYLPNLDDAQLAKEVXYLLKKVCIPCLEFELDHRFLFLEPN

SEQ ID NO: 4038 - protein, 60 aa, Glycine max
  misc_feature (16)..(16): Xaa can be any naturally occurring amino acid
  misc_feature (42)..(42): Xaa can be any naturally occurring amino acid
RTLLSIISGLCTCILXLTGLNRFTLYLLLMAFTSLGLVVKAXFSTHTYFDYWNRQLLDGF

SEQ ID NO: 4039 - protein, 465 aa, Glycine max
  misc_feature (281)..(281): Xaa can be any naturally occurring amino acid
RALLCSNLKDKDDDRLVKSKSIKKKKNADLVNHKNGNNLLDTNDQNNKSKDVQRIEGDNDEKSANGIKGNPATLGAEGAEKEFNPRKRKRDVLFGMLNWMKHIAKHPLDPLTQPIPKPSKWKEYNGQDFFGQFRRPLRAREVLSPRQHEEPSSELSSLQKQKMHPAMYEDHVALGCLATRKLRCSERLPSFVKSRSCSCCNPCSPNGNRLPGSHNMEAGKCPPEKNTEALDVSTTKTGAKPSGDESLDMQVTVGPRYQTEGPEWTGIFSESVSKWVGTHVXSWKNNTEPATATDVGRGRQEMCSCEFHGSVECVRLHIAENRMKLKLELGSEFYRLGFDRIGEEVSLQWTTEEEQRFKDIMKSNISSKNKYFWNNPSKYFPKKTRRNLVNYYFNVFLIQLRTYQNRVTPESVDSDDDEVEFGSFSDGFGMEAVKGPGDDFLECSLNKQCTDFKYTKLECKFDNWI

SEQ ID NO: 4040 - protein, 92 aa, Glycine max
MGFRLPGIRRSSFAVTKAASKAVEVPKGYLAVYVGEKMKRFVIPISYLNQPLFQQLLSQAEEEFGYDHPMGGLTIPCSEDAFLDLTSRLNGL

SEQ ID NO: 4041 - protein, 107 aa, Glycine max
  misc_feature (22)..(22): Xaa can be any naturally occurring amino acid
  misc_feature (29)..(30): Xaa can be any naturally occurring amino acid
  misc_feature (47)..(47): Xaa can be any naturally occurring amino acid
MASATVLCVLLLASDLTCGACXFLRRKCXXDCIFATLTFAQEQGSCXNSLAFHKVFGASNVSKLLLRIPAHGRFEAILTIAYEAQARLRDPVYGCVSHIFALQQQVA

SEQ ID NO: 4042 - protein, 244 aa, Glycine max
MAEASFFVGVIGNIISILMFLSPVPTFWKIKKHGSTEDFSSLPYICTLLNCSLWTYYGIIKAGEYLVATVNGFGILMETIYIILFLIYAPKGIRGRTAILALILDVVILTAIIIITQLALEGETRSGAVGVMGAGLNIVMYSSPLSVMKTVVTTKSVEYMPFLLSFFFFFNGAVWLLYAVLVRDVILGVPNGTGFLLGAMQLVLYAIYRNGKRVSNNRLEEGLQHEPLISEPNNESHQSEDRPI

SEQ ID NO: 4043 - protein, 80 aa, Glycine max
  misc_feature (49)..(49): Xaa can be any naturally occurring amino acid
  misc_feature (71)..(71): Xaa can be any naturally occurring amino acid
MIIIWLPQLMTSPSVTTVNRSRAGIVAPFSSLNSIAGFPIKKTNNDITXSIAINGRTIQCIQVLTPIRNTXFETLSLLPD

SEQ ID NO: 4044 - protein, 118 aa, Glycine max
DIWGMLSLYEASYLGAKGEEVLQQAMDFSKAHLHQSLAHLSPELRKLVAQALTLPRHLRMGRLEARNYMEKYSQATNQIPALMELAKLDFAMVQSMHQKELAEISRWWKNLGLVERLG

SEQ ID NO: 4045 - protein, 175 aa, Glycine max
MPGGSRNPLVVGRVIGEVIDPFEISIPFRVTYGNREVGNGCELKPSQVANQPRVSVGGDDLRNFYTMVLVDPDAPSPSNPNFREYLHWLVTDIPETTGPNFGNEVVSYESPRPTMGIHRLVFVLFRQQFRQRVYAPGWRQNFNTREFAELYNLGLPVAAVFFNCQRESGSGGRTF

SEQ ID NO: 4046 - protein, 103 aa, Glycine max
  misc_feature (68)..(68): Xaa can be any naturally occurring amino acid
  misc_feature (81)..(81): Xaa can be any naturally occurring amino acid
MASSMISWPGVTTVKRADAGMVASFTGLKSMAGFPTSNTNNDITFIAINGGRRRCTQASPPIGNKKFXTLSYLTDLDNAQXAKEVLFLLTKGLIPCFKFELEH

SEQ ID NO: 4047 - protein, 69 aa, Glycine max
  misc_feature (44)..(44): Xaa can be any naturally occurring amino acid
CRNATSAVPAGASMVAPFTGLKYIAVLPTRNTILDFAYIASNGXRAQCMHVWPPIGKKKVETLSYLPDL

SEQ ID NO: 4048 - protein, 75 aa, Glycine max
  misc_feature (34)..(34): Xaa can be any naturally occurring amino acid
  misc_feature (47)..(47): Xaa can be any naturally occurring amino acid
  misc_feature (60)..(60): Xaa can be any naturally occurring amino acid
SISWPGDTTVNRAGAGMDAPFTGLKSMAGLPTRXTYNDITSIGCNCXRVQCMQVWPPIGXKKYETLSYLPDLDDA

SEQ ID NO: 4049 - protein, 101 aa, Glycine max
  misc_feature (15)..(15): Xaa can be any naturally occurring amino acid
  misc_feature (55)..(55): Xaa can be any naturally occurring amino acid
  misc_feature (66)..(66): Xaa can be any naturally occurring amino acid
  misc_feature (75)..(75): Xaa can be any naturally occurring amino acid
  misc_feature (90)..(90): Xaa can be any naturally occurring amino acid
MRTKRKEMASSMISXPADTSGNRASSGLDARFAVLKSMAGFPTSETNKDITLIAXNCGRVLCMQVXSPIVMMKFXTLCYLPDLDDAQLAXEVRYLLKNGWI

SEQ ID NO: 4050 - protein, 75 aa, Glycine max
SGPICYQRNRAGAGMVAPFTVLKSMAGFPTRNTNNDITSIASIVGRVQCMHVCPPIVKKKFETLSYLSDLDYAQL

SEQ ID NO: 4051 - protein, 208 aa, Glycine max
MCGIFAYLNYNLNRERQYILQVLFNGLRRLEYRGYDSAGIAIDDSSSSQFSLSPPPLVFRQEGNIESLVKSVYQEVGETELNLGECFGTHAGIAHTRWATHGEPAPRNSHPQSSGHGNEFLVVHNGVITNYEVLKETLLRHGFTFESETDTEVIPKLAKFVHDKANEASGGQVVTFSQVGLEGMRHLEGAYALIFKGPHYPNELIACK

SEQ ID NO: 4052 - protein, 110 aa, Glycine max
  misc_feature (86)..(86): Xaa can be any naturally occurring amino acid
MASSMIWDRAVTTVNRAGAGMVAPFTGLKSMAGFPTRKTNNDITYIASNGGRVQCMHVWPPIGKRKSRLFSTWQNLVNPNLPKEVXFLLRKGWIPCLEFELEHGFLYRGP

SEQ ID NO: 4053 - protein, 79 aa, Glycine max
MVSASRYEHSSMSEDQISELVTETLAAVGLKGVEDRLPSELSGGMKKRVALARSIICDTTEESKDPEVLLYDEPTAGLD

SEQ ID NO: 4054 - protein, 345 aa, Glycine max
MVSLSTTPFLPFTAKNASTRIPPPTSFSYSKQRSNRDPRKVVCACIAPPQNFKSQDSSAIHFNGSSKSEQLSTARDHEDDSDVLIECRDVYKSFGEKKILNGVSFKIKHGEAVGIIGPSGTGKSTVLKIIAGLLAPDKGEVYIRGKKRVGLVSDDDISGLRIGLVFQSAALFDSLTVRENVGFLLYEHSSMSEDQISELVTETLAAVGLKGVEDRLPSELSGGMKKRVALARSIICDTTKESIEPEVLLYDEPTAGLDPIASTVVEDLIRSVHIKGQDARGKPGNISSYVVVTHQHSTIKRAIDRLLFLHKGKIVWEGMTHEFTTSTNPIVQQFASGSLDGPIRY

SEQ ID NO: 4055 - protein, 192 aa, Glycine max
  misc_feature (27)..(27): Xaa can be any naturally occurring amino acid
  misc_feature (138)..(140): Xaa can be any naturally occurring amino acid
ECILIWIVMPKLGWRWLLALSSLPTSXLLLFYKVTPESPRYLCLKGRTADAINVLEKIARVNGRELPSGILVSEHEIELHKIDNPTEDARLLSPRTNEDEHPKGIVSNLGAISSLLVLLSPKLARSTLLLWAVFFGNXXXYYGLVLLTTELNGHSKCMSDKLQTEKSQDVRYKSGFIASFAGIFLLISEFSY

SEQ ID NO: 4056 - protein, 133 aa, Glycine max
RISSHVVTTVNRAGAGLVVPLTGLKSMAGFPTGKTNIAIPSIVGTGGGVHCMQGGPPIGRKKFGTFSYWPDLVDAQLAKEVESFLRKGWIPCLEFGWEHGFGFRGPTSLPGSFDGPLWTMWKLPMLGCTDAFK

SEQ ID NO: 4057 - protein, 92 aa, Glycine max
ATFTGLKSMAGLPIRKTNRVISCTASNGGRMQCMQVMSPLGTKKFETLSYMTDLDDAQSAKEVEYLFTKGWINCLEIQLEHRVLYLEHNMSP

SEQ ID NO: 4058 - protein, 568 aa, Glycine max
MASSTLICDTQQWKELKAHAEDVEKTHLRDLLSDDERSQSMVVEFDGILLDYSRQQATLETREKLFKLAEVTSLKQKINQMYNGEYINSTENRSVLHVALRAPRDAVIQSDGNNVVPDVWNVLDKIQEFSERVRSGSWVGATGKELKDVVAVGIGGSFLGPLFVHTALQTDPEAIESARGRQLRFLANVDPIDVARNITGLNPETTLVVIVSKTFTTAETMLNARTLREWISNALGPLAVAKHMVAVSTNLTLVEEFGIDPNNVFAFWDWVGGRYSVCSAVGVLPLSLQYGFSVIEKFLKGASSIDQHMYSEPFERNLPVLLGMLSVWNVSFLGYPARAILPYSQALEKFAPHIQQVSMESNGKGVSIDGVPLPFEAGEIDFGEPGTNGQHSFYQLIHQGRVIPCDFIGVVKSQQPVYLSGEVVSNHDELMSNFFAQPDALAYGKTAEQLQKENVPPHLVPHKTFSGNRPSLSLLLPSLNAYNIGQLLAIYEHRVAVEGFIWGINSFDQWGVELGKSLASQVRKQLNASRTKGEPVQGFNFSTTAMLTRYLQASADVPADLPTRLPQI

SEQ ID NO: 4059 - protein, 517 aa, Glycine max
  misc_feature (184)..(184): Xaa can be any naturally occurring amino acid
  misc_feature (216)..(216): Xaa can be any naturally occurring amino acid
  misc_feature (224)..(224): Xaa can be any naturally occurring amino acid
  misc_feature (253)..(253): Xaa can be any naturally occurring amino acid
  misc_feature (315)..(315): Xaa can be any naturally occurring amino acid
MATLSSYDHFIFTALAFFISGLIFFLKQKSKSKKFNLPPGPPGWPIVGNLFQVARSGKPFFEYVNDVRLKYGSIFTLKMGTRTMIILTDAKLVHEAMIQKGATYATRPPENPTRTIFSENKFTVNAATYGPVWKSLRRNMVQNMLSSTRLKEFRSVRDNAMDKLINRLKDEAEKNNGVVWVLKXLPRFAVFCILVAMCFGLEMDEETVERIDQVMXKSVLITLXDPRIDDYLPILSPFFSNQRKKFLLVCKEXFKFLDQIKAQIRRAMQNPFPDYTNIMFSYLKTIFKHLLKGKKFSPCEAELVCLCSAVLNGGXRDKTAASIEWGIAQLIANPNVQTKLYEEIKRTVGEKKVDEKDVEKMPYLHAVVKELLRKHPPTHFVLTHAVTEPTTLGGYDIPIDANVEVYTPAIAEDPKNWLNPEKFDPERFISGGEEADITGVTGVKMMPFGVGRRICPGLAMATVHIHLMMARMVQEFEWGAYPPEKKMDFTGKWEFTVVMKESLRATIKPRGGEKVKL

SEQ ID NO: 4060 - protein, 116 aa, Glycine max
RLEENVSSKSSLVSYLTAALIGIVLGNMACVTTKSTSPPRKCLFPWLPGGFSMSVTWTYIIAEELVSLLVAIGSVIGVSPSILGLTVLAWGNSLGDLIANGAMAKNGGADGAQIAV

SEQ ID NO: 4061 - protein, 193 aa, Glycine max
MEANIADVDTDDEVNEAEEYEAWKVREIGRIKRDREDREAMLKEKEEIEKVRNMTEEERREWERRNPKPAPPPKQKWRFMQKYYHKGAFFQNESDDRAATVGSDGIFARDFSAPTGEDKMDKTILPKVMQVKHFGRSGRTKWTHLVNEDTTDWNNPWTYNDPLRAKYNDKMAAMNAPIVKPKGSRKLKDWESR

SEQ ID NO: 4062 - protein, 199 aa, Glycine max
MASSLTFHWFLFLILWILVLCSHAHARFFTVDPVSDGFAAASGSKWQSILRLPTALTGESVCEQTYGFLPCTTTVLGNLFLIIVYGFLMFKAATFLSGGSELLLEILGPGIVGGLFLPILGALPDAMLILVSGLSGSKEVAQSQVSVGMGLLAGSTTLLLTIIWGTCVIVGKCDIEGSIAIDSRDTRGFSLTGMPFEIV

SEQ ID NO: 4063 - protein, 248 aa, Glycine max
MANKEFKVPPVAFPSAGNPAAAGPNLQQRRMPTPPFQPNSGIPFMSFDIGSAAASTSSGPIYTGPAVGPGGSANFDDEEPLLDELGIHPDQIWSKIRSVLNPFRVNHTVHKDSDLSGPILLYMSFCLFQLLAGKIQFGVILGWIVVSSIFLYVVFNMLAGRTGNLDLHTCTSVVGYCLLPVVIFSALSLFLPVDGVIRLSVAAVFVLWATRASAGLVVSLADGGDEHRGLIAYASFLIYTLFSLLVIF

SEQ ID NO: 4064 - protein, 304 aa, Glycine max
MASLSCQFHSTNLLNSKNVNSRRKRFIFCSAQPTQNNIKVVINGATKEIGRAAVVAVTKARGMEVAGAVDTCHVGEDIGKIICGMEEPLEIPIINDLTMILGSISQSKAAGVVVDFTDPSSVYDNVMALKATAFGMKSVVYVPQIKLDTVAALSAFCDKASMGVLVAPTLSIGSILLQQAAISASFHYSNVEIVESRANANDLPSADANQIANNLSNLGQIYNREDPSTDVLARGQVLGDGIRVHSMVLPGLPSSTTVHFSGPGEVYSIKHDITDVKCLMPGLLLAIRKVVRLKNLVYGLEKFI

SEQ ID NO: 4065 - protein, 494 aa, Glycine max
MEIIMPSLERDLNDTRGYYESGKTKEASWRESQLKGLRRFLIEKQEDIMNALMHDLGKHQLEAFRDEIGTLIKTLNLALKSLKHWMSGKKAALPQLALLTSAEIVPEPLGVVLIISSWNFPFGISLEPLIGAVAAGNAAVLKPSELSPACSSLLASNLSTYLDNKAIKVIQGGPKETQQLLEQRWDKIFFTGSAHVGKIVMSAAVKHLTPVTLELGGKCPAVVDSLSSSWNIEVAVKRIIVGKYGACAGQACIAIDYVLVEKVYCFKLVELMKVWIKKMFGENPQQSKTIAKIVNKHHFSRLKNLLADKKVKESVIYGGSMDEQNLFIEPTILVDPPLEAAIMSEEIFGPLLPIITVEKIEDSIKFINSRPKPLALYVFTKNQTLQRRMISETSSGSVTINDAILQYAVDTVPFGGVGESGFGMYHGKFSFDTFSHQKAIVRRSFLTDFWYRYPPWTLNKLQLLEVSYNYDYLGLLLVLLGLKRPSKRLISDHV

SEQ ID NO: 4066 - protein, 257 aa, Glycine max
FVCMVQGIIPEKKKSMKRGRVHSVFKAKEYNATIEFYWAPFLVESNTDIRIIGDPKKRIIKVDQITERAKNWTGVDILVFNTYVWWMSGLRLKALWGSFANGEEGFEELDTPVAYKLGLRTWANWVDSTIDPNKTRVFFTTMSPAHTKSADWGHKDGIKCFNETRPVKKKNHWGSGSNKDMMSVVAKVVKRMKVPVNVINITQISEYRIDAHSSVYTETGGKILSEEERANPLNADCIHWCLPGVPDTWNQIFLAML

SEQ ID NO: 4067 - protein, 329 aa, Glycine max
MATFEQFWSRKTLLGLALGQFLSLLITSTGFTSSLLAKKGINAPTSQSFLNYVFLAIVYGIIVLYRREALKAKWYYYILLGLVDVEANFLVVKAYQYTSLTSVMLLDCWSIPCVMLFTWIFLKTKYGFKKVTGVVVCIAGLVLVVFSDVHAGDRAGGSNPSIGDILVIAGATLYAVSNVSEEFLVKNADRVELMAMLGLFGGIISAIQISILERNELKSIHWSAGAVLPFVGFAVAMFMFYSLVPVLLKINGSTMLNLSLLTSDMWAVLIRIFAYHEKVDWMYYVAFGAVVVGLIIYSGGDGDENQDPHHVAEDASQRQHDEEATSGKS

SEQ ID NO: 4068 - protein, 87 aa, Glycine max
MVIDIETLEDRYIDSCRRHDVFPNSSILSSLFKAEVKKSNHELCSLEILIDDLKEADIAPLFDLCMNFDASEIEAVDVRNESSCDLN

SEQ ID NO: 4069 - protein, 79 aa, Glycine max
  misc_feature (72)..(72): Xaa can be any naturally occurring amino acid
MATAMIAWAAVTTADRADPRMHAPFTGLKSMAGFTTRKTNHDISSIATNAVRVLCMHEWTPVLMKKYETLYXLPDLDDP

SEQ ID NO: 4070 - protein, 128 aa, Glycine max
  misc_feature (115)..(115): Xaa can be any naturally occurring amino acid
QRHPTSALDKVDSLIVCGGMAFTFKKTIEGVSIGNSLFDEPGSQKVQGIMGKAKKNGVKLVFPVDYVTADKFDKDATVGAATDAEGIKDGLMGLDAGPESCKLFAETIKASQTIXWNGPAGVIEFENF

SEQ ID NO: 4071 - protein, 77 aa, Glycine max
  misc_feature (66)..(66): Xaa can be any naturally occurring amino acid
MVSSFTCLKSMAGFPTRKTNNDITSIACNRLRVQCIHVSPPIVKKKFDTFSYLPYLYYSQLSNEVXYLLTKGLIPFF

SEQ ID NO: 4072 - protein, 469 aa, Glycine max
KVYYARNIKTGEGVAIKVIDKEKILKGGLVAHIKREISILRRVRHPNIVQLFEVMATKSKIYFVMEYVRGGELFNKVAKGRLKEEVARKYFQQLISAVGFCHARGVYHRDLKPENLLLDENGNLKVSDFGLSAVSDQIRQDGLFHTFCGTPAYVAPEVLARKGYDGAKVDLWSCGVVLFVLMAGYLPFHDQNVMAMYKKIYRGEFRCPRWFSPDLSRLLTRLLDTKPETRIAIPEIMENKWFKKGFKQIKFYVEDDRLCNVVDDDGLMDNDDDTASIVSVASFSDYSVSESDSEIETRRRINAPLPRPPSLNAFDIISFSPGFNLSGLFEEKEDETRFVTAAPVNRIISKLEEIAQLVRFSVRKKDCRVSLEGTREGVRGPLTIAAEIFELTPSLVVVEVKKKGGDRAEYERFCNDELKPGLQNLMVEESATSSELSTPIQPSLLRGLSEPVPDISSDIETPLCIPSDD

SEQ ID NO: 4073 - protein, 152 aa, Glycine max
MSQLLDKAKNYVAEKVTNMPKPEASVTDVDFKRVSRDSVEYLAKVSVSNPYSTPIPICEIKYSLKSAGKEIASGTIPDPGSLKASDTTMLDVPVKVPHSILLSLAKDIGADWDIDYQLDLGLVIDLPVIGNFTIPLSQKGEIKLPTLSDMFA

SEQ ID NO: 4074 - protein, 152 aa, Glycine max
MAELLEKAKNYVAEKVTNMPKPEASVTDVDFKRVSRDSVEYLAKVSVQNPYSTSIPICEIKYSLKSAGREIAAGTIPDPGSLKASDTTMLDVPVKVPHSILLSLAKDIGADWDIDYQLDIGLVIDLPVIGNFTIPLSQKGEIKLPTLTDMFA

SEQ ID NO: 4075 - protein, 400 aa, Glycine max
MACPAMANGNGSLKNLKLNDTKGKTITCKAAVVYGPGEPFVVENILVHPPQKMEVRIKILYTSICHTDLSAWRGVNEAQRAYPRIFGHEASGIVESVGEGVSEVEEGDIVVPIFNGECGECSMCKCEKTNLCERFGVDATKKVMEGDGTTRFSTVNGKPIFHFLNTSTFSEYTVVDSACVVKFLDSDHSLSHKNLTLLSCGVSTGVGGAWNTANVHSGSTVAIFGLGVVGLAVAEGARARGASKIIGVDINPDKFIKAQTMGVTDFINPDDEEKPVYERIREITDGGVHYSFECTGNVDVLRDAFLSSHEGWGLTVILGVHASPKLLPIHPMELLDGRNIVGCVFGGFKGRSQLPHFAKECGQGVVKLDNFITHELPFEEIDKAFDLLITGKSLRCLLHF

SEQ ID NO: 4076 - protein, 379 aa, Glycine max
  misc_feature (223)..(223): Xaa can be any naturally occurring amino acid
MCVKDQEKDMMDSTTTNSWPLQHCHLLLKTHMDKKGSFLRTSSDDTTNISVQNSFPLESICEDTVVVDKKQNLMNFVLALRSGEWSDIGERPYMEDTHICIGDLAKKFNYDVPFEEAVSFYGVFDGHGGKSAAQFVRDNLPRVIVEDVNFPLDLEKVVKRSFLETDAAFLKTYSHEPSVSSGTTAITAIIFGRSLLVANAGDCRAVLSHHGRAIEMSKDHRPXGINERTRVESLGGFIDDGYLNGQLGVTRALGDWHIEGMKEMSERGGPLSAEPELKLMTLTKEDEFLIMPSDGIWDVFSSQNAVDFARRRLQEHNDEKQCCKEIVQEASKRGSTDNLTVVMVCFNLDPPPPVVVERTRVRRSISAEGLQNLKCLLKQ

SEQ ID NO: 4077 - protein, 208 aa, Glycine max
INVSLVAEAESALILVRHGESLWNEKNLFSGCCSVPLTNRGVEEAIEAGQRISYIPIDMIFTSALIRAQMTALLAMTRHSQKKVPIIIHDESEQATTWTQVYSEKTTKQSIPVITAWQLNERMYGELQGLNKQETAERYGKEKVHEWCRSFDIPLPKALYWIFYDTDILLGIETYEISTGIEPPLKSGKHVMVASHGNSLRSIIMYRD

SEQ ID NO: 4078 - protein, 369 aa, Glycine max
  misc_feature (193)..(193): Xaa can be any naturally occurring amino acid
  misc_feature (246)..(246): Xaa can be any naturally occurring amino acid
GQLLFLCRDKFIFGRPTRPRKVEEMVLDILKKSNIKEATEFTIRVAASERLGIDLSDTASKHFVRSVVESFLLSVAANEKSKDAEKKKENEDIAAKNDDVAKKEDVVVANEEESRETEVLPKLKRDDPERVICHLSNRRNVAVKDFKGTTLVSIREFYMKDGKPLPGSKGISLSSEQWSTFKKSVPAIEEAIXKMEGRIGSEPNGKQNGDASNSAVDVAYLEPNGKQKGDASNSVVDVAPLEPHGXQNGDASNSVVDVAALEPVVPIEVIRLDGKNFQSWARQMELLLKQLKVDYVLDEPCPNPTLGGKRWLNDDLTCHRNILSHLSDPLYNLYANRKLSAKDLWERIKTGLSVRGIWNPKISCEKSIF

SEQ ID NO: 4079 - protein, 87 aa, Glycine max
  misc_feature (31)..(31): Xaa can be any naturally occurring amino acid
MRDVLRIASIPPTSLDGVTDWLDTADVDFYXSRLHLSCRRILWTITAGPDSAIGGGGCAWRTPGAAAPASCNSAAPAQGGGPSDVVP

SEQ ID NO: 4080 - protein, 125 aa, Glycine max
  misc_feature (16)..(16): Xaa can be any naturally occurring amino acid
  misc_feature (39)..(39): Xaa can be any naturally occurring amino acid
  misc_feature (51)..(51): Xaa can be any naturally occurring amino acid
  misc_feature (62)..(62): Xaa can be any naturally occurring amino acid
  misc_feature (84)..(84): Xaa can be any naturally occurring amino acid
  misc_feature (98)..(98): Xaa can be any naturally occurring amino acid
  misc_feature (103)..(103): Xaa can be any naturally occurring amino acid
PARHHTHLTYFESRLXLIWREILNTNTADPDSYIAGGGXQGLNLGATVPEXTTQRHVDEGYXPSEGEPVSDSEDEASHGESHAXSDDDGQEQPQEDSXKQNGXTCEELEMEASNADRNGETESNS

SEQ ID NO: 4081 - protein, 234 aa, Glycine max
MSSGNGGGGSSSGTGSPCGACKFLRRKCVSGCIFAPYFDSEQGTSHFAAVHKGFGASNVSKLLLSIPVHRRLDTVITICYEAQSRIRDPVYGCVSHIFALQQQVVSLQAELSYLHGHLAQMELPQPPPPLPLPQTMAAPPPGFSIADLPSATVAAAAATTYDLSSLFDPLGQTSWAMQQRAIDPRQYNMAAAPSTATTGADIQAVASDIPHRHGSPPSPPASSSNASPSLSLSK

SEQ ID NO: 4082 - protein, 262 aa, Glycine max
MEGGRRRITLYDQMTAGNSCSSGSRDSLASLMMDDVVFKKMETEASGELSRSRTLQDIIREEKPNNSSNATDRNSWKAFKEKLWLKRAIGSAWSSATTITNHSNDDRNLPNLPETRHDSDELTQQNDVVAGEANDSEPIARFGSPVEQVAAGGDSSDGENNHEAVVGVSLMDLLEEAEQEMDLYRVSDDDDVAEYEKREGEGEEEKGGVVEYNCCVCMVRHKGAAFIPCGHTFCRMCSREIWVSRGNCPLCNNLILEILDIF

SEQ ID NO: 4083 - protein, 619 aa, Glycine max
  misc_feature (572)..(572): Xaa can be any naturally occurring amino acid
MNKSSDAAASPYCRGRSKKPNLRSSKSQPPSHVEFSSKTPEKPPQRIRNRGVALSVADIRKAACKRLQDQKQCTETTSSSLSSSSSLSKSVRRQISLGPSSPSKPMATDDESSNLPEKYEILDEFFNRLDTLVSLHRLKRWTPTFTSISSRIESLTDRRFTHSHLAQLKFILRKAIVLRKHLVLDERTSCMKPDIHISLDPDAVEADAAKLPPQGGRVSLKKVFRARLKEFWESHPEGDEIPEGTLPEPFNRQKKDSVVDMLETPLPTKLPPCMRYSDIVNNADLDEKLYVPVNATVEFPNEHLAAPSHMAPSFRADDVQQNPLLDSLQPLAFPVSESSQKENPPLVDTESHLKTSPAKFSSEASSSESCLTICASLESSSPHPATPSKTIEYTEKKDGSLKSIDAMSTPTSRTNKYTENKDGSLESIDATSTPAKLVSTPIRLMSATPALRSPKRRYMSPDDHSISSLNKLARHPSRSRSLKFDTPVKNKDDISDTLQEEFIQSIREKERLAMEERDPAITQAKKKKKNIASLPKLFDMIRGLLRQRNCITKAELVSKIISSRCDIADRSXVEEQLNLLQELAPEWISEKQVSSGDLLLFINKMLSPETVRASLEEAT

SEQ ID NO: 4084 - protein, 184 aa, Glycine max
  misc_feature (76)..(76): Xaa can be any naturally occurring amino acid
  misc_feature (155)..(155): Xaa can be any naturally occurring amino acid
MEVLAGALHSITSKCMVLLVTVLILRALLFASFPGFGGIEWGNLVYLRAPLLNFDFGIRQDKFLVVPQLVWGLNNXQRIAFARACLTARLLNRTLLMPSLSASLFYKEIDLLQPISFDKVFQFEKFNALCRGFVRLGCYSDVLNRQEVLKMEKGXSGRKVDSWRKIWHQWKEHSKGSFDEYEVI

SEQ ID NO: 4085 - protein, 158 aa, Glycine max
  misc_feature (79)..(79): Xaa can be any naturally occurring amino acid
  misc_feature (99)..(99): Xaa can be any naturally occurring amino acid
  misc_feature (112)..(112): Xaa can be any naturally occurring amino acid
SATKPPRSRNSARYRPSTTAPVTKRCAVPANASCSPSYRRISTPNTVELEPYFTDSLGNSSRIDSGTGHDTNFAAWLYXLVRIGVIGVGDYPGVVASVXVKYLDLMRKLQLXNWLEPAGPHGVWGLDDYHLVRFIFGCSQLIDHMCMKPKPNHNEDIL

SEQ ID NO: 4086 - protein, 168 aa, Glycine max
GILLNAVATQLKKEGSSGRVVGLDRSKRTTLSTLRAAKMEGVGEYVTCREGDARRLPFPDNYFDVVVSGVFVHTVGREYGARTAEAAAERMRAVAELVRVMKPGGVAVVWDLLHVPEYVLRLQELKMEDVRVSERVTAFMVSSHIVSFRKPSQHVHGPAEVRLDWRLC

SEQ ID NO: 4087 - protein, 431 aa, Glycine max
MKEESTGLIIGISIGVVIGVGLAISALFCLRYHRKRSQIGNSSSRRAHTIPIRENGVDSCNILSDSTLGPESPVRSGRNGMSFWLDGFKKSSNMVSASGIPEYSYKDLQKATYNFTTLIGQGAFGPVYKAQMSTGETVAVKVLATNSKQGEKEFQTEVMLLGRLHHRNLVNLVGYCAEKGQHMLVYVYMSKGSLASHLYSEENGALGWDLRVHIALDVARGIEYLHDGAVPPVIHRDIKSSNILLDQSMRARVADFGLSREEMVDKHAAIRGTFGYLDPEYISSGTFTKKSDVYSFGVLLFELIAGRNPQQGLMEYVELAAMDTEGKVGWEEIVDSRLEGKCDFQELNEVAALAYKCINRAPKKRPSMRDIVQVLTRILKSRHQRNHHHNKSLSATADEVSIDVDQLETKNSVTDHRREESIDSTADIYDL

SEQ ID NO: 4088 - protein, 116 aa, Glycine max
  misc_feature (54)..(54): Xaa can be any naturally occurring amino acid
  misc_feature (77)..(77): Xaa can be any naturally occurring amino acid
  misc_feature (81)..(81): Xaa can be any naturally occurring amino acid
  misc_feature (98)..(98): Xaa can be any naturally occurring amino acid
MEEILGLLPLVLDSTTFAMTNPNFDGKGTYLILNVRDAFLITDLNSIDKDPTRXIDLTNSNPECHTFEQDANDVHDXLLVXNFGDDYSVSLRQQLHDXDKKLVAAHNYNKDWPVNN

SEQ ID NO: 4089 - protein, 137 aa, Glycine max
  misc_feature (54)..(54): Xaa can be any naturally occurring amino acid
  misc_feature (116)..(116): Xaa can be any naturally occurring amino acid
VLVVLSVPLNDNLYICDNTRGWAGAITIKYLTGNGSNVILYRHYRHPKGVTPKXYSLKPVVPRLFEIIEIYVQMVNDCIDEEVDIFFAQLPQSGVLLLENDMIYNVDDMNDPHFAXKIACIADLYMTDAFSAVHRAH

SEQ ID NO: 4090 - protein, 345 aa, Glycine max
EQFLCSMLGDDSDINLAVVRDVLCQCGNDIERASDILLDLAASTNEKPNTARHPNYGVDNIDDERFFADPNDSLIDRRLECTSLSWEGYLSNNPWSVGSFGRKYVEVLNNSKADSAVSPGCTKSEIPQKVLESLFNIPKSTEHDKNTMNWRNVVKKIQSLGPGFYVSPHVAESQQRTCAKGDEYHVFREDSKQQWDSVKSYYTKAATAYTKRERAYAAYLSDQGKEQTKLAQKADTKASHDIFVARIKGIENMITIDLHGQHVKQAMRMLKLHLLFGSYVPSVQTLRVITGCGSHGVGKSKLKQSVINLLDREAIEWREENQGTVLIKLSGWREYSFLDTSSDSD

SEQ ID NO: 4091 - protein, 545 aa, Glycine max
MATSLSVSPSLSLNTLFFAKALPLSRPSLLSLPLPKSLLSLSTRRRTFAVRAESQNGRDAAPAHYDFDRFTIGAGSGGVRARRFAANYGASVAICELPFSTISSETTGGVGGTCVIRGCVPKKLLVYASKFSHEFEESNGFGWRYDSEPKHDWSSLIANKNAELQRLTGIYKNILNNAGVKLIEGHGKIIDPHTVDVNGKLYSAKHILVTVGGRPFIPDIPGNEYAIDSDAALDLPTKPEKIAIVGGGYIALEFAGIFNGLKSEVHVFIRQKKVLRGFDEEIRDFVSEQMSVRGIEFHTEESPQAITKSADGSFSLKTNKGTVDGFSHIMFATGRRPNTQNLGLESVGVKIAKDGAIEVDEYSQTSVPSIWAVGDVTNRINLTPVALMEGGALVKTLFQDNPTKPDYRAVPSAVFSQPPIGQVGLTEEQAVQQYGDIDIFTANFRPLKATLSGLPDRVFMKLVVCAKTNEVLGLHMCGDDAPEIVQGFAVALKARLTKADFDATVGIHPSAAEEFVTMRTPTRKIRKSESSEGKSGSEAKTAAGV

SEQ ID NO: 4092 - protein, 86 aa, Glycine max
  misc_feature (73)..(73): Xaa can be any naturally occurring amino acid
PPLFVRGDQRPWGGFFPPGILFLYISGWIGWGGRTSLFASRGEKNPPMKGFFTDVPWVFRLLFRGFSWPVSAXKKFIKGALFAKDV

SEQ ID NO: 4093 - protein, 175 aa, Glycine max
MGVTPKIAPSMLSSDFANLASEAQRMLHMDIMDGHFVPNLTIGAPVIESLRKHTKGYLDCHLMVTNPLDYVEPLAKAGASGFTFHVETSKDNWEELIQRIKSHGMTPGVALKPGTPIEEASALVEAENPVEMVLVMTVEPGFGGQKFMAETMDKVRILSSLFLMLCLMVDNTHQL

SEQ ID NO: 4094 - protein, 639 aa, Glycine max
  misc_feature (342)..(342): Xaa can be any naturally occurring amino acid
HASAVIITKDKTEIVTATSSKALKDVAYSFNEDEEEERPSTKPDAKKAEPFMSKTTLRSDNHEVSKEELRRQHQAELARQKNEETARRLAGGGSETGESRSSARTSAELMAYKNINDLPPPREMMIQIDQKNEAVLLPINGSMVPFHVAFIRTVSSQQDTNRNCYVRIIFNVPGTPFSPHDANSMKFPGSIYLKEASFRSKDSRHISEVVQSIKTLRRQVVARESERAERATLVTQEKLQLANNRFKPIRLSDLWIRPAFGGRGRKIPGTLEAHVNGFRYSPTRQDEPPPIMFPNIKHAFFQPAENEMITLLHFHLHNHIMVGNKKTKDVQFYVEVMDMVQXVGGGKRSTYDPDELEEEQRERQRKNKINVEFQTFVNRVNDLWGQPQFNGLDLEFDQPLRELGFPGVPHKSSVFIVPTSACLVELIETPFLVVTLSEIEIVNLERVGLGQKNFDMTVVFKDFKRDVLRIDSIPSTSLDGIKEWLDTTDIKYYESRLNLNWRQILKTITDDPQSFIEGGGWEFLNLEATDSESENSEESDKGYEPSDVEPESDSEDEASDSESLVESEDDDDDEDSEEDSEEEKGKTWEELEREASNADREKGNESDSEEDRKRRKAKSFGKSRGASLSSSMPKRSKLR

SEQ ID NO: 4095 - protein, 323 aa, Glycine max
MLRTLVLKRSLGLHSHFHHLLLRRCSSSAAPNSSADAETRKYAGYAALLLFCGGATYYTFPLPDDAKHKKAQIFRYAPLPEDLHTVSNWSGTHEVQTRNFLQPENAEQLERALREARSRIRPVGSGLSPNGIGLSRTGMVNLALMDGILDVDKQSKTVRVQAGIRVQQLVDGLKDHGLTLQNFASIREQQIGGIIQVGAHGTGARLPPIDEQVIAMKLVTPAKGTIEISKDKDPELFYLARCGLGGLGVVAEVTLQCVDRQELVEHTVVSTMNEIKKNHKKLLSENKHVKYLYIPYTDSVVVVRCNPVSKWKGPPKFKPQYTK

SEQ ID NO: 4096 - protein, 247 aa, Glycine max
  misc_feature (30)..(30): Xaa can be any naturally occurring amino acid
  misc_feature (240)..(240): Xaa can be any naturally occurring amino acid
MAAYKLVLIRHGESAWNLENRFSGWYDADXSAGHEEAKRGGQALRDAGYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRXAMGAVAA

SEQ ID NO: 4097 - protein, 189 aa, Glycine max
  misc_feature (34)..(34): Xaa can be any naturally occurring amino acid
  misc_feature (46)..(46): Xaa can be any naturally occurring amino acid
  misc_feature (55)..(55): Xaa can be any naturally occurring amino acid
  misc_feature (68)..(68): Xaa can be any naturally occurring amino acid
  misc_feature (71)..(71): Xaa can be any naturally occurring amino acid
  misc_feature (85)..(85): Xaa can be any naturally occurring amino acid
  misc_feature (125)..(125): Xaa can be any naturally occurring amino acid
TRPPRFPLNPSALLLAKKQATNMSVGALKEGDLXGKRAFVRVDLNXPLADNLNIXDDTRLRAAVPTIXFLXTGHGATVILSSPLXRPKRGTPNYSEKPLVPMLAQLLQIEGTTANDSIAEETEKXVAQLPKRRAWLLENVRLYKEEEKIDPVFAKKEAALAELYVNDAFSTDHTAHALTEGVAKHLKPS

SEQ ID NO: 4098 - protein, 223 aa, Glycine max
  misc_feature (160)..(160): Xaa can be any naturally occurring amino acid
  misc_feature (178)..(178): Xaa can be any naturally occurring amino acid
MLTFFLYLFLFFLLCALHQLASSQPFFLNRRILHEPFVPLTSTLPPSEAPKPQPLHASPSSHKQKPNPKYPSSTIPTTSTTATAVPTPTTATTTPQSPFFPLYPSSPPPPSPITFASFPANISSLILPHSPKPNSSSNKLLPVALSAVAACGPRYNHLRXSSVTGRRRGPPLAADGKXIRSDTDLRLLPRNAETAVETRKLRHTSSTSSEFLYLGTVVNSHII

SEQ ID NO: 4099 - protein, 208 aa, Glycine max
TRPHDLVLLFCSAWCVFYVGSCSAQLQSSQTQVLLQLKKHLEYPKQLEIWRDRWTDLCSISSPGQVNVTCKDNFVTELTILGDDKPTTKGRDFDGFAIPNQTLSESFSMDSLVATLARLTSLRVLNLVSLGMWGPLPDRIHRLYALEHLDLSSNYLYGSIPPKICTMENLQTLRLVDNFFNGTIPSLVNSSSHLTVLSLKSNRLKGPF

SEQ ID NO: 4100 - protein, 170 aa, Triticum aestivum
LSYLLIGKKLPVDVVGMMSSIVQIVVAPIAAGLLLNRFLPRLCSAIQPFLPPLSVFVTALCVGSPLAINIKAVLSPYGLSIVFLLFAFHTTSFVAGYHLAGTWFRKSPDVKALQRTISFETGMQSSLLALALANRFFPDPLVGVPPAVSVVLMSLMGFGLVMLWSKKTQA

SEQ ID NO: 4101 - protein, 174 aa, Triticum aestivum
MVLELDRVLMLRAAVLAVVTGFAAAGFISNDALQSHSHGGAGRSLLQAKKECPVTFEGANYTLITSKCKGPLYQPALCCAALTEFACPYDTYINDVATNCAATMFSLIHLYGKYPAGLFANTCKGDNLGLKCPEDVPQVQPGEEGKSSAAVATAAQAALAAASAAVMSLLIVMS

SEQ ID NO: 4102 - protein, 141 aa, Triticum aestivum
  misc_feature (121)..(121): Xaa can be any naturally occurring amino acid
  misc_feature (129)..(129): Xaa can be any naturally occurring amino acid
MEIRTKDDAWRLLLVLFLGQLVAFSMAACSFASSFIANLGVDTPLAQSFCTHLLLTLVYVPILLRRRQKLRIPWYWYLVLAFVDVQGNYLVTEAYQYSSITSVTLLDCWTVVWAIILTWYXLGTRYSFXAISGGQGPVWLG

SEQ ID NO: 4103 - protein, 524 aa, Triticum aestivum
MGCCRSSLRAVTHPHPEKPPGTGAGAAPMARRPSFSASAHRAAPPPPAAAAAASSSEAGFAEFSLAELRAATGGFAPENIVSESGDKAPNFVYRGRLQQGQGQGPRRAIAVKKFGKMAWPDPKQFAEEARGVGRLRHRRLANLIGYCCDGDERLLVAEFMPNDTLAKHVFHWENQTIEWAMRLRVAYHIAEALDYCSNEGRPLYHDLNAYRVLFDENGDPRLSCFGLMKNSRDGKSYSTNLAYTPPEYLRTGRVTPESVIFSFGTVLLDLLSGKRIPPSHALDMMRGNNIQMLMDSHLEGNYSTEEATALVDLASQCLQYEARDRPNTKKLVNILEPLQTKLEVPSYEMLGIPKHEEEVPPPPTPQPPQHPLSPMAEACSRMDLTAIQQILVSTHYRDDEGSNELSFQEWTQQMRDMLDARKRGDLAFRDKDFKTAIECYTQFVDVGTMVSPTVYARRSLCHLMCDQPDAALRDAMQAQCVYPEWPTAFYMQAVALSKLDMQSDAKDMLSEASQLEEKKQKNSR

SEQ ID NO: 4104 - protein, 183 aa, Triticum aestivum
MAPPAAGRPSASAAPEPPLREAAKRRRAPACAGAWARILSLGVRGAVMVAALVLFLLFAAAAVILMLALLVAARAFRQQGRRRHRAPPDSSAPPPPPAVGLPSAKIRLLPSFVPCPCDGGGGGDGDPSSPRICPVCLDAARAGERWRALPACGHAFHAACVDRWLLLSPGCPVCRATVSVPVS

SEQ ID NO: 4105 - protein, 194 aa, Triticum aestivum
MLLASKNDFFLHGAYCRYLFDQKFVRDLPVILVYTDQAKDSDSMETYTTDDALSAMGFGRFQALVLAYAGMGWVVEAMELNLLSFVGPLVREEWKVSYCHLSVRSFGGCGKSLPKMRAYSQVWSRYGRRTVLLFSALFTSGMGFLSAWSPNYLCLIALRFLVGVGVGGGHVFSSWFLEFVPAQNRGTCVVLFSL

SEQ ID NO: 4106 - protein, 245 aa, Triticum aestivum
MDSTLFIIGVIGNIISVLVFISPIPTFWRIVRSGSTEDFEAAPYVLTLLNTLLWLYYGLTKPDGLLVATVNGFGAVMETIYLVLFLVYAADKGKRVKTAKLVAVLDIGFFGVVFAATTFAIGGLDMKIMVIGLICACLSVFMYGSPLTAVRTVIASRSVEYMPFFLSFFLFLNGGVWATYAVLDKDVFLGVPNGIGCFLGGIQLVIYAMYMNSKVASHSYGSDEAASLLSSEASKHGQHDASTRV

SEQ ID NO: 4107 - protein, 295 aa, Triticum aestivum
MFSKRLKAAGEALAVEASQPVPRPPPLLTAGYVQPQFSGSDAVTPVPAPVTASVPPVRSFLPRRPLIVPEVHTESLDKEKRTPKANQLYQNSEFLLAKDRIPPSDSHGRKKTKHHKKKHRSSSAHGAGYNAEQRLYSHAFKKSSSLLSRLMKHKFGWVFNKPVDPVALGLHDYFAIIKHPMDLGTIKGQLTRGHYRDPKEFANDVRLTFHNAMTYNPKGQDVHFMAEQLLGIFEAQWPEIEAEVDYLASCPPLPKKVPPPPIDLRLLERSDLKHHMALDSRSRPIHTPISVRTHP

SEQ ID NO: 4108 - protein, 487 aa, Triticum aestivum
MDALAGLSAFAAVALPLLLLYSVHRWRNPRCNGRLPPGSMGLPLVGETFQFFSPDASLDVPRFIRDRLTRYGPIFKTSVVGHPVVVSADEELNHMVFQQEGELFQSWYPDSFVEILGRDNVGEQKGTMFKYLKNMVLRFFGPESLKESILRDVQRAVCSSLCTWSTLPAVDFKEAVSTMVFELSASKLLGLEPSRSKVLRKSFFDFVLGLISFPLYLPGTAYYACMQGRMSVMEVLQQVLEERTRSAEAAGGGEARCHGDFLDYVVQEITKEKPVLTEGMALDLLFVLLFASFHTTSLAITLAVKLLTDNPRVLEELTVEHETILNEREAGGETDGDRLTWKEYKSMTFTSQVINETVRLANIAPGIFRKTLKDVQFRVYTIPAGWGVMVCPLAVHLNPDIYPDPLTFNPSRFKDKLEANRGSRHFMAFGGGLRSCVGADFSKLQMAIFLHFLVTKYRWIQLGGGKIVRCPGLEFPDGYLIQIRQRD

SEQ ID NO: 4109 - protein, 201 aa, Triticum aestivum
MDSEHWISRLAAAKRFYAAQLGHAGADRAGMDELDMDGDENAGRPDFACPYCYEDHDVASLIAHLEEDHPFEPHAANRRRLRRFAVPGSQSLSLLSRDLREAHLQVLLGGGGHRSSNNNAANISADPLLSSFGLSFPTLDAEETSKLSTPAQSDVPVLKEAAARPWRSSMDSSLTREEREQASVRAAFVQDLLLSTLFRDQ

SEQ ID NO: 4110 - protein, 284 aa, Triticum aestivum
  misc_feature (130)..(130): Xaa can be any naturally occurring amino acid
MDSEHWISRLAAAKRFYAAQLGHADRAGMDELDMDGDENAGRPDFACPYCYEDHDVASLVAHLEEDHPFEPHAAPCPICSEKVSKDMLNHITMQHGYLFKNRRRLRRFAVPGSQSLSLLSRDLREAHLQXLLGGGGHRSSNNNASNISADPLLSSFGLSLPSLDAEETSNLTTPAQCDVPVQKERAARSRRGINYYSLLTGSKTNISADPLLSSFGLSFPTLDAEETSKLSTPAQSDVPVLKEAAARPWRSSIDSSLTREEREQASVRAMFVQDLLLSTLFRDQ

SEQ ID NO: 4111 - protein, 495 aa, Triticum aestivum
  misc_feature (149)..(149): Xaa can be any naturally occurring amino acid
SPSAAAAPHTPHKTTRSFFSFPLLRRARGADMSSAAPLLEPADGKGGEAKRPCGCPPAWLRRLINTEEAWAQLQLAVPMVLTNMSYYGIPLVSVMFSGHLGDVHLAGATLGNSWATVTGYAFVTGMSGPLHAIGGHAFGARVYPLLGLXLQALLIMAAVVHVVIAVLLLVGVRLLLSLRQVAEVYLQAQLPSLQTQSVVVPLVVCSVVPLALHVLLNHLLVNVLGLGLSGASAAISATFWFSCLMLLGYVMWSKKFGETWKGFSADAFNYVLPTIKLAAPSAVMVCLEYWAFELLVLIAGLLPNSTVSTSLIAMCSSTEAIAYMITYGFSAAVSTRVSNEIGAGNVDMAKNAVAVTLKLSVFLAFSFVLLLGFGHGLWARLFSRSEVIAAEFAAITPLVMASIVLDSAQGVLSGVARGCGWQHLAAITNLVAFYFIGMPLAILFAFKLNFYTKGLWSGLICGLTCQTITLVVITARTKWSKIADAMQQEKANYVA

SEQ ID NO: 4112 - protein, 367 aa, Triticum aestivum
LSCRPPYLQAGRARSRSVRPRVLRRRRRPPAPEEMPRYDDRYGNARLYVGRLSSRTRSRDLEYLFSKYGRIREVELKRDYAFIEYSDPRDADEARYNLDGRDVDGSRIIVEFAKGVPRGSGGSREREYVGRGPPPGTGRCFNCGIDGHWARDCKAGDWKNKCYRCGERGHIERNCQNSPRSLRRERSYSRSPSPRRGRARSRSYSRSRSYSRSRSRSYSESPRGRRTERDERRSRSISYSRSPRRSLSPEAKDMDRSPTPDRSRSPRRSISPVAKDNGDSPRGREKSRRPSDGYRSPVANGRSPRSPVNNGSPSPTRDNRASPSPRGNNGSPSPKGNGNGGSPSPRGNGDDDGRRGSGSPRGRSVSP

SEQ ID NO: 4113 - protein, 300 aa, Triticum aestivum
MLPSTFQDKMKEEEALKRKLKARMEYAKFLQEPAKEMAKEVKASYSGETKQTAGDLDEFLNKDVTNVGDEGGFAPNIQENKDGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 4114 - protein, 349 aa, Triticum aestivum
  misc_feature (230)..(230): Xaa can be any naturally occurring amino acid
  misc_feature (287)..(287): Xaa can be any naturally occurring amino acid
  misc_feature (320)..(320): Xaa can be any naturally occurring amino acid
MDALTLTSLLKAAAAAFPDRRAIAVHAKIDLTHAALDALVDAAAARLAAGPDGLRPGQTVALCFPNTVELVVVFLAVIRARGVAAPLNPAYTQDEFEFYLSDSGARLLVTGADGNAPAQAAAAKLGLPHAVAATLTDAAGPLGLTGLVEGNPAPQNNGTLQHKEENEPSDVALFLHTSGTTSRPKGVPLTQRNLAASVQNIRAVYRFAGTDAPVVTLPLFHVHGLMCALXSSLASGASVGLPAAGRFSAVTFWADMLAAGATWYTAVPDIHQIILDPHALRPERRYXALGFVGSWTRFLAPGILERLEAGFGGPGLEAYXIKRAPHLRPQPLSQEGGPHRGSGGGAGGS

SEQ ID NO: 4115 - protein, 147 aa, Triticum aestivum
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEATKSPKKKTTTKSPKKKVAAKE

SEQ ID NO: 4116 - protein, 293 aa, Triticum aestivum
  misc_feature (103)..(103): Xaa can be any naturally occurring amino acid
  misc_feature (126)..(126): Xaa can be any naturally occurring amino acid
  misc_feature (137)..(137): Xaa can be any naturally occurring amino acid
MTTTATMNVAVTQLCGRGRRRRPAALRHDHRWARVLRLAVATRVVRLVWDQLLACSFCGGGGGARYRRLGPPHGPDVLTPVAMDDDAGAHAHADADDDAADVXDVVGLKVSLLGDRQIGKTSLMVXYVGDGEEPNGXLQMTGLNLMDKTLAVRGARLAFNIWDVAGDSQSADHVPIACKDAVAILFMFDLTSRCTLNNVTDWYERARKWNKTAIPILIGTKFDDFAQLPLEMQWTIVDEARAYARAMKATLFFSSATHNINVNKIFKFITAKLFNLPWTVERNLTVGEPIIDF

SEQ ID NO: 4117 - protein, 521 aa, Triticum aestivum
MGNQNGTPGNDYYNRFPREHPASRPTAAGILRQGLDPTSISVLGRKTADLREHYILGRKLGQGQFGTTYLCTEISTGCDFACKTILKRKLITKVDVEDVRREIQIMHHLSGHKNVVSIKDVYEDAQAVHIVMELLPGGELFDRIQGNGRYSEMKAAEITRIVVSIVAMCHSLGVMHRDLKPENFLLLDKDNDLSIKAIDFGLSVYFKPGQVFSELVGSPFYVAPEVLHKRYGPESDVWSAGVILYVLLSGVPPFWADTQKGIFDAVLKGHLDLESDPWPKISDSAKDLIRKMLCNCPSERLKAHEVLRHPWICQNGMATDGVLDPSVISRLKRFSAMNNLQKLALRVIAERLSEEEIAGLRELFKTVDIKNRGVITFGELRKGLTRYGNELVDTEICDIMEAADTDTDVTINYEEFIAATMPLNKIEREEHLKAAFTYFDKDGSGYITVDKLQRACAEYNMEGTLLEEIILEADQNNDGQIDYAEFVAMMQGNANGGNIGLGRPTMETSLNVTLRDAAQVH

SEQ ID NO: 4118 - protein, 268 aa, Triticum aestivum
VRKKVRSGGIEPGIRAEVWPFLLGVYDLNSSEEERNTIRAKKRKEYEKLRRQCQHILNGYRGSGLKSINEVNNEECSAQGSGAEGSESPCFEDVNVEKASRSLEEPKPEHSEAEQPEITMCDDVIESMEEDTSELIDAYPCIAESESSDSESSDEDDSGRISVCGEESCDPDPKFARSSSFKADIFRSSRTSEDFATWQRIIRLDATRANAEWISFSRNQAEVPKEKALQSATSVGLKDYDHLEPHMIYHAARLVGLLEAYAIYDPEI

SEQ ID NO: 4119 - protein, 188 aa, Triticum aestivum
PPTASAKQEERRSGTMLGHLAGLVKVRVTRGVNLAIRDLRSSDPYVVVRMGKQKLKTRVVRKSINPEWNDELTLSVEDPTIPVKLDVFDKDTFFDDPMGNAELDIGPLVEAATMRIQLQGVADGTVVKKLVPNRQNCLAEESAVYLSEGTVKQDVLVGVLRLRNVECGEVELQLQWIDIPGSKGASGF

SEQ ID NO: 4120 - protein, 375 aa, Triticum aestivum
MNSLTATGSSSGGAEMRAADGEGYLRADGFDLVNLDMQLEKTRSRVWLDQQRGASPAQPGELLEWEIDLAKLDIQNQVASGTFGVVYRGTYDGNDVAVKVLDWGQEGQESSSKHREAFEKEVAVWQKLDHPNVTKFVGASMGTSQLKIPASKKGGSSHGPGQRCVVVVEYQHGGTLKTLLFQHRDKKLPYKKVVQLALDMARGLSYLHSQKIVHRDVKAENMLLDRKKSVKIADFGVARVEAQDDDNMTGQTGTLGYMAPDVLEGRPYDHKCDVYSFGVLLWETYCCALAYPNYSIADISYHVVKLGIRPDIPRCCPKPLSEIMTRCWDGNPDHRPEMAEVVAMLERIDSTKGKSMTPAVPDHTSQGCSCFGFSK

SEQ ID NO: 4121 - protein, 375 aa, Triticum aestivum
MNSLTATGSSSGGAEMRAADGEGYLRADGFDLVNLDMQLEKTRSRVWLDQQRGASPAQPGELLEWEIDLAKLDIQNQVASGTFGVVYRGTYDGNDVAVKVLDWGQEGQESSSKHREAFEKEVAVWQKLDHPNVTKFVGASMGTSQLKIPASKKGGSSHGPGQRCVVVVEYQHGGTLKTLLFQHRDKKLPYKKVVQLALDMARGLSYLHSQKIVHRDVKAENMLLDRKKSVKIADFGVARVEAQDDDNMTGQTGTLGYMAPEVLEGRPYDHKCDVYSFGVLLWETYCCALAYPNYSIADISYHVVKLGIRPDIPRCCPKPLSEIMTRCWDGNPDHRPEMAEVVAMLERIDTTKGKSMTPAVPDHTSQGCSCFGFSK

SEQ ID NO: 4122 - protein, 283 aa, Triticum aestivum
  misc_feature (115)..(115): Xaa can be any naturally occurring amino acid
MTKDEDFKLVKIQTHVLRVNIHCDGCKHKVKKLLQRIEGVYSVAIDVDNHKVTVTGSVDSETLIRKLTRGGKHAGGVGGHKSSPRHPGRGGGGRSSQPKQQQQQKPQKQAANVSXDGGGKGNGGQKEQGKLGGGGVGSLMQGLKAFKSQHSKHQLPELSSDDDDDDMYDDEDDEDDDEFDDEYEDDLRFLGDKMSQLGILRQRAEAAAAINAKNKNAANVGGKKGAPAGNNHHQSNQNQKMNMGAAAGNAKMGNGAPKNTGGIGGLMGLNHGGLGAAGAAPGI

SEQ ID NO: 4123 - protein, 453 aa, Triticum aestivum
  misc_feature (112)..(112): Xaa can be any naturally occurring amino acid
  misc_feature (257)..(257): Xaa can be any naturally occurring amino acid
  misc_feature (269)..(269): Xaa can be any naturally occurring amino acid
  misc_feature (319)..(319): Xaa can be any naturally occurring amino acid
MARPEENAKFPSCDAYFDTIQSKKKLPLALQESLTAAFAQIPVASFPDVPSGRVTEIPGETSVLDAVRILSEHNIRAAPVLNPEPGAPADWQGRYLGIIEYSAIILWVLDNXDLAAVALSAGSATPAGVGMGAVGAGGVAALGATGPAAVAGLTAAAVGAAVAGGLTAEKGVAKDGVTAADHLGEDFYKVLLQQEPFKSTTVRSIVESYPWSPFVPVTLDSSMLAVLLLLSKYRLRNVPVIEPDKPVIKNFITQTGXVVKGLQQCKGRXDWFDYISALPLSDMGLPFMSLDEVITVNSDDLILEAFKCMKDNKIGGVPXVVEGPKRKLVGSVSIRDIRFLLLRPDLFSDFRHLTVLEFMNALGSTLPDSGGNGLVKPPLTCAPDASMGSVIDSIGSRITHRIYVVDGDFEVVGVVTLRDVISCFIHEPPGFCDSYLASAMEMPRGQGRCRFLR

SEQ ID NO: 4124 - protein, 522 aa, Triticum aestivum
  misc_feature (146)..(146): Xaa can be any naturally occurring amino acid
  misc_feature (504)..(504): Xaa can be any naturally occurring amino acid
MGNQNGTPGNDYYNRFPREHPASRPTAAGILRQGLDPTSISVLGRKTADLREHYILGRELGQGQFGTTYLCTEISTGCDFACKTILKRKLITKVDVEDVRREIQIMHHLSGHKNVVSIKDVYEDAQAVHIVMELLPGGELFDRIRXNGRYSEMKAAEITRIVVSIVAMCHSLGVMHRDLKPENFLLLDKDNDLSIKAIDFGLSVYFKPGQVFSELVGSPFYVAPEVLHKRYGPESDVWSAGVILYVLLSGVPPFWADTQKGIFDAVLKGHLDLESDPWPKISDSAKDLIRKMLCNCPSERLKAHEVLRHPWICQNGMATDGVLDPSVISRLKRFSAMNNLQKLALRVIAERLSEEEIAGLRELFKTVDIKNRGVITFGELRKGLTRYGNELVDTEICDIMEAADTDTDVTINYEEFIAATMPLNKIEREEHLKAAFTYFDKDGSGYITVDKLQRACAEYNMEGTLLEEIILEADQNNDGQIDYAEFVAMMQGNANGGNIGTWGXPTLETSLNVTLRDAAQVH

SEQ ID NO: 4125 - protein, 144 aa, Triticum aestivum
MPSAGLEAGSNKVDVAIDLGNPLLNRTVDGFLKIGAVGACRVVAEDAFDCIHRGDISKRQLEETLKKMCKEGAYWGAVAGVYVGMEYGVERARGDRDWKNALIGGIATGALVSAATNNKGSKIAQDAITGGAIATAVEFINYLT

SEQ ID NO: 4126 - protein, 148 aa, Triticum aestivum
MAGRKGGERKKAVTRSVKAGLQFPVGRIGRYLKKGRYAQAVGSGAPVYLAAVLEYLAAEVLELAGNAAKDNKKTRIIPRHLLLAVRNDQELGRLLAGVTIAHGGVIPNINSVLLPKKAAGAAEKESTKSPKKKAATKSPKKKTAATKE

SEQ ID NO: 4127 - protein, 231 aa, Triticum aestivum
MAALTASIATSSAFAAKPRLARPPARLSVSCSASSGDNNTPSLSASIKTFSAALALSSVLLSSAATSPPPAAADIAGLTPCKESKAFAKREKQSVKKLNSSLKKYAPDSAPALAIQATIEKTKRRFENYGKFGLLCGSDGLPHLIVSGDQRHWGEFITPGVLFLYIAGWIGWVGRSYLIAVSGEKKPAMREIIIDVELAARIIPRGFIWPVAAYRELINGDLVVDDADIGY

SEQ ID NO: 4128 - protein, 167 aa, Triticum aestivum
MALTRLFISLFPAAVLAGLASASASPFLSDSLFQASTGSTGRSLLQTKNDCPMSFETQNYTVLTNKCKGPQYPPTECCDAFKEFACPFAAYINNQSTNCADTMFSYIDFRGYPKGLFADECLKGKEGVSCEGIPAVDTGVPSGGRQVQGVSRPLVVLLCGLGALLFP

SEQ ID NO: 4129 - protein, 499 aa, Triticum aestivum
  misc_feature (144)..(144): Xaa can be any naturally occurring amino acid
MGQRLLLLVTTCLWALSCAVPHHASSPDGLLRINLNKRSLTYESLAAAKAARQHGALRLKSSDSDSDIVPLVDYLNTQYYGVIGLGTPPQNFTVIFDTGSSNLWVPSSKCYFSIACYLHPKYKSSKSSTYKADGETCKITYGSXGAISGFFSNDNVLVGDLVVKNQKFIETTRETSVSFIVGKFDGILGLGYPDISVGEAPPVWLSMQEQKLLADDVFSFWLNRDSDALSGGELVFGGMDPDHYKGNHTYVPVSRKGYWQFNMGDLLIDGHSTGFCAKGCAAIVDSGTSLLAGPTAIVAQVNHAIGAEGIISTECKEVVSQYGEMILELLIAQTQPQKVCSQIGLCLFDGTHSVSNGIESVVGKENVGSDVMCTACEMAVVWIENQLRENKTKELILQYANQLCERLPSPNGESTVSCHEMSKMPNLAFTIASKTFVLTPEQYVVKLEQSGQTVCISGFMAFDIPPPRGPLWILGDVFMGAYHTVFDFGHDRIGFAESA

SEQ ID NO: 4130 - protein, 323 aa, Triticum aestivum
MAAAAARKSVVCVTGAGGFVASWLVKLLLSKPHYTVRGTVRDPGNAKNAHLKALEGAGERLQLLSADLMDYDSIASAVAGCEGVFHVASPVPSGRSTNPEEEVIAPAVTGTLNVLKACYEAKVKRVVIVSSCAAVFNNPNWPKGKVFTEDSWSDEDLCREGLDWYLLSKTRAEREAFAYAAKTGLDVVAILPSLVLGPLMQSTVNASSKILLKYLKGEHETVENRSWNLVDVRDVADALLLAYENPAASGRYICSPVRIKVSDVISILKTLYPTYTYPKNFTEVEEGNVMSSEKLQKLGWTFRPVEKTLGDSVESYKASGILN

SEQ ID NO: 4131 - protein, 277 aa, Triticum aestivum
  misc_feature (213)..(213): Xaa can be any naturally occurring amino acid
MATPNGLARIDTTHPEKKAAAAKHENGICHDDSSAPVRAQNIDELHSMQRKRSAPTTPIKDTSASPFAVAVSDEDRRKQQLQSISASLASLTRETGPKVVRGDPARKGEAAAKTSAPAAAPPPPQPHHHHHHHVAPTISVSDSSLKFTHVLYNLSPGELYEQAIKYEKGSFITATGALATLSGAKTGRSPRDKRIVKDEAAAQELWWGKGSPXNIEMDEHTFLTNRERAVDYLNSLDKVYVNDQFLNWDPENRIKVRIISARAYHSLFMHNMCIRPT

SEQ ID NO: 4132 - protein, 369 aa, Triticum aestivum
  misc_feature (171)..(171): Xaa can be any naturally occurring amino acid
  misc_feature (200)..(200): Xaa can be any naturally occurring amino acid
  misc_feature (205)..(205): Xaa can be any naturally occurring amino acid
AKKQSKQSSMEKGTPALGWAARDESGLLSPYSFSRRVQKDDDVTIKVLFCGICHTDLHIAKNEWGNALYPIVPGHEIVGVVTDVGPGVESFKAGDTVGVGYFIDSCRSCDTCSKGYENYCSTLVLTSNGVDYDGATTQGGFSDVLVVNQDYVLRVPESLSLAGAGAAALRXGVTVYRPMMQYGPPRRGGKHLGVVGLGGXLGHMXGKFGKGFRVTVTVISLVSEGSARRGSSGSGRDGFLVSQDAEQMKAAAGTMDGIIDTVSAGHPLVPLLELLKPMGQMVVVGAPSEPLALPAYAIIGGGKRVAGNGVGSVSSCQAMLDFAGKHGITADVEVVKMDYVNTAVERLERNDVRYRFVIDVAGSQLDAAA

SEQ ID NO: 4133 - protein, 207 aa, Triticum aestivum
MSKMADEKVISAPATGGGEDGLIAGDLSAAEARVRPLETLLRAAPLGLCVAAMAVMLRDTQTNEYGTVSYSDLGGFKYLVYANGLCAAYSLVSAFYTAVPRPATLSRSWIVFLLDQVFTYLILAAGAASAELLYLAYNGDKEVTWSEACGVFGGFCRQARTSVAITFGSVVCYILLSLISSYRLFSAYDAPMPSLGNKGVEIAAFPR

SEQ ID NO: 4134 - protein, 106 aa, Triticum aestivum
  misc_feature (70)..(70): Xaa can be any naturally occurring amino acid
  misc_feature (81)..(81): Xaa can be any naturally occurring amino acid
RRIRVRFRRGSLRNGYHIQGRQQARKLPNPDIEFTIGGKKFALKPEEYILKVGEGAAAQCISGFTAMDIXPPPRGPLWILXGDVFMGPYHTVFDYGKLRVGFAKAA

SEQ ID NO: 4135 - protein, 147 aa, Triticum aestivum
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPKKSPAAAEKEAKSPKKKTAAKSPKKKTAATKE

SEQ ID NO: 4136 - protein, 176 aa, Triticum aestivum
MEYQGQTGHATDKVEEYGQPVAGHGGATGGPTGTHGAAAAAGGQLQPTRDDHKTDGVLRRSGSSSSSSSEDDGVGGRRKKGMKEKIKEKLPGGAHKDATGQQHTPAAGEYAGTGTGTHGAEATGEKKGVMDKIKEKLPGGQHSASYGVLCLCSVQARHGWPQLGCLHAYFCMRSYG

SEQ ID NO: 4137 - protein, 130 aa, Triticum aestivum
MAAAVADAAVPAVAKANGAGAGCCAAKGPGYATPREAMEKGPREGLLYVTCVYNGTGINKPDYLATVDVDPNLATYSQVIHRLTGTHIGDELHHSGWNACSSCHGDPSTSRRFLILPSLLSGRVHVVDTA

SEQ ID NO: 4138 - protein, 265 aa, Triticum aestivum
  misc_feature (55)..(55): Xaa can be any naturally occurring amino acid
DPGMKGVLATRVSGSADLYQVNQRKPHHGVNFIIAHDGFTLCDLVSYNLKHNDAXNGEGGRDGCNDNYIWNCGVEGETNDSNVLALRWRQMKNFHVALMISQGTPMMLMGDEYGHTRYGNNNSYGHDTCINNFQWGQLAERRYGHFRFFSEMINFPQNHPILKRDRFLSKNDVTWHEDCWDNLESKFLAFTIHDHNSGGDIYLAFNAHDYSVDAVIPPAPQHKHWNRVVDTNLESPNDIAPEGVPLTGSGYRIAPFSSILLKASP

SEQ ID NO: 4139 - protein, 536 aa, Triticum aestivum
MLVLFETPAGFALFKVLDEGKLSSVEDLWKDFASSDKARKVVELKAFNKFENTSDALSAATLLIDSKPSKGLRKFLQKHCDGETLAVADSKLGNAIKEKLQIDCLHNSAVMELMRGLRNQLTELMSGLAEHDLGPMSLGLSHSLSRYKLKFSPEKVDTMIIQAIGLLDDLDKELNTYAMRVREWYGWHFPELTKIVADNIHYAKAVKMMGNRVNAVNLDFSEILPEEVEAELKEAAVISMGTEVNDLDLSNIRELCDQVLALSEYRAQLYDYLKSRMNTIAPNLTALVGELVGARLISHGGSLMNLAKQPGSTIQILGAEKALFRALKSKHATPKYGLIYHASLIGQAAPKHKGKISRSLAAKSALAIRYDALADGDDNSMGLESRIKLETRLRVLEGKELGRSAGSTKGKPKIEAYEKDRKGGGARATPPKTYNSAADLVLGQTTEETPGKSEVAAEKRKHQEEEPTAEAAEEDGEQEKEKSKKKKKKSKDIEETPAAVTDASEKEKKKESQEAEETPAADPRRREEEKEEEIRR

SEQ ID NO: 4140 - protein, 376 aa, Triticum aestivum
MATVNPFDLLGDDEGDDPTQLLAKAAALAQKAEAKKAAAPPAAGKGGARTVANLPTKPPPPGQAANESRGGGPLSRGGYGRGERGSGRGGRGGYGQNRDYASEDTNGYRGGYGARTGGEEGAHDRERAPRQPYQGGGRRGGYREGEFGDDSERPPRRNYERQSGTGRGYEIKREGAGRGNWGTTSDEIVAQETEALKQDEKAPAPEKQGAPEDAPQADENKATKDGAAVVEEEKEEDNEMTLDEFEKVMEEKRKALAALKKSEERKVEIDKDLQAMQLLSTKKGNDEVFIKLGADKEALKKKENAEREERAKKSVSINEFLKPAEGERFYGGRGRGGRGRGDRGGFRGGFGGGGYHGPPPAPAIQDQNQFPTLGGK

SEQ ID NO: 4141 - protein, 256 aa, Triticum aestivum
  misc_feature (108)..(108): Xaa can be any naturally occurring amino acid
MADSMADSMVASFWGPVTSTTELCEENYARSSYIAEFYNTLSNAPCILLALIGLVNALRQRFEKRFSVLHISNMILSIGSIIFHATLQHVLQQSDETPMVWEIPLYLXDWHYRSTMPTFLVLYGAAFAVVHFFVRFQVVFKLHYIGLCLLCIPRMYKYYIQTKDLAAKRLAKLWVLTIFLATVCWLVDRIFCKKLSLWVINPQGHAWWHVLMGFNSYFANTFLMFCRAQQRGWEPRIIHLFGFLPYVKIQKSRKRE

SEQ ID NO: 4142 - protein, 453 aa, Triticum aestivum
  misc_feature (425)..(425): Xaa can be any naturally occurring amino acid
LNKFVQKSRLVPVRNSRDIVDPRVRVIDLVKEYNAQTKDNVIALMVDTKGPEVRSGDLPQPIFLETGQEFTFTIKRGVGTETCVSVNYDDFVNDVEAGDMLLVDGGMMSFLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVREGADAVMLSGETAHGKFPLKAVKVMHTVALRTEATIIGGETPSNLGQVFKNHMSEMFAYHSTMMSNTLGTSIVVFTRTGFMSILLSHYRPSGTIFAFTDQEIVRQRSALYQGVCPVHMEFSDCAEKTFADALSYLLKHGMVKEEXGEEVALVQSGRQPIWRSQSTHNIQVRKV

SEQ ID NO: 4143 - protein, 217 aa, Triticum aestivum
MSADELRLDLEELRRLEGLAKRPRVVSLLSNEIRSVDAKLASRAAPVQTQAPQAVAVAAAAPAGLSYVTLGSFSWDQDNEKIRVYVFLENVDQEKVETTFKPMSVDIKFHDVKGKNYRCAIPKLNKEIVPEKCKVVVKPTKIVITLWKASSGNWLDLHYQRDKFNPRMAPEKDPMSGIMDLMKGMYEEGDEDMKRTIAKAWSDARSGKTADPMRGLP

SEQ ID NO: 4144 - protein, 408 aa, Triticum aestivum
MASMTTPRLPFLPRPNPLPRRRRLKQNNSFLSSSSSPSSPLPRRSIKCSSSANANSAPLPSTSRQPRAPVADGVGSADLNGLRAPPIPVADPPLPAYRDPHGLPRPLTSADLMESSGEGLKVAYQGFPGAYSEAAAKKAYPNCQTVPCEHFDTAFQAVQNWIVDRAVLPLENTLGGSIHRNYDLLLRHELHIVGEVRLAVRHCLLANRGVKIGNLRNVISHPQALAQCEHTLTELGIEHRQAVDDTAGAAKLVAEQMLQDTGAVASSLAAELYGLDILAENIQDEKVNVTRFMMLAREPIIPRVDKPFKTSIVFSLEEGPGQLFKALAVFALREINLTKIESRPHKKRPFRVADDAFSTRVKYFDYLFYVDLEASMADPKTQNALRNLEEFATFLRVLGSYPTDVSEA

SEQ ID NO: 4145 - protein, 480 aa, Triticum aestivum
  misc_feature (49)..(49): Xaa can be any naturally occurring amino acid
  misc_feature (394)..(394): Xaa can be any naturally occurring amino acid
MQRLASSRRLLRAALAPGRAHSSLSAAAVAAAPENGAGAPKMPPFAYTXPPPYDGPRVAEIAQKRAQFLSPSLFHFYDRPLNIVDGKMQYLFDEDGRRYLDAFGGIATVCCGHCHPDVIEAIVNQAKKIQHSTVLYLNHAIADFAEALAAKMPGDLKVVFFTNSGTEANELALMIARLYTGSHDIISLRNGYHGNAAATMGATAQSNWKFNVVQTGVHHALNPDPYRGAFGSDGEKYARDIQETIDYGTTGRVAGFISEAIQGVGGIVELAPGYLPAAYDMVRKAGGLCIADEVQAGVARTGSHFWGFEGQGVIPDIVTMAKGIGNGIPIGAVVTTPEIAKVLTRSSYFYTFGGNPVRTAAGHAVLKVLEKEKLQENAFVVGSYLKEKLNALSXKKKHDIIGDVRGKGLLLGVELVTDRQKKTPAKAEIAQVMNHMKDMGVLVGKGGFFGNVFRVTPPLCFSKEDSDFMIEVMDIALSKL

SEQ ID NO: 4146 - protein, 337 aa, Triticum aestivum
  misc_feature (165)..(165): Xaa can be any naturally occurring amino acid
MAPPRRVCVTGGGGFIASWLVKLLLSRGYAVHATLRDPCDPKNVHLKQMGEVRENLHLFKADVLDYDALTRAFEGCEGVFHLATPVPEDKIVDPESEVLAPAVKGTSNVLKACSAMKVQKVIVLSSNAAVDFNPNWPQDKLKDESCWSDKDFCQENQDWYSVAKXVAEQASLEYSEKHGLNVVTLCPPLVFGPLLQPTVNTSSKFLIYVINGGPDVMSNKLWHIVDVRDVADALLAVYEKAESSGRYICAPNSVCTKDLVDLLRKMYPQYSYVNNIVDVDRKAGLSSQKLKGLGWRPRKLEETLSDSVGCYEKAGLLQGSAGRNCRLPHLFRLAGDQ

SEQ ID NO: 4147 - protein, 369 aa, Triticum aestivum
MVSATKLEGGYCFHSKNSPLDQPEGVKIHLYRLGIEQREHDALKSFAYAGQGSPSLLDTLILSQWENFAQKGHMGYDVTACELKVIEGQRDFVIQMNDKWNTFPLKKHDKFGHPFGCLKPNSARSYEELLLCIAEGENNEPEVVPSITPPNNGVLLIANAYPVEYGHIFLVPNATNQLSSFWDKRMFGLITKIASEVNSAAFRVFFDDGTSIVPKHMFFQACYFANPLPVESSSTVALYDGATRSGICVSEIVDYPLKALVFTSTNVNALVDVVSEACLALHENNTVHSLMMSNNGRNVFLFPQVKNLVTGCCLSAWECCGYFVHHTKVDFDRASETGISNRMASFSFQDGDFEDLKKLCCAIADGLVT

SEQ ID NO: 4148 - protein, 98 aa, Triticum aestivum
  misc_feature (8)..(8): Xaa can be any naturally occurring amino acid
  misc_feature (13)..(14): Xaa can be any naturally occurring amino acid
RRKEEIVXEGSGXXSWTKKLLLDNQLLCSKIREEAGELIQTLLENEEKSRTASEMADLLYHAMVLLSVRDVKMEEVLEVLRKRFSQSGVEEKASRKKF

SEQ ID NO: 4149 - protein, 144 aa, Triticum aestivum
MATKRSVGTLGEADLKGKKVFVRADLNVPLDDAQKITDDTRIRASIPTIKYLLEKGAKVILASHLGRPKGVTPKFSLKPLVPRLSELLGLEVVMAPDCIGEEVEKLAAALPDGGVLLLENVRFYKEEEKNDPEFAKKLASVADL

SEQ ID NO: 4150 - protein, 176 aa, Triticum aestivum
  misc_feature (124)..(124): Xaa can be any naturally occurring amino acid
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCXTDATQVLNEVEEVKKEYPDAYVRVIGFDNLRQVQCVSFIAFRPPGCEESGKA

SEQ ID NO: 4151 - protein, 108 aa, Triticum aestivum
  misc_feature (90)..(90): Xaa can be any naturally occurring amino acid
MANIDMAAVLADMERDAVADARTPRTKLVCTLGPASRSVPMLEKLLRAGMNVARFNFSHGTHEYHKETLDALRQAMHNTGILCAVMLDTXGPEIRTGFLEDGKPIKLT

SEQ ID NO: 4152 - protein, 130 aa, Triticum aestivum
  misc_feature (93)..(93): Xaa can be any naturally occurring amino acid
  misc_feature (110)..(110): Xaa can be any naturally occurring amino acid
  misc_feature (120)..(120): Xaa can be any naturally occurring amino acid
MANIDMAAVLADMERDAAADARTPRTKLVCTLGPASRSVPMLEKLLRAGMNVARFNFSHGTHEYHKETLDALRQAMHNTGILCAGMLDTQGPXEIRTGFLKDGKPIKLTXKGHEITVSTXYYFKGDTNTI

SEQ ID NO: 4153 - protein, 143 aa, Triticum aestivum
  misc_feature (15)..(15): Xaa can be any naturally occurring amino acid
  misc_feature (55)..(55): Xaa can be any naturally occurring amino acid
ANVVSSACIWLQDNXNVPYNVLISDSGRKIFLFPQCYAEKQALGDVSQELLDTQXVNPAVWEISGHIVLKRRDDYEEASEASAWRLLAVVSLSEARFEEVKAYIFDAACLVQVPVVDLETDDAIYAPVPVGPSAVGEGCLVIP

SEQ ID NO: 4154 - protein, 526 aa, Triticum aestivum
  misc_feature (520)..(520): Xaa can be any naturally occurring amino acid
MAAIKPPPPDRPPQAARLPSPSSSSSAAAAAKRGGTGSRGLLMGRYELGRVLGKGTFAKVYHARHVQTGESVAIKVLDREKAVRSGLVSHIKREIAVLRRVRHPNIVHLFEVMATKTKIYFVMELVLGMEVVRGGELISRVSKGSVQEDFARRYFQHVFSAAGGCHTRGVFHRDLKPDEAGNLKVSDFGLSAVAEPFQPEGLLHTFCGTPAYVAPEVLARRGYEGAKADIWSCGVILFVLMAGYLPFHDQNLMAMYRKVYKGEFRCPRWFSKDLTSLIMRFLDTNPSTRITLPEVMESRWFKKGFRPVKFYIEDDQLYNVIDAENDMLDLGLPDPLPQPLPPPPPSPSPQQVDGDDSGSESDASVVSCPATSSFEERHRLRGPLPRPASLNAFDIISFSRGFNLSGLFEEKGDEVRFISGEPMPDIITKLEEIANVKSFAVRKKDWRVSLEGTREGVKGPLTICAEIFELTPSLVVVEVKKKAGDKEEYDDFCNKELKPGMQHLVHQMAPVPITPTISEXAERPSR

SEQ ID NO: 4155 - protein, 526 aa, Triticum aestivum
MSAIKPPPPDRPPQAARLPSPSSSSSAAAAAKQGGTGSRGLLMGRYELGRVLGKGTFAKVYHARHVQTGESVAIKVLDREKAVRSGLVSHIKREIAVLRRVRHPNIVHLFEVMATKTKIYFVMELLVRGGELFSRVSKGRLKEDIARRYFQHLISAVGFCHTRGVFHRDLKPENLLVDEAGNLKVSDFGLSAVAEPFQPEGLLHTFCGTPAYVAPEVLARRGYEGAKADIWSCGVILFVLMAGYLPFHDQNLMAMYRKVYKGEFRCPRWFSKDLTSLIMRFLDTNPSTRITLPEVMESRWFKKGFRPVKFYIEDDQLYNVIDAENDMLDLGLPDPLPQPLPPPPPSPSPQQVDGDDSGSESDASVVSCPATSSFEERHRLRGPLPRPASLNAFDIISFSRGFNLSGLFEEKGDEVRFISGEPMPDIITKLEEIANVKSFAVRKKDWRVSLEGTREGVKGPLTICAEIFELTPSLVVVEVKKKAGDKEEYDDFCNKELKPGMQHLVHQMVPVPNTPTISELAERPSR

SEQ ID NO: 4156 - protein, 377 aa, Triticum aestivum
  misc_feature (42)..(43): Xaa can be any naturally occurring amino acid
MDTSGGGDDAAGGAAQIQGTATHGGRYVLNNVYGNLSEAASXXAPPIRPIGRGAYGIVCAAVSSDTGEEVAIKKIGNAFDNHIDAKRTLREIKLLRHMDHENILAIKDLIRPPRRDDFKDVYIVTELMDTDLHQIIRSNQSLTDDHCQYFLYQLLRGLKYVHSANVLHRDLKPSNLFLNANCDLKIADFGLARTTSETDLMTEYVVTRWYRAPELLLNCSQYTAAIDVWSVGCILGEIITRQPLFPGRDYIQQLKLITELIGSPDDSSLGFLRSDNARRYMKQLPQYPRQDFRLRFRNMSDGAVDLLERMLVFDPSRRITVDEALHHPYLASLHDINEEPTCPAPFSFDFEQPSFTEEHMKELIWRETLAFNPDPPY

SEQ ID NO: 4157 - protein, 177 aa, Triticum aestivum
MDSGSDSDGAPEELTAVQGVEKHEEISKVEKDSAVRATQEEKDRRKRWAQRKTSSKPNKKKPLKVEDKDTEVDEETHAMPGTLPKSVIEMLAAREKQTFSSDSEEENVNQKVQKKKKRLKTATTGPETILLKDVRSTEHIKKALEFLSRRKNQVPRSNAVLKNPNAMRLFNKHNFTS

SEQ ID NO: 4158 - protein, 168 aa, Triticum aestivum
MSKEEVLKIQTCVLKVNIHCDGCQKKVKKILHKIEGVYQSSIDPEQGKVTVSGMVDPDTIIKKLTKAGKPAELWGSKAGMANQFQKLQLDGGGKGQAKDAGGKGQSKDAGGAKGQKGGGGGGGAGGASKDAKMMMPPPTAQQLQQLQQQMQMKGMKLPQFMDGKMPFA

SEQ ID NO: 4159 - protein, 144 aa, Triticum aestivum
QICFYESGNLPEGTEVWIKRDDLSGMQLSGNKVRKLEFLLSDAVAQGADCVITVGGIQSNHCRATAVAAKYLNLDCYLILRTSKLLVDQDPGLVGNLLVERLLGAHIDLVSKEEYGKIGSVALADLLKKRLLEEGRKPYVIPVG

SEQ ID NO: 4160 - protein, 157 aa, Triticum aestivum
MAPLLAPPLLADLAAKAHSSSTAGRCSGSVRRWAAAGLAGAGRRDRHRRRRTWGRRGFRVSAVATEPRSPEGSAAEDYYAALGVMPDATPHQIKKAYYNCMKACHPDLSGNDPDVTNFCMFINEVYTGRTGPFRRAVYDEINGFTATATNPFLDDAP

SEQ ID NO: 4161 - protein, 69 aa, Triticum aestivum
  misc_feature (7)..(8): Xaa can be any naturally occurring amino acid
  misc_feature (17)..(17): Xaa can be any naturally occurring amino acid
  misc_feature (24)..(24): Xaa can be any naturally occurring amino acid
  misc_feature (31)..(31): Xaa can be any naturally occurring amino acid
  misc_feature (48)..(48): Xaa can be any naturally occurring amino acid
MRFAGWXXKIAVGGAAXGAAMELXMIHTGFXEKVTVLESEKRAWESSXEAQAMREALNPWHKRDEKEKK

SEQ ID NO: 4162 - protein, 251 aa, Triticum aestivum
TPQSYSYLPTHPPRPSLQPPEEQGEMSSGMGKVVCVTGASGYIASWLVKLLLHRGYTVLATVRDTADPKKTLHLQALDGAKDRLHLFKASLLEEGSFDAAVAGCDCVFHTASPFYHNVKDPKAELLDPAVNGTLNVLRSCKKASIKRVIITSSMAAVAYNGKPRTPDVVVDETWFSSAEVCEKNEQWYVLSKTLAEEAAWKFANDNGFEIVTINPAMVIGPLLQPTLNTSAEAILKFINGMSVCGFIINFL

SEQ ID NO: 4163 - protein, 241 aa, Triticum aestivum
MAAAAAMARRLLSPTTTSHSTTARLLVSRRLASAPCFPRAPAAAAKEMLRPAAVASSSAFFLRGAGGARGMARRPGGGDGYAPARGGDRAPTEMAPLFPGCDYEHWLIVMDKPGGEGASKHQMIDCYIHTLAKVLGSEEEAKRKIYNVSCERYFGFGCEIDEETSNKLEGIPGVLFVLPDSYVDPEHKDYGAELFVNGEIVQRSPERQRRVEPVPQRASDRPRYNDRTRYARRRENQQQQR

SEQ ID NO: 4164 - protein, 516 aa, Triticum aestivum
  misc_feature (13)..(13): Xaa can be any naturally occurring amino acid
PTRPKGAAETLKXNMALVLLPVCRNTITWIRSKTKIGAVVPFNDNINFHKVIAAGVAVGVALHAGAHLTCDFPLLLHASDAKYEPMKPFFGDKRPPNYWWFVKGTAGWTGIVMVVLMSIAFVLAQPWFRRNKLKDTNPLKKMTGFNAFWFTHHLFAIVYALLIVHGTSLYLTKEWYKKTTWMYIAYPVFLYSCERIVRLFRRHDSVKIQKVAVYPGNVLALYMSKPPGFKYRSGQYIFINCGAVSPYEWHPFSVTSAPGDNYLSVHIRTRGDWTSRLRTVFSEACRPPTEGESGLLRADLSVGITDSNARFPKLMIDGPYGAPAQDYREYDVLLLIGLGIGATPLISIVKDVLNHIQRGESVGGTEPDGSGKAKKKPFMTKRAYSYWVTREEGSFEWFRGVMNEVAEKDKDGVIELHNHCSSVYQEGDARSALIVMLQELNHAKKGVDILSGTSVKTHFARPNWRSVFKRIAVNHENQRVGVFYCGEPVLVAQLRQLSADFTHNTNTKFDFHKENF

SEQ ID NO: 4165 - protein, 239 aa, Triticum aestivum
  misc_feature (13)..(13): Xaa can be any naturally occurring amino acid
  misc_feature (174)..(174): Xaa can be any naturally occurring amino acid
  misc_feature (196)..(198): Xaa can be any naturally occurring amino acid
  misc_feature (205)..(205): Xaa can be any naturally occurring amino acid
PTRPKGAAETLKXNMALVLLPVCRNTITWIRSKTKIGAVVPFNDNINFHKVIAAGVAVGVALHAGAHLTCDFPLLLHASDAKYEPMKPFFGDKRPPNYWWFVKGTAGWTGIVMVVLMSIAFVLAQPWFRRNKLKDTNPLKKMTGFNAFWFTHHLFAIVYALLIVHGTSLYLTKXWYKKSTWMYIAYPVFLYSCERXXXRLFRSHXAVKIQKFAVYPGHVLALYMSKPTGFRYRSGQYIF

SEQ ID NO: 4166 - protein, 308 aa, Triticum aestivum
  misc_feature (201)..(201): Xaa can be any naturally occurring amino acid
  misc_feature (273)..(273): Xaa can be any naturally occurring amino acid
MAKDIEAAPPGGGYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGYSTGTGLAAEIIGTFVLVYTVFSATDPKRSARXDSHVPVLAPLPIGFAVFMVHLATIPITGTGINPARSLGAAVIYNNEKAWDDHWIFWVGPFIGAAIAALYHQXYVLRASATKFGSSASFRQPLDRPAAVSVMVGGTEL

SEQ ID NO: 4167 - protein, 438 aa, Triticum aestivum
  misc_feature (191)..(191): Xaa can be any naturally occurring amino acid
MPRRRWAPPSCPSLASGGSEGRLSLLPVVGEGCVNFTTIYIFQVPSAITTFPSTAQIVPEPLGVVLVISAWNYPFLLSIEPVIGAIAAGNAVVLKPSEIAPATSSLFAKLLPEYVDSSCIKVVEGGVTETGALLEQKWDRVLLYTGNGNVARVVLAAAAKHLTPVALELGGKCPVIVDSNVVLHVAAKRIXVGKWGCNNGQACIAPDYIITTKAFVTELVDSLKRVLERFYGEDPLQSADLSRIVSITHFKRLTKLIEDKEVATKIQLGGQTDQEQLKIAPTVLVDVPLDTALMTGEIFGPCFPIITVDKIEESIAHINAGAKPLAAYLFTKDKKLQQDFVSNVSAGGMLVNDVALHLTNPHLPFGGVGDSGTGSYHGKFSFDCFTHRKAVLIRGFGGEANARYPPYTAEKQRILRGLIKGSFFALILALLGFPREKR

SEQ ID NO: 4168 - protein, 131 aa, Triticum aestivum
MSYYDRRGESSVLEAFTLSPLPYPVILILMMVTLLLGASWFFSYEEFMEEASEQFSWFLLGVPIALVLLIRWISSVDTFEGYFGFYPTESRWRGYPAAPSEGSSPWGVAMVVVLLLVLASFHSTFQDMWKA

SEQ ID NO: 4169 - protein, 288 aa, Triticum aestivum
  misc_feature (207)..(207): Xaa can be any naturally occurring amino acid
  misc_feature (229)..(229): Xaa can be any naturally occurring amino acid
MAKDIEAAPQGGEFSTKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATDPKRNARDSHIPVLXAPLPIGFAVFMVHLATIPITGXTGINPARSLGAAVIYNKDKAWDDQWIFWVGPLIGAAIAAAYHQYVLRASAAKLGSYRSN

SEQ ID NO: 4170 - protein, 164 aa, Triticum aestivum
MGGEWWRKKWVAWAAAAAIFVVLMLVTPAIPQDEDYHDFADQRVLFLGIPNTLNVISNIPFLFVGLAGLILCHYKNYFRLCSQGELWSWTLFYAGVTAVGVGSSYYHLYPNDATLVWDRLPMTIAFTSIVAIFIIERVDDRAGTKSLAPLVIAGALSILYLEVL

SEQ ID NO: 4171 - protein, 565 aa, Triticum aestivum
  misc_feature (174)..(174): Xaa can be any naturally occurring amino acid
  misc_feature (392)..(392): Xaa can be any naturally occurring amino acid
MLSRFAARRPRPGSARAAAYRSSAAASSSVLPDALVRSSDAYARNAAAVGGLLSDLRSRVSQVLGGGGAGAVKRNEGRGKLLPRDRIDRLLVPGASFLELSQLAGSDVYEEALPSGGIITGIGSVHGRKCLCRARHPTTKEGTYYPTARLWDVRIIDPADTRRVLCIYLSASAXAILPKQAEVFPDRDNFGRIFYNQAKMSADGIPQIAVVLGSCTAGGAYIPAMADESIIVKGNGTIFLAGPPLVKAATGEEISAEDLGGASVHCKVSGVSDHFAQDERHGLALGRNIVKNLHLAAKETSIHNSACDYQEPLYDVQELRSIAPADTKQSFDIRSIIARIVDGSEFDEFKKLYGTTLVTGFARICGQPVGIIGNNGILFTESSLKGPHFIEXCAQRNIPLIFLQNISGFMVGSKSEASGIAKAGAKMVMAVSCSKVPKITIIVGGSFGAGNYGMCGRAYSPNFLFMWPTARISVMGGIQAAGVLAQIEKNNRKRQGVEWTKDDEEAFKAKVVEAYDKEGSPYYSTARLWDDGIIDPADTRRVLSLCLSASAKPVPEDTKYGVFRM

SEQ ID NO: 4172 - protein, 167 aa, Triticum aestivum
MAAGRGLPLLLVIAALLVGLASASPFISDGVFQASAGSTTGRTLLQAKRDCPVNFEFQNYTVITSRCKGPKYPPKDCCDSFKEFACPFNNYINDESNDCASTMFSYINLHGKYPPGLFAHECREGKLGLSCEGVPQKDVVKSGVQRARSSSLALITLMCGLVALFFQ

SEQ ID NO: 4173 - protein, 498 aa, Triticum aestivum
MGQRLLLLVTTCLWALSCAVPHHASSRDGLLRINLNKKSLTHESLAAAKAARQHDALRLKSGNSDSDIVPLVDYLNTQYYGVIGLGTPPQNFTVIFDTGSSNLWVPSAKCYFSIACYLHPKYKSSKSSTYKADGETCKITYGSGAISGFFSNDNVLVGDLVVKNQKFIETTRETSFSFIVGKFDGILGLGYPDISVGKAPPVWLSMQDQKLLADDVFSFWLNRDSDALSGGELVFGGMDPDHYKGNHTYVPVSRKGYWQFNMGDLLIDGHSTGFCTKGCAAIVDSGTSLLAGPTAIVAQVNHAIGAEGIISTECKEVVSQYGEMILELLIAQTQPQKVCSQIGLCLFDGTHSVSNGIESVVGKENVGSDVMCTACEMAVVWIENQLRENKTKELILQYANQLCERLPSPNGESTVSCHEMSKMPNLAFTIANKTFVLTPEQYVVKLEQSGQTVCISGFMAFDIPPPRGPLWILGDVFMGAYHTVFDFGKDRIGFAESA

SEQ ID NO: 4174 - protein, 153 aa, Triticum aestivum
  misc_feature (82)..(82): Xaa can be any naturally occurring amino acid
MDASAAGAISKAKKYVVGRKLGGGPRKKAVARSVKAGLQFPVGRIGRFLKKGRYAQRVGMGAPVLAWSRPRYLAAELLELAXNAAKDNKKSRIIPRHLLLAIRNDQELGKLLAGVTIAHGGVLPNINPVLLPKKTAEKEPKSPKKAAKSPKKA

SEQ ID NO: 4175 - protein, 218 aa, Triticum aestivum
MAPRVPSSLLLVGAALLLGLAAGAARASNEEGDALYALRMRLSDPNGVLQSWDPTLVNPCTWFHVTCDSASRVVRLDLGNSNVSGSIGPELSRLVNLQYLELYRNNLNGEIPKELGKLKNLISLDLYANKLTGRIPKSLSKLSSLRFMRLNNNKLAGSIPRELAKLSNLKVIDLSNNDLCGTIPVDGPFSSFPLRSFENNSRLNGPELQGLVSYDFGC

SEQ ID NO: 4176 - protein, 283 aa, Triticum aestivum
  misc_feature (70)..(70): Xaa can be any naturally occurring amino acid
MFLSRIVLRDLDSIDSPASMATSKKVVTRDEWERKLRDVKIRKEDMNRLVMNFLVTEGFVDAADKFRVEXSGTQPDIDLATITDRMEVKKAVQSGNVQEAIEKINDLNPTILDTNPELYFHLQQQKLIELIRMGKINEALEFAQEELAPRGEENQAFLEEIEKTVALLVFEDVKNCPYGELLDVSQRLKTASEVNAAILTSQSHEKDPKLPSLLKMLIWTQNQLNEKAAYPRINNLSTAALEDPSYMSCCAQSVRVLSTELRHQQPCLHVHSVVGLLFVSSVF

SEQ ID NO: 4177 - protein, 290 aa, Triticum aestivum
  misc_feature (164)..(164): Xaa can be any naturally occurring amino acid
  misc_feature (220)..(220): Xaa can be any naturally occurring amino acid
DKAELHRGGGRSRTSGSPGLQEFARDHYLEHPNRKLLVSRTLSPRPPYLQAGRARSRSVRPRVLRRRRRPPAPEEMPRYDDRYGNARLYVGRLSSRTRSRDLEYLFSKYGRIREVELKRDYAFIVCKFYSPQPYLCSFKLLAYLRPILFMYEVHCLFCLFLSIXQEYSDPRDADEARYNLDGRDVDGSRIIVEFAKGVPRGSGGSREREYVGRGPPPRNXGRCFNCGIDGHWARDCKAGDWKNKCYRCGERGHIERNCQNSPRSLRRERSYSRSPSPRRGRARSRSYSTS

SEQ ID NO: 4178 - protein, 144 aa, Triticum aestivum
MRVSSMASKGLVVFAVLLAAAFLVATAEQTQAKKEETKAGVQGYHGGGSGGGGYHGGGGGGGGYPGHGGGGGGYPGHGGGGGGGGYPGHGGGGGGGGYPGHGGGGGGGGSGCRYQCCGHGHSGCRCCASPNEIPEPMYRAEVRN

SEQ ID NO: 4179 - protein, 515 aa, Triticum aestivum
  misc_feature (116)..(116): Xaa can be any naturally occurring amino acid
  misc_feature (152)..(152): Xaa can be any naturally occurring amino acid
  misc_feature (323)..(323): Xaa can be any naturally occurring amino acid
  misc_feature (424)..(424): Xaa can be any naturally occurring amino acid
  misc_feature (496)..(496): Xaa can be any naturally occurring amino acid
PSPSPLQSSDHRAQTHPDSNPYPATPTTPQSRRAYSTPWRRRGASSPPGGRLWRRKERCEGAGRNVPAGHPRKVPAPPRRRATTPPFKHPPATGTYLILASHVGPPTGLIPTSSLXPPVPRLSELLGREVVIAPDCIGGEADKMAAALPDGXLTTTWMNVRCYKGQLKTDTEIAKTLVPVARLFVNEAFGTELMALGSSIAHTNLPRLSATVVVLLQKTGCSLGAFANWRMGYDALLCAFVLVKVEIEEVYVKALFEFPLITDAECGAVPDLLNPSFAGYVSQNEVEYLEGVVSNPKRPFAATVGRGSLKCQLGCMVCRCLQXNISRFGGGRTFPFCNGRRLVVGSALVVEENLELATSLLAMAKIKAISLMLGADVIGGDKFAPDANGQTVPASAFPGGWMGVDIGPVSVRTLNDALETTQTXIWNGPGGFFEFDKFPVGTESIAKKLAELSKKGVTTIIGGGDSVAAVEKVGVADVMSHFSSGGGACLELLEGXELTGVVALDEGVMTRSVTV

SEQ ID NO: 4180 - protein, 151 aa, Triticum aestivum
MAQLMDKAKGFVAEKISGVQKPEADLSDLSVQHVGRDGATLSGRLDVRNPYSHTIPICEISYSLKSAGRDVASGTMPDPGSLVASDTTSLDIPVKVPYDFLMSLVKDAGKDWDLDYEMRVGLTVDLPIVGNFTLPLTKAGELKLPTLSDLF

SEQ ID NO: 4181 - protein, 151 aa, Triticum aestivum
  misc_feature (129)..(129): Xaa can be any naturally occurring amino acid
MAQLMDKAKGFVAEKISGVQKPEADLSDLSVQHVGRDGATLSGRLDVRNPYSHTIPICEISYSLKSAGRDVASGTMPDPGSLVASDTTSLDIPVKVPYDFLMSLVKDAGKDWDLDYEMRVGLTVDLPIXGNFTLPLTKAGELKLPTLSDLF

SEQ ID NO: 4182 - protein, 443 aa, Triticum aestivum
MDPQTFVRLSVGQLGLRLPGASARKAFHCEIRLRGFPVQLAPVPLENSSEFHLDPHANAAVFSLDEPGLKALPTSRWFRTPEPPYLEIAVYVSRRDGGGHCVGLKRRLVGAVRVDVGPEWRDGKPVLLRHSWTGIGRAAELHVRVRVEADPRYVFRFEDEVALNPQVVQLHGGASQPIFSCKFIRDVRRASQPDHLGGKYWSSSGSGEEKETEMAGRRRERKGWKVAIHDLSGSAVAAAFMATPFVPATGSDTVARSNPGAWLIVRADTTGSSESWQPWGRLEAWRECAAPAGGKDAVCLRLHLLPERRDACVLVSETPLSCDKGGEFSIDMDRQSILPEDAVASETTSSSYCAASMGQSCAGGGFVMSCSVQGEAATSSRPPLVHLAARHVMCMEDAAMFLALAAAVDLSVKACRPFRSKTAAAKKKTAAGSSSPDSLELDT

SEQ ID NO: 4183 - protein, 346 aa, Triticum aestivum
MYLLPGRSRTESNRIESNDPTTKVSKLGFGCMGLTGSYNSPVEDDAGVAVITHAFNRGVTFFDTSDVYGPHANEILLGKALKQLPREQVQVATKFGIQRDAQGKSTICGRPEYVRACCEASLHRLGVHHIDLYYQHRIDTTIPIEDTIGELKKLVEEGKVKYIGLSEASPDTIRRAHAVHPISSVQMEWSLWARDIEPEIVPLCRELGIGIVPYSPIARGFFGGRGVTQQVSAESSLKGHPRFSAENLEKNKQLYLKIEELAKKHQCSPAQLALSWVLHQGDDVVPIPGTTKIKNLDSNIDSLKVRLTEDDLKEISNEIREEDVAGGRQYTSFAKFTWNYADTPKK

SEQ ID NO: 4184 - protein, 703 aa, Triticum aestivum
  misc_feature (161)..(161): Xaa can be any naturally occurring amino acid
MDSAAAGMRDSALDLLAALLTGRAPPAAADGDQNRRLLALLATSLAVLVGCGVALLFRRSSSGAAPLAHKSAAAKPLAAKKDQEPDPDDGRQRVALFFGTQTGTAEGFAKALAEEAKARYDKAVFKVLDLDDYAAEDEEYEEKLKKENIAFFFLEWHLQEXHVTCSLVHGQTPTGRIHKGVCSTWMKNSTPSEESKECSWAPIFVRQSNFKLPADPTVPIIMVGPGTGLAPFRGFLQERLALKETGVELGRAILFFGCRNRQMDFIYEDELNNFAESGALSELVVAFSREGPTKEYVQHKMAEKAAELWSIVSQGGYVYVCGDAKGMARDVHRALHTIVQQQGSYAENSIETVEEAEKLLDYSPDTYFSIYADQEDGTPLFGGSLPPPFPSPCTVRVALARYADLLNSPKKSVLLALAAHASDPKEAERLRHLASPAGKKEYSQWIIASQRSLLEVISEFPSAKPPLGVFFAAIAPRLQPRYYSISSSPRMAPTRIHVTCSLVHGQTPTGRIHKGVCSTWMKNSTPSEESQECSWAPIFVRQSNFKLPADPTVPIIMVGPGTGLAPFRGFLQERLALKETGVELGRAILFFGCRNRQMDFIYEDELNNFAESGALSELVVAFSREGPTKEYVQHKMAEKAAELWSIVSQGGYVYVCGDAKGMARDVHRALHTIVQEQGSLDSSKAEGYVKNLQMEGRYLRDVW

SEQ ID NO: 4185 - protein, 216 aa, Triticum aestivum
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVDDAKAFAERESTFFMETSALEAMNVENAFTEVLTQIYRVVSKKALDIGDDPAAPPRGQTINVGGKDDVSAVKKAGCCSS

SEQ ID NO: 4186 - protein, 307 aa, Triticum aestivum
ADFVTGPLLGRTRIYPLPTLSLWTRENLVLVPLPPPVAVAAGPNQTLAAGRRQAMDRKRINDALDRHLRAATERSSPSTSRGAKPKPPPAAAPKPKEQLDSDSSEGGSAGGSSEADDTFWINWFCAMRGNEFFAEVDDDYIQDDFNLCGLSAQVPYYDHALDLILDLEPVQGDVFADDQNELIVASAEMLYGLIHARYILTTKGLAAMLEKFKNCDFGRCPRVSCSGQPCLPMGQSDIPRSSTVKIYCPKCEDLYYPRSKHQANTDGAYFGTTFPHIFMMTHSQLKPQKPAQQYVPRIFGFKVHKKT

SEQ ID NO: 4187 - protein, 678 aa, Triticum aestivum
NDDCTRHVVRALLRKCGYEVISAENGLHAWQYLEDVQNRIDLVLTEVAMPCLSGIGLLSKITSHSICKGIPVIMMSKNDSMSTVFRCLSKGAVDFLVKPIRKNELKTLWQHIWRRCHSSSGSESGIHTQKCSKPKAGDEYENNSHDDDDDCGSHDDDDDDDDDADDDFSVGPNARDGSDNGSGTQSSWTKRAVEIDSPQLLSSDHLAESPDSTCAQVIHPRSEIGSNRWLPTANKRNINNQKENNDDSMGKYLEIGAPRNSSLGYQSSPNEMSVNPTEKQHENLTSQNKSVNKIVIDKPTCQTADLISSIARNTESKQAARITDAPDCSSKMPNGNEMKNDSPINMPSQELGLKISETTRCETEIHDERSIPKRSNLSAFTRYHTPMASDQGGATFRGSCSPQDNSSEAVKTNSTCKMESNSDAAQIKQGSNGSSNNNDMGSSTKNAIAKPCTDRERVMSPSLVKSNQQTSAFHPVQHQVSPADAARKDKASEEIVNAVKVGHSSEAQQSSVQHHHHAHYYRHVIAQQQTLIDRASNARCGSSNASDLPLEGHAANYGVNGSISGSNNGSNTQNASSSAPNIARPNMDSGAMDKTEAGGGNGSGSGPSGSGNDMVCQNQLSQREAAVNKFRQKRKERNFGKKVRYQSRKRLAEQRPRVRGQFVRQSGQEDEAGQAEDR

SEQ ID NO: 4188 - protein, 452 aa, Triticum aestivum
  misc_feature (419)..(419): Xaa can be any naturally occurring amino acid
  misc_feature (426)..(426): Xaa can be any naturally occurring amino acid
NDDCTRHVVRALLRKCGYEVISAENGLHAWQYLEDVQNRIDLVLTEVAMPCLSGIGLLSKITSHSICKGIPVIMMSKNDSMSTVFRCLSKGAVDFLVKPIRKNELKTLWQHIWRRCHSSSGSESGIHTQKCSKPKAGVVPENNSHDDDDDCGSHDDDDDDDDDADDDFSVGPNARDGSDNGSGTQSSWTKRAVEIDSPQLLSSDHLAESPDSTCAQVIHPRSEIGSNRWLPTANKRNINNQKENNDDSMGKYLEIGAPRNSSLGYQSSPNEMSVNPTEKQHENLTSQNKSVNKIVIDKPTCQTADLISSIARNTESKQAARITDAPDCSSKMPNGNEMKNDSPINMPSQELGLKISETTRCETEIHDERSIPKRSNLSAFTRYHTPMASDQGGATFRGSCSPQDNSSEAVKTNSTLQMXVNSDAAXIKQGSNGSSQPVAKVSLISVYIYLYT

SEQ ID NO: 4189 - protein, 386 aa, Triticum aestivum
MAKPISIEVWNPSGKYRVVSTKSMPGTRWIKLLTDKDCRLEICTEKKTILSVDDILALIGDHCHGVIGQLTEDWGEVLFSALKRAGGTAFSNMAVGYNNVDVDAANRNGIAIGNTPGVLTETTAELAASLSVAAARRIVEADQFMRAGLYDGWLPHLFVGNLLKGQTVGVIGAGRIGSAYARMMIEGFKMNLIYFDLYQSTRLEKFVTAYGQFLKANGEQPVTWKRASSMEEVLREADVISLHPVLDKTTYHLINPERLAMMKKEAVLVNASRGPVIDEVALVEHLRANPMFRVGLDVFEDEPYMKPGLAEMKNAVVVPHIASASKWTREGMATLAALNVLGKIKGYPVWGNPNAVEPFLDEKAAPPPACPSIVNAKQLGLPSSKL

SEQ ID NO: 4190 - protein, 249 aa, Triticum aestivum
IVEADQFMRAGLYDGWLPHLFVGNLLKGQTVGVIGAGRIGSAYARMMIEGFKMNLIYFDLYQSTRLEKFVTAYGQFLKANGEQPVTWKRASSMEEVLREADVISLHPVLDKTTYHLINPERLAMMKKEAVLVNASRGPVIDEVALVEHLRANPMFRVGLDVFEDEPYMKPGLAEMKNAVVVPHIASASKWTREGMATLAALNVLGKIKGYPVWGNPNAVEPFLDEKAAPPPACPSIVNAKQLGLPSSKL

SEQ ID NO: 4191 - protein, 527 aa, Triticum aestivum
MHSTNLLLEEPIRMVSILEPSKPNFFPAMTKIVGTLGPKSRSVEAISACLKAGMSVARFDFSWGDAAYHQETLENLKLAIKATKKLCAVMLDTVGPELQVVNKSEVTISLEENESVVLTPHQGQEASSKLLPINFAGLAKAVKPGATIFVGQYLFTGSETTSVWLEVSEVQGDDVVCVIKNSATLAGSLFTLHCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPTMPVLSVVIPRLKTNQLKWSFTGAFEARQSLIVRGLFPMLADPRHPAESTSTTNESVLKVALDHGKASGVIKSHDRVVVCQKVGDSSVVKIIELDD

SEQ ID NO: 4192 - protein, 376 aa, Triticum aestivum
  misc_feature (272)..(272): Xaa can be any naturally occurring amino acid
MELATRDLAALGAADLVRVSAAIPRAAPRTFALLTACLVFPLSFAVLAHSLFTHPILRRIRTSDYTATSAQWVALFAYQFLYLIFLFTFSLLSTAAAVFTVASLYAAKPASIASSLSALPPILPRLLRTFLWVSLLMLAYHVGFVVTVVLLILLFDPPMTASTPPPLSFLLALLAVAFLFLAIHVYISALWHLASVISVLEPLCGLAAMSKSRQLLQGRTRTARRPSSSSPSTSTSPRSGTSPASSPCSSPSAASPPCPRAGSSFRAALAPXAVLVFSYFAICGLITGMFRSAVVKARGEEGSLDMSLAGRIGVGALLVSVLVCVNLLGLLAQSVFYYACKAYHNQEIDRTALYEHLGGYLGEYVPLKSNIQMENL

SEQ ID NO: 4193 - protein, 239 aa, Triticum aestivum
QHILMYEYMSNGNLATLLYGDNKRSLSWQERLQIAHDVSHGIEYLHEGAVPPVIHRDLKSANILLDESMRAKVADFGLSKEEVFDGSKSGLKGTYGYMDPDYMSTNKFTKKSDVYSFGIILFELITAINPQQGLMEYIDLAAIGGEGKVDWDEILDKNLLGGSIPEEARVLADVAYRCINRSPRKRPWISEVTQAISRLRQRQMTLPWSETRTVLRRIEYQHVELSDLAGMKELTPVGA

SEQ ID NO: 4194 - protein, 175 aa, Triticum aestivum
  misc_feature (8)..(8): Xaa can be any naturally occurring amino acid
MAPAVMAXSSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4195 - protein, 191 aa, Triticum aestivum
FSASPPCSPLARASPRRICRTLKPHADTAPLRPHAPHPGHLLPPTAAGGAMEVGGEEFAVGVVISAKTTLGEEFEGQIVSFDRPSNLLVIQEGVGRAERGERRNVRVLKANYIQEFSVVGKYDDPLDPAGCVLDLAAIHAREEAALRCGQDSFNELGKHEHHNIVLDIYCKEFMFEDTIKQEEVYKSFILI

SEQ ID NO: 4196 - protein, 337 aa, Triticum aestivum
MAPLGDAVTPAAAAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAAMRAAKSAGILCSYDPNVRLPLWPSAQAARDGIMSIWKEADFIKVSDEEVAFLTQGDATDEKNVLSLWFEGLKLLFLTDGEKGCRYFTKDFKGSVPGYSVNTVDTTGAGDAFVGSLLVSVSKDDSIFCNEAKLREVLQFSNACGAICTTKKGAIPALPTTATALELISKGSN

SEQ ID NO: 4197 - protein, 530 aa, Triticum aestivum
MQGGNHMLLEEPVRLASVLAPAKPKVFPSLTKIVGTLGPNSHSVEVIEECLTAGMSVARFDFSWKDATYHQETLDNLRKAAQNVKKLCPIMLDTVGPEIQVHNSTGGAIELIGGNHVTITPDLSKAPSADILPIKFGDLAKVVKKGDTLFIGQYLFTGSETTSLWLEVTETSGAEVICYVKNTATLSGPIFTLHVSQVHISMPTLSEYDKQVISTWGLQNSVDIISLSHTRSSEDVRELRAFLKSHDLQDTQIYAKVENAEGLEHFDEILQEADGIIISRGDLGIDLPPERVFMSQKTGIHKCNMAGKPVIITRVVDSMIDNLRPTRAEATDVANAVLDGTDGILLGAETLRGQYPVDAVRTVGRICAEAETVYNQSLHFKKVVRHVGEPMVHEESVASSAVRSAMKVKAAAIVVFTFSGRAARLIAKYRAPMPVLAVVFPREGSDPSKWRSYGTTQARQCFSVRGVYPLMGSTDDAETGGLTKEEYGIKLALNYGRSVGIIKPYDRVIIFEKIGDSSVVKIIECDDSER

SEQ ID NO: 4198 - protein, 147 aa, Triticum aestivum
MAGRKGGDRKKAVTRSVKAGLQFPVGRIGRYLKKGRYAQRVGSGAPVYLAAVLEYLAAEMLELAGNAAKDNKKTRIIPRHLLLAVRNDQELGRLLAGVTIAHGGVIPNINSVLLPKKSPAAAEKEATKSPKKKTSTKSPKKKVAAKE

SEQ ID NO: 4199 - protein, 390 aa, Triticum aestivum
  misc_feature (196)..(196): Xaa can be any naturally occurring amino acid
  misc_feature (204)..(204): Xaa can be any naturally occurring amino acid
MASAALLKSSFLPKKAEWGTTRQAAAPKPVTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAXWGLARYAXAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAEASENMFVKNYSY

SEQ ID NO: 4200 - protein, 388 aa, Triticum aestivum
MASATLLKSSFLPKKAEWGATRQAAAPKPVTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAEASENMFVKNYSY

SEQ ID NO: 4201 - protein, 166 aa, Triticum aestivum
VYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 4202 - protein, 463 aa, Triticum aestivum
  misc_feature (364)..(364): Xaa can be any naturally occurring amino acid
MAASVREGAAAAAAAGHAVDDYDVSDGEMDVDVDVEAGSELQHAGGAGDDGRRDGDGDDEYALLTRITDTSAAEARAGKDIQGIPWERLQITRQDYRKARLEQYKNYENFPQSGELMDKLCKQVESSSKYYEFQYNTRIVKPSILHFQLRNLLWATSKHDVYFMSNSTVGHWSSLSHKMTDVLDFSGHVAPAKKHPGCALEGFTGVQVSTLAVNEGLLVAGGFQGELVCKSLGERDVKFCTRTTLSDNAITNAMDIHRSTSGSLRITVSNNDSGVREFDMERFQLLNHFRFNWPVNHTSVSPDKKLLAVVGDDRDALLVDSRNGKVTSTLVGHLDYSFASAWHPDGVTFATGNQDKTCRVWDIXRNPSTSLAVLRGNIGAIRCIRYSSDGRFLLFSEPADFVHVYSAAECYRKRQEIDFFGEISGISLSPDDESLFVGVCDRVYASLLNYRMVHANGYLDSYM

SEQ ID NO: 4203 - protein, 209 aa, Triticum aestivum
MATAAAAGAGGVAAGVAGSPCGACKFLRRRCVAECVFAPYFSSDQGAARFAAIHKVFGASNAAKLLAHLPLADRCEAVVTITYEAQSRLRDPVYGCVAQIFALQQQVAILQAQLMQARAQIACGVQSTASPVSHQWPDSSSSSIASLLRQQEVNSGSFATGGALLPELMGGDVSMLQQHCGGKVEGGGGGAGDLQYLAQAMMRSSNYSL

SEQ ID NO: 4204 - protein, 146 aa, Triticum aestivum
MQGEVEQQAPMQMVLRVKHPSSLSSGSEEASEGEGSSRSALSVFKAKEEQIERKKMEVRDKVFAQLGRVEEESKRLAFIRQELEGMADPTRKEVESIQRRIDTVNRQLKPLSKSCVKKEKEYKEILEAYNEKSKEKAILVNRLIDW

SEQ ID NO: 4205 - protein, 190 aa, Triticum aestivum
MGSGNLVMKKVVKPSSFDLDIQLDKSWTEDVTCPICLDFPHNAVLLRCTSYEKGCRPFVCDTDKSRSNCLERFKSAHGQPVNVKVSAVNIAPRDSIHFISSNTNNHPACPLCRGDVIGWAVIGEARQHLNQKKRCCEESCCSYVGNFHELQKHTQQKHPNSRPSEIDPARRVDWEDFQQSSDIIDVLSTI

SEQ ID NO: 4206 - protein, 139 aa, Triticum aestivum
  misc_feature (132)..(132): Xaa can be any naturally occurring amino acid
MALLKAARVADVPSLDVVVPDHLAAAARVLDAESAAAMKRQQRGAGRRFAVIGHRGKGMNALASPDRRLQEVKENSIRSFNEAARFAVDYVEFDVQVTKDVCPVIFHDNFIVTEEHVSSHVPSCSVRVSQDXLQYGPQN

SEQ ID NO: 4207 - protein, 284 aa, Triticum aestivum
MAKEVSEEPEHAAPAHKDYSDPPPAPLFDMGELRMWSFYRAIIAEFVATLLFLYITVATVIGYKVQSAADPCGGVGVLGIAWAFGGMIFVLVYCTAGISGGHINPAVTFGLLLARKVSLLRAVMYIVAQCAGGIVGAGIVKGIMKDAYQANGGGANMVASGFSRGTALGAEIVGTFVLVYTVFSATDPKRSARDSHVPVLAPLPIGFAVFMVHLATIPITGTGINPARSLGAAVIYNKKAAWDNHWIFWVGPFVGALAAAAYHQYILRAAAIKALGSFRSSRSN

SEQ ID NO: 4208 - protein, 386 aa, Triticum aestivum
  misc_feature (81)..(81): Xaa can be any naturally occurring amino acid
MAAAASSSSPPAVITCRAAVAWGPGQALVMEDVEVAPPGPLEIRVKVVSTSICRSDVAEWQSTAQPDLFPRIFGHEASGPXVVESVGEGVTEFQVGDHALTVFIGECMSCKHCVSGKSNMCQTLGLERKGVMHSDQTTRFSIGGKPVYHYCAVSSFSEYAVVHSGCAVKVSPTMPMDRICLLSCGASAGLGAAWNVADVSKGSSVVIFGLGTVGLSVAQGAKLRGASKIIGVDTNPAKQEKGKAFGVTDFINPAELNEPVQQVVKRLTDGGADYSFECVGDTGVVSTALQSCSDGWGLTVTLGVPKAKPEVSAHYGLLLSGRTLKGSLFGGWRPKTDIPLLVEKYANKEIQVDGLVTHDMPFSDINKALELMLQNRCLRCVIHMPK

SEQ ID NO: 4209 - protein, 315 aa, Triticum aestivum
  misc_feature (221)..(221): Xaa can be any naturally occurring amino acid
MLPWIFSRKGASGFSWASTADQVTAGISAAGLTAIVTGASSGIGAETARVLAARGAHVVMAVRNLAAAEAVRQAVLAETPGGSVEVMELDLSSLASVRNFAADFAATGLPLNILVNNAGVMATPFSLSKDGIEMQFATNHVGHFLLTNLLLETMKKTSRESNVEGRIVNVSSEGHRFAYKEGIRFAKLNDEEEYSTIAAYGQSKLANILHANELARRFKQXGVNITANSLHPGAIITNLLRHHSIIDVLHRTLGRLVLKNAKQGAATQCYVALHPDAKGVSGKYWSDSNLYEPSEKAKDAELGKKLWDYTLDLVA

SEQ ID NO: 4210 - protein, 167 aa, Triticum aestivum
HEVSPDGKLLAVLGDSSDCLIADSGSGKEIASLRGHADYSFASAWHPDGRVLATGNQDRTCRLWDVRNPSEAFAVLEGRIGAVRGLRFSPDGRFLAAAEPADFVRVYDVAAGYARAQEIDLFGEIAGVSFSPDDGAEALFVGVADRTYGSLLEFRRRHRHAYLDCYL

SEQ ID NO: 4211 - protein, 384 aa, Triticum aestivum
MVESRAAAVQELRARFAAGQTRPAEWRAAQLRGVLRMATEMEAEICDALHADLGKPKTEAHVHELSLIKSSCLFALKNLKKWMKPQKVPAKLMNFPSTARITPEPLGLVLQTTYLPIISVLSLDPVIGAIAAGNAVALKPSEGAPAMSSLLAELLPRFVDGTCIKVIEGGVKETTALLNQKWDKIFYTGNSRVGRVVMAAAAKHLTPAVLELGGKCPVVVDSNVDLHIAAKRIAAGKWGCNNGQACIAPDFIITTQAFAPKLLESLKNVMGKYYGKDPILSEHTPRPGDALRRSRVTGMTDGETVTGDFPVGRKRQERHLNIAPTTLLACRPRSCKLQGRKARPLKPELLGPHVRSQRRPLQRCCQAYATVILHTGAQAPEADT

SEQ ID NO: 4212 - protein, 479 aa, Triticum aestivum
MVESPAAAVQELRERFAAGQTRPAEWRAAQLRGVLRMATEMEAEICDALHADLGKPKTEAHVHELSLIKSSCLFALKNLKKWMKPQKVPAKLMNFPSTARITPEPLGLVLQTTYLPIISVLSLDPVIGAIAAGNAVALKPSEGAPAMSSLLAELLPRFVDGTCIKVIEGGVKETTALLNQKWDKIFYTGNSRVGRVVMAAAAKHLTPAVLELGGKCPVVVDSNVDLHIAAKRIAAGKWGCNNGQACIAPDFIITTQAFAPKLLESLKKVLEKFYGKDPLLSADLSRVVNASHFGRLKGLMDEEMVSDIVFGGQRDEQQLKIAPTIFLDVPLDSAIMKDEIFGPLLPILTVDKIHESFGLINSMAKPLAAYLFTRDSELQNQFEGAISAGGMLFNDTSIHLTNPYLPFGGVGESGTGAYHGKFSFDAFSHRKAVMNRGFAGEARARYPPYSAPKLKILKGVLEGKLGDMIQAILGFPRGK

SEQ ID NO: 4213 - protein, 220 aa, Triticum aestivum
  misc_feature (161)..(161): Xaa can be any naturally occurring amino acid
PVPDFPEILKPRFREWGPGALYWVEGYEKPRGPPPSRLYTYIAQPWAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMXKLPMFGCTDATQVINEVEEVKKEYPDAYVRIIGFDNMRQVQCVSFIAFKPPGCEESGKA

SEQ ID NO: 4214 - protein, 176 aa, Triticum aestivum
  misc_feature (124)..(124): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCXTDATQVINEVEEVKKEYPDAYVRIIGFDNMRQVQCVSFIAFKPPGCEESGKA

SEQ ID NO: 4215 - protein, 253 aa, Triticum aestivum
  misc_feature (158)..(158): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQXVSFIAFKPPGCEEVRQGPKQAHSRTGHILKVPLQLSTLTIAFGVFLSPFIFLNLGLMGPLFHPNIGEASYFMLGGFVYSPDIIIQYTLGKKKKKN

SEQ ID NO: 4216 - protein, 175 aa, Triticum aestivum
  misc_feature (165)..(165): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFXPPGCEESGKG

SEQ ID NO: 4217 - protein, 185 aa, Triticum aestivum
MAPTVMASSATSVAPFQGLKSTAGLPVSRRSNGASLGSVSNGGRIRCMQVWPIEGIKKFETLSYLPPLSREALLKQVDYLIRSKWVPCLEFSKVGFIFREHNASPGYYDGRYWTMWKLPMFGCTDATQVINEVEEVKKESPDAYVRIIGFHNMRQVQCVSFIAFNPPGCEESRQGLNSSLPTGHI

SEQ ID NO: 4218 - protein, 191 aa, Triticum aestivum
  misc_feature (107)..(107): Xaa can be any naturally occurring amino acid
  misc_feature (156)..(156): Xaa can be any naturally occurring amino acid
  misc_feature (162)..(162): Xaa can be any naturally occurring amino acid
  misc_feature (164)..(164): Xaa can be any naturally occurring amino acid
  misc_feature (176)..(176): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGXYYDGRYWTMWKLPMFGCTDATQVINEVEEVKKEYPDAYVRIIGFDNMRXVQCVSXIXFKPPGCEESGKXTGSHGPHIKPLRFQL

SEQ ID NO: 4219 - protein, 174 aa, Triticum aestivum
  misc_feature (173)..(173): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQVRQLHRFKPPGCEESXG

SEQ ID NO: 4220 - protein, 116 aa, Triticum aestivum
  misc_feature (29)..(29): Xaa can be any naturally occurring amino acid
  misc_feature (33)..(33): Xaa can be any naturally occurring amino acid
  misc_feature (35)..(37): Xaa can be any naturally occurring amino acid
  misc_feature (87)..(87): Xaa can be any naturally occurring amino acid
MAPTVMASSATSVAPFQGLKSTAGLPVSXRFSXRXXXSLGSVSNGGRIRCMQVWPIEGIKKFETLSYLPPLSTEGPLLKQGSTTPDXRSQWVPCLEFSKGGVHSSREHNAFSGYYD

SEQ ID NO: 4221 - protein, 161 aa, Triticum aestivum
  misc_feature (105)..(105): Xaa can be any naturally occurring amino acid
  misc_feature (123)..(123): Xaa can be any naturally occurring amino acid
  misc_feature (145)..(145): Xaa can be any naturally occurring amino acid
  misc_feature (152)..(152): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASXPGYYDGRYWTMWKLPMFXGCTDATQVINEVEEVKKGVPLXRTFRLLXSKTCARVQC

SEQ ID NO: 4222 - protein, 174 aa, Triticum aestivum
  misc_feature (39)..(39): Xaa can be any naturally occurring amino acid
  misc_feature (50)..(50): Xaa can be any naturally occurring amino acid
YTYIVHPWAPTVMASSATSVAPFQGLKSTAGLPVSRRSXGASLGSVSFCXRIRCMQVWGGEGIKKFETLSYLPPVSTEALLKQVDYLIRSKWVPCLEFSKVGFIFREHNASPGYYDGRYWTMWKLPMFGCTDATQVINEVEEVKKEYPDAFVRFIGFDNLRQVQGRRFLAFKPP

SEQ ID NO: 4223 - protein, 91 aa, Triticum aestivum
  misc_feature (9)..(9): Xaa can be any naturally occurring amino acid
  misc_feature (37)..(38): Xaa can be any naturally occurring amino acid
  misc_feature (71)..(71): Xaa can be any naturally occurring amino acid
  misc_feature (73)..(73): Xaa can be any naturally occurring amino acid
  misc_feature (86)..(86): Xaa can be any naturally occurring amino acid
  misc_feature (90)..(90): Xaa can be any naturally occurring amino acid
MAPTVMASXATSVAPFQGLKSTAGLPVSRRSNGASLXXVSNGGRIRCMQVWPIEGIKKFETLPYLPPLSTXAXLKQVDYLIRSKWXPCLXF

SEQ ID NO: 4224 - protein, 381 aa, Triticum aestivum
MTSLNQFDLLGDVDNDDPSQLLAAAAAAAAKKAQANKTEAAPAGKAAQTAAAAKLPTKSAPPAQAGRDARSGGPPSRGGFGRGEPGRGRGGGRYGQNRDFGSENTNGYQGGYGGVGSGDGAVAGGGDGERGPRPYRGGGGRRGGYRNGEFGDDSERPPRRNYERHSGTGRGQGMKRDGAGRGNWGSSTDEGLAQETDEALKIEDNAPIAEKQGEQDDAPPTTVENKDHKDGAAKEEEENEEDKEMTLEEFEKIREEQRKALLALKTEERKVEVDKDLQSLQPLSTKKANDEVFIKLGSDKEKKKESTERDERAKKSLSINEFLKPAEGERYYGGRGRGRGRGEGRGDRGGFRGGFGGGYQRGQAAAPSIEDRSQFPTLGGK

SEQ ID NO: 4225 - protein, 252 aa, Triticum aestivum
  misc_feature (75)..(75): Xaa can be any naturally occurring amino acid
ALHSTVQLPILSSRVPSLQPKQSTTQPPPEEHEEMGSGTGKVVCVTGGSGYIASWLVKFLLQRGYTVRATVRDTXDPKKTLHLQALDGAKDRLHLFKASLLEEGSFDAAVAGCDCVFHTASPFYHNVKDPKAELLDPAVDGTLNVLRSCKKASIKRVIVTSSMAAVAYNGKPRTPDVVVDETWFSSAEVCEKNKQWYVLSKTLAEEAAWKYANDNGLEIITINPTMVIGPLLQPTLNTSTEAILKFINGSQA

SEQ ID NO: 4226 - protein, 158 aa, Triticum aestivum
EIALVGTSSQGSSKIVKFEGARRLAFKHIEAFVLTFSDPQMFSTAASSSGAAALSQVAEALFIQEAGHLRCSRAEIARFVDTLRNPSSVLRACAAFALLQFTMPAGRHAAHHAALLQKAGASRVLRGAAAAATAPIEAKIFARIVLRNLELHQAGPST

SEQ ID NO: 4227 - protein, 126 aa, Triticum aestivum
AAASAFSVSTSSYNFVISPFLPSFCNAPYRSAFNGHLRCSRAEIARFVDTLRNPSSVLRACAAFALLQFTMPAGRHAVHHAALLQKAGASRVLRWAAAAATAPIEAKIFARIVLRNLELHQAGPST

SEQ ID NO: 4228 - protein, 119 aa, Triticum aestivum
MSAVNITNVAVLDNPTAFLNPFQFEISYECLVPLDDDLEWKLTYVGSAEDETYDQQLESVLVGPVNVGTYRFVFQADPPDPLKIREQDIIGVTVLLLTCSYVGQEFMRVGYYVNNDYDE

SEQ ID NO: 4229 - protein, 177 aa, Triticum aestivum
  misc_feature (30)..(30): Xaa can be any naturally occurring amino acid
  misc_feature (171)..(171): Xaa can be any naturally occurring amino acid
MAPTVMALVGPPPSLPFQGLKSTVGLPVSXGSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCXEESGKA

SEQ ID NO: 4230 - protein, 177 aa, Triticum aestivum
  misc_feature (101)..(101): Xaa can be any naturally occurring amino acid
  misc_feature (140)..(140): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREXHTHPPGYYDGRYWTMWKLPMFGCTDATQVINEVEEVKKXEYPDAYVRIIGFDNMRQVQCVSFIAFKPPGCEESGKA

SEQ ID NO: 4231 - protein, 197 aa, Triticum aestivum
  misc_feature (92)..(92): Xaa can be any naturally occurring amino acid
  misc_feature (108)..(108): Xaa can be any naturally occurring amino acid
  misc_feature (114)..(114): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREHNASPGXYYDGRXYWDNVELPMFGCTDATQVINEVEESRRIPDAYVRISDRQHAQVQCVTHRQRARIRKAKHSHGQYKCNAVCTRALVLSLLLLSR

SEQ ID NO: 4232 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGHA

SEQ ID NO: 4233 - protein, 84 aa, Triticum aestivum
  misc_feature (62)..(62): Xaa can be any naturally occurring amino acid
  misc_feature (64)..(65): Xaa can be any naturally occurring amino acid
  misc_feature (80)..(80): Xaa can be any naturally occurring amino acid
RQNKPCEHEKRCTGINKPDYLATVDVDPNSATYSQVIHRLPATHIGDELHHSGWNACSSCHXDXXTSRRFLILPSLLSGXVFVV

SEQ ID NO: 4234 - protein, 354 aa, Triticum aestivum
  misc_feature (234)..(234): Xaa can be any naturally occurring amino acid
MDPKSPDDRPEAAAPQPLEWRFAQVFGERGAGEDVQEVDIISAIEFDKSGDHLATGDRGGRVVLFERTDARGNASRTELERQDYSVPRHPEFRYKTEFQSHEPEFDYLKSLEIEEKINKIKWGQTANNALFILSTNDKTIKYWKVQDKKVKRISVMNLDTSQSADNGTTSSSSTSSSRGLPNGGSSEKSYNCANNDLPFPPGGYASLRLPVVVVTGQELNPVARCRRVYAHAHXDYHINSISNNSDGETFISADDLRINLWNWEINSQSFNIVDVKPANMEDLTEVITCAEFHPTHCNTLAYSSSKGAIRLIDLRQSALCDNHSKLFEEHEAPGSKSFFTEIIASVSDIKSTRP

SEQ ID NO: 4235 - protein, 140 aa, Triticum aestivum
  misc_feature (130)..(130): Xaa can be any naturally occurring amino acid
MASPALISDTDQWKALQAHVGAIHKTHLRDLMTDADRCKAMTAEFEGVFLDYSRQQATTETVDKLFKLAETAKLKEKIDKMFKGEKINTTENRSVLHVALRAPRDAVINSDGVNVVPEVWAVKDKIKQFXETFRSGSWVG

SEQ ID NO: 4236 - protein, 338 aa, Triticum aestivum
MAASALAASAAASQSMRNREILDAVGTTAAALSLAGSSFIVLCYLLFRELRKFSFKLVYFLAVADMLCSLFTIMGGPANAFYCFAHDYSAHFFCVASFLWTTTIAFTLHRTVVKHKTDVEEFGFIFHLYVWGTSLVTTVLRSIGSDYGRPGTWCWIQQGSTGKILHLITFYLPLWGAILYNGFTYYQVNRMLNNATRMAVGMSDRSSQSDVRADKKAFNRWGYYPLILIGSWAFATINRLYDFANPGHKIFWLSILDIGFAGLMGLFNSIAYGLNSSVRRAIAERIDMYLPERIKRSLPTLSRLRSQQENELTSLIVESNNSITETTMRVTPRSSLAG

SEQ ID NO: 4237 - protein, 78 aa, Triticum aestivum
MAAMSYSSSSSAAAAGGGGAAAATAAGLKTYFKTPEGRYKLQYEKAHSTAVLHYNHGGKTVSQVPVDAVAVLAPTRGI

SEQ ID NO: 4238 - protein, 107 aa, Triticum aestivum
MAATSYSSSSSAAAAGGGGAAAATAAGLKTYFKTPEGRYKLQYEKAHSAAVLHYNHGGKTVSQLTVAYLKERSTGQGSTPSTPSSSCGMRSGAAWLLGSGNGSRALF

SEQ ID NO: 4239 - protein, 298 aa, Triticum aestivum
VIDLITSKDVERIRSYPKLGKPSLGADGKFVVAASIGTREDDKLRLEQLIQAGANAIVIDSSQGNSTYQLDMIKYAKKTFPEVDLIGGNVVTIGQAQNLIAAGVDGLRVGMGSGSICTTQEVCAVGRGQATAVYKVASYAKDHNVPVIADGGISYSGHIVKALSLGASTVMMGSFLAGSHEAPGAYEYKDGHRVKKYRGMGSLEAMTKGSDARYLGDTLKLKVAQGVVGAVADKGSVLRFIPYTMQAVKQGFQDLGASSLQSAHDLLRAETLRLEVRTGAAQVEGGIHGLVSYEKKSF

SEQ ID NO: 4240 - protein, 126 aa, Triticum aestivum
  misc_feature (99)..(99): Xaa can be any naturally occurring amino acid
MHDFCFTIPYGFAVLAGGLLGYLRRGSTASLAGGAGVGGLLLLAGFVSLKAFEKRRNSYLALALETLCALALTFVMGQRYLETSKIMPAGVVAGLSARXCRLVLLMSAFYLFKIATGGNHFSPKKE

SEQ ID NO: 4241 - protein, 120 aa, Triticum aestivum
  misc_feature (97)..(97): Xaa can be any naturally occurring amino acid
MHDFCFTIPYGFAVLAGGLLGYLRRGSTASLAGGAGVGGLLLLAGFVSLKAFEKRRNSYLALALETLCALALTFVMGQRYLETSKIMPAGVVAGLSXSVMSAFYLFKIATGGNHFSPKKE

SEQ ID NO: 4242 - protein, 204 aa, Triticum aestivum
MALVGQAAMVAQFAGVDAYGLIKMIADAAQTVRRNRATCLQLARRAKMIGDLLHQLHAAQLMQQPETRNPMEQLEETLRRALLLVRSCQGRGYLYRCFMGARHADELREVQGEITFYLQLFPLVSYVDTTLTWVRLLNKGAAPQPPSCKEAPVVRPYFVPDEWCLLVSHSGSILWHSLLVISTNHPSGKIYSGMYLQEFKLLCN

SEQ ID NO: 4243 - protein, 404 aa, Triticum aestivum
MDRIVGRKFKLGRKIGSGSFGVIYLATDMDTYEIVAVKIESSNSKHPQLFYEAKIYNALQGGSGIANVKWCGVDGEENVLIIDLLGPSLEDLFVYCGRKFTLKTVLMLADQMLTRIEFMHSKGYLHRDIKPDNFLMGLGRKANQVYVIDFGLAKRYRDSTTNRHIPYREHKNLTGTARYASSNTHLGIEQSRRDDLESLGYVRLYFLRGSLPWQGLKAATKKQKYEKICEKKIPTPIEVLCKSCPVEFASYFHYCMSLTFDQRPDYGFVKRLFRDSFDATGYDFDYVFDWTVLKYKQGQKTQHVPGATITRAIPTHLDKRAGVNGDVHPNEAHEQMESSHMTGSAAQLQRQNMAASARNENPKNDGNSRHIVRIDAFHQNQGFDSNTGSPSACFPTLPHNAPAR

SEQ ID NO: 4244 - protein, 381 aa, Triticum aestivum
MATAGKVIKCKAAVAWEAGKPLSIEEVEVAPPQAMEGQTPVFPRILGHEAGGIVESVGEGVTELVPGDHVLPVFTGECKCAHCKSKESNLCDLLRINVDRGVMIGDGESRFTIGGKPIFHFVGTSTFSEYTVIHVGCLAKINPEAPLDKVCVLSCGISTGLGATLNVAKPKKGDDPRRFCSTPCFCRLKRIMCYNQGNFRVLLSHMINPRGHGKGPRWSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFLNERTLRGTFFGNYKPRTGLPGVVDMYMRKELELDKFITHSVPFSQINTAFDLMLKGEGLRCVIRMEE

SEQ ID NO: 4245 - protein, 396 aa, Triticum aestivum
  misc_feature (92)..(92): Xaa can be any naturally occurring amino acid
MAPRAGGQTYGFPIYCASWLPLAHIIKPSPSADDVVDADASPAPSSPPPPPMVALGGGGGEGRSGVPNALVVAALDPGAAGAPPALSPEPCXRLGTEEQVPYRMAVHPRGDGVLCAFPNGCRLVRWESPEGDDQHSLVLRSDQEALVKLNDVGLQLAVSFSGEGSILATGGEDGHLRVFKWPGMETVIEEPDAETSVKDLSFSSHEMSLVGNRSSGPSRVWDLKSSEAVANLPREQGEIFGFCRFSTKSDNSQILFVTAMQGDYGKIISWNTTSWTRIGSKKVTRDAISAFSVSPDGTLLAIGTIEGSISVLGPRDMRVVLTVKKAHLGIVTTLAFSQDSRALLSTSFDSTTRVTSTESPKSDGISLWSMVLAIILGILVYYYMQHKEDLLAMLPQ

SEQ ID NO: 4246 - protein, 252 aa, Triticum aestivum
MATVAATMATPTRHRQFRVRAAWDMNPGAATVAVPKPSKDKPKPALGQSPATATTPARAPPPTHADLFARSSEDQAKKSTYMGFEKWWLPPAPEVKKPRSLYNAASLAYLGDCIYELYARRHFFFPPLSINEYNKRVMDVVKCESQDLLLNKLLGEDFLTEEERDILRWGRNIVSSKTRTRKRAGIAVYNRASSLETLIGYLYLTNFKRLEQMMFQLGFTSGASSQNIADELLSSFQKTTSTSVQSQQPAKR

SEQ ID NO: 4247 - protein, 155 aa, Triticum aestivum
MDASATVATGKGKKGAAGRKAGGPRKKSVSRSVKAGLQFPVGRIGRFLKKGRYAQRVGSGAPVYLAAVLEYLAAELLELAGNAAKDNKKSRIIPRHLLLAIRNDEELGKLLAGITIAHGGVIPNINPVLLPKKTAEKSPKEPKSPKKTAKSPKKA

SEQ ID NO: 4248 - protein, 131 aa, Triticum aestivum
MSKEDVLKIQTCVLKVNIHCDGCQKKVKKILSKIDGVYQSTIDPEEGKVMVSGLVDPDTIIKKLNKGGKPAVLWGSKPAGVANQFQKLDLDGGGGGGQGRPPRSSRTGNGSRSSSSRSRCQRRSNSSSRQK

SEQ ID NO: 4249 - protein, 364 aa, Triticum aestivum
  misc_feature (102)..(102): Xaa can be any naturally occurring amino acid
KSHRGRTGRPRLPLFLCSPVRPLPPLVGVVAAARIIVRASLPRPPTAPPQERATQRFDSGRREWRRRRPSPPPTSPASPPPPRPRSTTTRTTSSASAAPAAXAQRLVAMAGSGKFFVGGNWKCNGTKESITKLVSDLNAATLESDVDVVVAPPFIYIDQVKSSLTDRIEVSAQNTWIGKGGAFTGEISAEQLVDIGCQWVILGHSERRHVIGEDDQFIGKKAAYALSQNLKVMACIGELLEEREAGKTFDVCFKQMKAFADNITDWKNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 4250 - protein, 283 aa, Triticum aestivum
MCSDSKEVAAVPQSTHATCAPASPRSAHQSAHAPPRPASPLLSSPLSSSYARREKMGKRWIPLEANPDVMNQFIWGLGVTEGEAQFCDVYGLDDELLAMVPQPVLAVIFLYPLTSLDEKVEEYDASATSTAGGKDSSKKVYFTKQTVGNACGTVGVIHAIGNAASDIKLVEGSYFDRFYKQTADMDPVQRAVFLEEDDEMEGAHSVAATAGDTDVNVEVNEHFVCFSCVDGELYELDGRKSKPISHGPSSPETLLQDAAKVIKARIATNPNSLNFNVMVLSKQ

SEQ ID NO: 4251 - protein, 203 aa, Triticum aestivum
MKNVAKCDTWCELQNPANHRVFERKLRPRPLGRGHACLGVNTRQIWRKTLSILHPLRSADPSLHADADLSGPFLFLLSFGLFQLLAGKFHFGIVLGWVTVASLFLYFVFSMLSGGRRGDLDLYRCVSLVGYCMLPMVIFSAVSLFLPRGGGLIFGMGMGFVLWSTRVCTRLLAELASSGDEHRGLIAYACWLVYMLFSLLVIF

SEQ ID NO: 4252 - protein, 373 aa, Triticum aestivum
MASSAGDMPEVKFKRTGSLGSSDYVRADKIDLTSLDIQLEQQLNKKWGKTNIKSQGPRARWEIDLAKLEIRHVIAQGTYGTVYRGTYDGQQVAVKLLDWGEDGFATEAETTALRTSFKQEVAVWHKLSHPNVTRFIGASMGTTDLKIPVNDNGARANLPARACCVVVEYLAGGTLKQYLIKNRRRKLAYKVVVQLALDLSRGLSYLHSRKIVHRDVKTENMLLDTQRNLKIADFGVARVEAQNPKDMTGATGTLGYMAPEVLDGKPYNRKCDVYSFGICLWEIYCCDMPYPDLSFADVSSAVVHQNLRPDIPRCCPSAFANIMRKCWDGNPDKRPDMDEVVQLMEALDTSKGGGMIPDGQSSGCLCFTRARGP

SEQ ID NO: 4253 - protein, 298 aa, Triticum aestivum
MRIGSRPAAGVAASKNLGMHLAADYPHRGGGRLGLGPFAAAVLRTDNRRRAIAGGAVLASALLLVATPRLRHSPALHLFADMRNLLGVPNTLNVLTAYPLLLAGVPGLILCLFGGGCFGISLRWEALGWFLFYVGNVGAAFGSAYYHLKPDDDRLIWDRLPMMMSASSLLSILVIERVDERAGLSCLISLLSLLLVSSACERILDDMRLWVVLNLVPCVAIPAMLFLFAPKYTHSRFWFLATGFYLLARFEGLADRKVYSVNRYFISGHSLEHLCFAMVTLILTVMLSFRNIKITRDS

SEQ ID NO: 4254 - protein, 496 aa, Triticum aestivum
MARKMLKDGEAPLVADDGGTYDYDLFVIGAGSGGVRGSRTAAGFGAKVAICELPFHPISSEWLGGHGGTCVIRGCVPKKILVYGASFRGEFDDAKQFGWEINGDINYNWKKLLENKTQEIVRLNGVYKRILGGSGVTMIEGAGSIVDAHTVEVTQPDGSKQRHTTKHILIATGSRATLVDIPGKELAITSDEALSLEELPKRAVILGGGYIAVEFASIWKGLGAEVDLFYRKELPLRGFDDEMRTVVASNLEGRGIRLHPGTNLTELSKTADGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAETKNDLLIYTSSFNPMKNSISKRVEKSTMKLVVDAETDKVLGAAMCGPDAAEIMQGIAVALKAGATKATFDSTVGIHPSAAEEFVTMRTLTRRVSPPSKPKTNL

SEQ ID NO: 4255 - protein, 462 aa, Triticum aestivum
  misc_feature (98)..(98): Xaa can be any naturally occurring amino acid
TQYAFAPTQLPTPRSHLLVVSSTELNSVYSLVLIFMKTAPRSVFHVINAAIYSLEKKVFFDMTKSTNHSRVAGKLMNLLYFGLRRAQGRDGGLSASRXYSYMGGFDATSNVAAGRLFGIPIRGTHSHAFVSSFLGLDEIIDKALSSSDGSNKCEDFVSLVQNWLVKIQDASSLRGSFGETNQSELAAFTSYALAFPNSFLALVDTYDVMRSGVPNFCAVALALNDMGYKAVGIRLDSGDLAYLSIETRKFFCAIEKEFGVVGFGKTNITASNDLNEETIDALNKQGHEVDSFGIGTYLVTCYAQAALGCVFKLVEINKQPRIKLSEDVTKVSIPCKKRCYRLYGKEGYPLVDIMTGQDEPSPKVGERILCRHPFIESKRAHVVPQHVEELLKCYWPGHSSVQREELPSLNENRSRCMRQLERMRPDHLRKLNPTPYKVSVSAQLYDFIHFLWLNEAPVGELQ

SEQ ID NO: 4256 - protein, 395 aa, Triticum aestivum
  misc_feature (229)..(229): Xaa can be any naturally occurring amino acid
  misc_feature (323)..(323): Xaa can be any naturally occurring amino acid
LAWSRPRLVSTQSPARGAQGPDGGISASRYSYMGGFDATSNVAAGRLFGIPIRGTHAHAFVNSFLGLDEIIDKALSSSDGSNKCEDFVSLVENWLVKIQGASSLRGSFGETNQSELAAFTSYALAFPNSFLALVDTYDVMRSGVPNFCAVALALNDMGYKAVGIRLDSGDLAYLSIETRKFFCAIEKEFGVVGFGKTNITASNDLHEETIDALNRQGHEVDSFGIGTYXLVTCYPQAALGCVFRLVEINKQPRIKLSEDVTKVSIPCKKRCYRLYGKEGYPLVDIMTGQDEPSPKVGERILGRHPFIESKRAHVVPQHVEELXLKCFWPGNSSVQREELPSLNENRSRCMRQLERMRPDHLRKLNPTPYKVSVSAQLYDFIHFLWLNEAPVGELR

SEQ ID NO: 4257 - protein, 414 aa, Triticum aestivum
  misc_feature (88)..(88): Xaa can be any naturally occurring amino acid
MEPQTDSKPIRLMTPYEIGSSLDLAHRVALAPKDRSSGAQELAAMEPHAESKPIPLMTPYKMGSSLDLAHRVVLAPLTRQRSYGNVPXQPHAAVYYGQRATPGGMLITEATGVSDTAQGYTDTPGVWTAEQAEAWRPVVDAVHAKGALFFCQLWHVGRVSSYGFQPGGAAPVSSTQRMVGPQVRHDGTTEEFSPPRRLAVEEIPMIVDDFRKAARNAINAGFDGVEIHGGNGYLIEQFLKDSANDRDDGYGGSLENRCRFALEVVEAVAKEVGAHRVGIRLSPFMDYMDCHDSDPHALGLHMATKLNDHNILYLHMIEPRMALVDGRREVPHRLLPYREAFKGTFIANGGYDREEGDRAVVSGYADLVSFGRLFLANPDLPKRLELNAPLNKYNRLTFYISDPVVGYTDYPFLP

SEQ ID NO: 4258 - protein, 209 aa, Triticum aestivum
  misc_feature (176)..(176): Xaa can be any naturally occurring amino acid
  misc_feature (199)..(199): Xaa can be any naturally occurring amino acid
MGSGNLMVKKVVRPSSFDLDIHLDKSWKEDVTCPICLDYPHNAVLLRCTSYEKGCRPFVCDTDQSRSNCLERFKGAYELPANVKVSSIAVAPLDSIHIVSSHAIIRPSCPFCRGDVIGWIVISEARLHLNQKKGCCEEDCCSFTGNFNELQKHTQQKHPDSRPSEIDPARQVDWDXFQQSSDIVDVLSTIHAQVPNGIXLGDYVIEYGG

SEQ ID NO: 4259 - protein, 291 aa, Triticum aestivum
MEVGFLGLGIMGKAMAANLLRHGFRVTVWNRTLSKCDELVAMGAAVGDTPASVVAKCKYTIAMLSDPSAALSVVFDKDGVLEQIGEGKGYVDMSTVDAATSCKISEAVKQKGGAFVEAPVSGSKKPAEDGQLVILAAGDKALYDDMVPAFDVLGKKSFFLGEMGNGAKMKLVVNMIMGSMMNAFSEGLCLADKSGLSPQTLLDVLDLGAIANPMFKMKGPSMLQGSYNPAFPLKHQQKDMRLALSLGDENAVSMPVAAASNEAFKKARSLGLGDLDFSVVHEVLKGTGGSG

SEQ ID NO: 4260 - protein, 277 aa, Triticum aestivum
MAAAAEQDYWGLFREETGWYNEIFLSAVVPGGGGWWRALPHPLRSWLRNCIGGYLLYFATGFLWCFVIYYWKRNAYIPKDAVPTVEAMKKQIIVASKAMPFYCALPSISEHMIESGWTRCFFHISEVGWPMYIVYVSLYLIFVEFGIYWMHRELHDIKPLYKHLHATHHIYNKENTLSPFAGLAYSIHCGILQAISHVIALFLLPMHFRTHIALLFIEAVWTANIHDCIHGKIWPVMGAGYHTIHHTTYRHNYGHYTVWMDWLFGTLREPEDLLKKD

SEQ ID NO: 4261 - protein, 421 aa, Triticum aestivum
  misc_feature (59)..(59): Xaa can be any naturally occurring amino acid
MGLFTVTKKATTPFDGQKPGTSGLRKKVTVFQQPHYLPNFVQSTFNALPADQVRGATIXVVSGDGRYFSKDAVQIIAKMAAANGVRRVWVGQDSLLSTPAVSAIIRERISADGAKATGAFILTASHNPGGPTEDFGIKYNMGNGGPAPESVTDKIFSNTKTITEYLIAEDLPNVDISVIGVTSFTGPEGPFDVDVFDSATDYIKLMKTIFDFESIKKLLASPKFSFCFDGLHGVAGAYAKRMFVDELGASESSLLNCVPKEDFGGGHPDPNLTYAKELVDRMGLGKTSNVDPPEFGAAADGDADRNMVLGKRFFVTPSDSVAIIAANAVQSIPYFASGLKGVARSMPTSAALDVVAKNLNLKFFEVPTGWKFFGNLMDAGMCSLCGEQSFGTGSDHIREKDGIWAVLAWLSILAYKNKDNL

SEQ ID NO: 4262 - protein, 368 aa, Triticum aestivum
  misc_feature (219)..(219): Xaa can be any naturally occurring amino acid
VTLITDEDESAPDLDKMGDFNLAHRVVLAPLTRCRSYGNLAQPHNALYYAQRAAPGVLLVAEACAVSEAARGYPHVPGLWSQEQVEAWKPVVDAVHGKGAVFFCQLWHTGRVSPTEFQPNGQAPVSSTDKQVPPQVAHDGSVLEFAPPRRLATEEIPHIVNDFRVAARNAMRAGFDGVEIHAGNGYLIDQFMKDGVNDRTDEYGGGLENRCRFPAEVIXAVCHEAGVCRVGVRLSPFADYVDCVDSDPWALALHVIGVMNGLGVLYCHMIEPRMCVNERMIPRRLLPFRRAFSGTFMVNGAYDREEGDKAVADGYADLVAYGRLFLANPDLPERFKRNAALNKYDRSTFYTSDPVVGYTDYPFLDQED

SEQ ID NO: 4263 - protein, 593 aa, Triticum aestivum
  misc_feature (325)..(325): Xaa can be any naturally occurring amino acid
PRPPPPPPPPSPGPFAGRPLPPPSPPAPSPASPPPPAAAAPPTAGRPPPPPPSSRPPSPPPPAAPPPPPPPPPPPPAGACGRTAASRPPPPSAGACSCVRPRAAHASADAWAFLSAGSELLLEIMGPGLVGGLLLPMLGALPDALLVLVSGLSGTKETAQSQVLIGMGLLAGSTVFLLTLLWGTCVVVGKCDVGENGVAIDSTDTKGFSLTGSGITTDVQTSYAARIMAISVIPFVIAQFPKMLKTHHGERLAILLALIASFSLVLAYCLYQVFQPWVQKRKLAYAKHKHVISGILQHAQKQALGRLLNDDGSPNEYVIRWPSRXTVMAAVPCLARADLRALSGATFWGVTVSGMMLAVGSCTAVFLPAGTLSGGVGVSRAGMYACLRRAKQWGPAGPAHSNKFVNDYHARTREEHDQLVDRSDEAVESVENPGWCIAKAVGYLILGATICAAFADPLVDAVHNFSNATHIPSFFVSFIGLPLATNSSEAVSAIIFASRKKQRTCSLTFSEVYGGVTMNNTLCLGVFLALIYFRELTWDFSSEVLVILLVCVIMGLFTSFRTSFPLWTCLVAYLLYPLTLAVVYVLDFVFGWS

SEQ ID NO: 4264 - protein, 596 aa, Triticum aestivum
GRVGGRVGHGVFNECNWRNKRKILGVMMNWLEWVLSQSLLRIAECNPYGMDDFWLQQGTSMLLSLVKSSQEDVQERAATTIATFVVIDDETANVDAARSEAVMRDGGIPLLLDLARCSRVSAQSEAAKAIANLSVNAKVAKVVADEGGIAIFTNLAKSTNRLVAEEAAGGLWNLSVGEEHKAAIAAAGGIKALVDLIFRWPAGTDGVLERAAGALANLAADDKCSLEVAKAGGVHALVTLARSCKLEGVLEQAARALANLAAHGDNNNNNAAVGQEAGALEALVQLTCSQNEGVRQEAAGALWNLSFDDRNREAIAAAGGVEALVSLAQQCLNASEGLQERAAGALWGLSVSESNSIAIGQEGGVAPLLTMAQSEVEDVHETAAGALWNLAFYSSNAHRIVEEGGVPILVHLCSSSGSKMARFMSALALAYMFDGRMDEAAIVGTSSEGSSKGVNVEGARRMALKHIETFVLTFSDPQVFSMAAASSAPAALSQVAEAVFIQEAGHLRCSGAEIGRFIAMLRNPTPVLRACAAFALLQFSIPGGRHATHHADLLQNVGAARVLRAAAAATSASIEAKVFARIVLRNLEHHQAGTST

SEQ ID NO: 4265 - protein, 407 aa, Triticum aestivum
  misc_feature (49)..(49): Xaa can be any naturally occurring amino acid
  misc_feature (94)..(94): Xaa can be any naturally occurring amino acid
  misc_feature (99)..(99): Xaa can be any naturally occurring amino acid
  misc_feature (196)..(196): Xaa can be any naturally occurring amino acid
  misc_feature (314)..(314): Xaa can be any naturally occurring amino acid
  misc_feature (326)..(326): Xaa can be any naturally occurring amino acid
MDGGGGGGGGRSGCCGTTSGADGKQAKQPVLAQKLFLLSHPDVDDLSKXDLRLPAGRRRRESPRTWAPLFESLAAAGVLEPDAVLLSGMRARIXEEIRXLDEKIADAEENLGESEVREAHLAKSLYFVKVGEKEKALEQLKVTEGKTVAIGQKMDLVFYTLQIGLFYMDFDLISKSIDKAKKLFEEGGDWERKNRXLKVYEGLYCMATRNFKKATSLFLDSISTFTTYELFPYDTFIFYTVLTSIISLDRVSLKQKVVDAPEILAVISKVPHLSEFLNSLYNCQYKSFFVAFSALTEQIKLYRYLQPHFRYYMXEVRTVVYSQFFXSHTKSVTMEAMASAFGVTVDFIDQELSRFIAAGKLHCKIDKVAGVLETNRPDERNAFYQSTIKQGDFLLNRIQKLSRVIDL

SEQ ID NO: 4266 - protein, 396 aa, Triticum aestivum
  misc_feature (318)..(318): Xaa can be any naturally occurring amino acid
MDGGGGGGSTSGDDGKQEKHLVLAHKLFLLSHPDVDDLSKVDLRSDVLSAVKSDDMAPLFESLAAAGVLEPDAVLLSEMRARIDEEIRKLDEKIADAEENLGESEVREAHLAKSLYFVKVGEKEKALEQLKVTEGKTVAIGQKMDLVFYTLQIGLFYMDFDLISKSIDKAKKLFEEGGDWERKNRLKVYEGLYCMATRNFKKATSLFLDSISTFTTYELFPYDTFIFYTVLTSIISLDRVSLKQKVVDAPEILAVISKVPHLSEFLNSLYNCQYKSFFVAFSGLTEQIKLDRYLQPHFRYYMREVRTVVYSQFLESYXKSVTMEAMASAFGVTVDFIDQELSRFIAAGKLHCKIDKVAGVLETNRPDERNAFYQSTIKQGDFLLNRIQKLSRVIDL

SEQ ID NO: 4267 - protein, 261 aa, Triticum aestivum
MADSMADSMVASFWGPVTSTTELCEENYARSSYIAEFYNTLSNAPCILLALIGLVNALRQRFEKRFSVLHISNMILSIGSIIFHATLQHVLQQSDETPMVWEILLYLYVLYSPDWHYRSTMPTFLVLYGAAFAVVHFFVRFQVVFKLHYIGLCLLCIPRMYKYYIQTKDLAAKRLAKLWVLTIFLATVCWLVDRIFCKKLSLWVINPQGHAWWHVLMGFNSYFANTFLMFCRAQQRGWEPRIIHLFGFLPYVKIQKSRKRE

SEQ ID NO: 4268 - protein, 146 aa, Triticum aestivum
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKSTTKSPKKKVAAKE

SEQ ID NO: 4269 - protein, 343 aa, Triticum aestivum
TGASDVVASGVGRADELRRKIVKQVEYYFSDENLPTDEFMLKFVMKNKEGLGNVPLGVPAACPRVRKLVQDHSTIEAALRTSSKLVVSSNGKRVRRLHPLPCNELKDVKKRTVVVENLPLDFSLESIQEKFGSVGKIMKITIHDPHAVGESAASKKPDIMLSNKVHAIVEYEAVEAAEKAVATLNDERNWRTGMRVILLAKRSVVGSGKNIQSSKENHGTCLRKNNEGQFSKEVQQSVSEKNGGADSGEVASDKENVNSDVNHEEVRQHQRANASGGRKGRYRSQGKGLSGQGHGSSPTIPGSDSANKPISGPRMPDGTRGFTMGRGRSLPLPKAEKAQKTEE

SEQ ID NO: 4270 - protein, 175 aa, Triticum aestivum
SEPAGPAPTNNVNWSLVVADKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 4271 - protein, 480 aa, Triticum aestivum
  misc_feature (291)..(291): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFTEWNKGELLSFLVEITADIFSIKDDQGEGYLVDKVLDKTGMKGTGKWTVQQAAELSVAAPTIEASLDSXRFLSGLKDERVAASKIFQGDYSSGETVDKAQLIEDVRKALYASKICSYAQGMNIIKAKSTEKGWGLNLGELARIWKGGCIIRASFLDRIKKAYDRNGELANLLIDPEFAQEIMDRQAAWRRVVCLAINNGVSTPGMSASLAYFDSYRRDRLPANLVQAQRDYFGAHTYERVDMPGSFHTEWYKIANSKI

SEQ ID NO: 4272 - protein, 437 aa, Triticum aestivum
MGSLRGGSGGEGRNEDGGKVGLPALEVALAFPQATPASLFPPAVSDYYQLDDLLTSEEKALRKKVRAISEKEIAPIMTEYWEKAEFPFHAIPKLATLGLAGSTTKGYGCPGLSLTASAVSIAEVARVDASCSTFILVHSSLAMSTIALCGSEAQKQKYLPSLAQFKTVGCWALTEPDYGSDASSLKTSAIKVPGGWQLDGQKRWIGNSTFADVLVILARNADTKQLNGFIVKKGAPGLRATKIQNKIGLRMVQNGDILLNKVFVPEEDRLTGINSFQDISKVLAMSRIMVAWQPIGISMGVYDMCHRYLKERKQFGAPLAAFQLNQEKLVRMLGNIQAMLLVGWRLCKLYESGKMTPGHASLGKAWTSSKSREVVSLGRELLGGNGILADFLVAKAFCDLEPIYSYEGTYDINSLVTGREITGIASFKPAAVAKSRL

SEQ ID NO: 4273 - protein, 419 aa, Triticum aestivum
  misc_feature (292)..(292): Xaa can be any naturally occurring amino acid
MHRLTCGCKFADPDTVVPSAAAASHRVRPDTMSCGSDGCRDGGSGGGSEGFGRSRPSKVAADDSVEPARCSDATSPPGSWIDRKLLVDPKMLFVGSKIGEGAHGKVYKGKYGDQIVAIKVLNSGGTPEEKVTLEDRFIREVNMMCKVKHDNLVKFIGACKEPLMVIVSELLPGMSLKNYLNSIRPSQLDIHTALGYALNIARAMECLHANGIIHRDLKPDNLLLTANRKKLKLTDFGLAREETVTEMMTAETGTYRWMAPELYSTVTLQRGEKKHYTNKVDVYSFGIVLWEXLLTNKMPFEGMSNLQAAYAAAFKQVRPAFPEDTPQELASIVQSCWVEDPAMRPSFSQIIRMLDAFLLTIPPPPPSEADEDTAESEDTASSLSSKSSSVSSIVSRATSKLSVVRHLFASKKGGSNGKA

SEQ ID NO: 4274 - protein, 290 aa, Triticum aestivum
MAKDIEAAPPGGEYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGFSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRASATKLGSSASFGRN

SEQ ID NO: 4275 - protein, 302 aa, Triticum aestivum
RPTRPRTRGRTRGRTRGFWYQPRHKTMISSSWGAPAAFKTGFDLQHVQDGLYGRHLHVYDWPGGELKQTLDLGSTGLLPLEVRFLHDPSKDTGYVGCALTSNMVRFFKTADGSWSHEVAISIEPLKVRNWMLPEMPGLITDFVISLDDRYLYLVNWLHGDIRQYNIEDPAKPVLAGQVFVGGLLQKGSDVVYVTDDDKEEQYAVPEVKGHRLRGGPQMIQLSLDGKRVYVTNSLFSRWDEQFYGPDLLKKGSHMLQIDVDTEEGGLAVNPNFFVDFGTEPEGPSLAHEMRYPGGDCTSDIWI

SEQ ID NO: 4276 - protein, 397 aa, Triticum aestivum
TQTHRNRAQRKVYRSFCNLRSIQFTARKMVAKEAIPLLTPHRMGRFELSHRVVLAPLTRCRSYANVPQPHAALYYSQRATEGGLLIAEATGVSATAQGYPETPGIWTQQHVDAWKPIVDAVHRKGALFFCQIWHVGRVSTNDFQPDGQAPISSTDQQITPDAESGMVYSKPRQLQTDEIPLIVDDFRRAARNAIEAGFDGVEIHGAHGYLLEQFMKDSSNDRTDEYGGSLKNRCRFAVEVIDAIVHEIGADRVGIRLSPFVDYMDCFDSDPHALGMYMVQQLNKHQGFVYCHMVEPRMAIVDGRRQIPHGLLPFRKAFNGTFIAAGGYDREEGNKVVADGYADLVAYGRIFLANPDLPKRFELDSPLNKYDRNTFYTQDPVIGYTDYPFLEGGSNAE

SEQ ID NO: 4277 - protein, 253 aa, Triticum aestivum
  misc_feature (88)..(88): Xaa can be any naturally occurring amino acid
  misc_feature (199)..(199): Xaa can be any naturally occurring amino acid
  misc_feature (217)..(217): Xaa can be any naturally occurring amino acid
MGRKFFVGGNWKCNGTVEQVESIVNTLNAGQIASTDVVEVVVSPPYVFLPTVKGKLRPEIQVAAQNCWVKKGGAFTGEVSAEMLVNLXVPWVILGHSERRSLMGESSEFVGEKVAYALAQGLKVIACVGETLEQREAGSTMAVVAEQTKAIADKIKDWTNVVVAYEPVWAIGTGKVASPAQAQEVHANLRDWLKTNVSXEVAESTRIIYGGSVTGAXCKELAAQPDVDGFLVGGASLKPEFIDIINAATVKSA

SEQ ID NO: 4278 - protein, 122 aa, Triticum aestivum
  misc_feature (85)..(85): Xaa can be any naturally occurring amino acid
  misc_feature (111)..(112): Xaa can be any naturally occurring amino acid
  misc_feature (114)..(114): Xaa can be any naturally occurring amino acid
MALLKAARVADVPTLDVVVAPGLVAVAKARSAAAVGGRFSVIGHRGKGMNALASEDPRLREVRENTVRSFNDAGTIPVDYVEFDXQVTKDGCPIIFHDNFIFTQDDGKISXXRXGGQLGDSC

SEQ ID NO: 4279 - protein, 78 aa, Triticum aestivum
  misc_feature (74)..(74): Xaa can be any naturally occurring amino acid
MEMKLTIRRVPTVVSNYQEDADKPRAGCGRNCLGDCCLPASKLPLYAFKLTPAKGSQEDAASTKLLVDILLNEXGGGG

SEQ ID NO: 4280 - protein, 163 aa, Triticum aestivum
MEYQGQQQHGRVDEYGNPVARHGVGTGMGTHGGVGTGAAAGGHFQPMRDEHQTGRGILHRSGSSSSSSSEDDGMGGRRKKGIKEKIKEKLPGGHGDQQHTGGTYGQQGTGMAGTGGTYGQQGHTGMTGTGAHGTGGAYGQHGTDTGEKKGIMDKIKEKLPGQH

SEQ ID NO: 4281 - protein, 112 aa, Triticum aestivum
MATKRSVGTLREADLKGKKVFVRADLNGPVDDAEKITDDTRIRASIHTIKYLLEKGAKVILASHLDRPKGVTRKFILKPIVARLYELLGLEVVMAADCIGKEVEKLACALPD

SEQ ID NO: 4282 - protein, 259 aa, Triticum aestivum
  misc_feature (225)..(225): Xaa can be any naturally occurring amino acid
  misc_feature (257)..(257): Xaa can be any naturally occurring amino acid
QVCTKKQAGTGPEFPGYRRPTRPLADLGERVESEFDSITIDLAELVGMELGVNIRRMHTGEGTVEPRPAVVTVMGHVDHGKTSLLDSLRQTSVAAKEAGGITQHIGAFVVEMQSGASLTFLDTPGHAAFSAMRARGAAVTDIVVLVVAADDGVMPQTLEAMSHAKVANVPIVVAINKCDKSGADPERVRIQLGSEGLLLEDMGGDVQVVEISALSKLGLDKLEEXLLLRPRYELNLKARTDGPAQAFVVEGKGDRGXGH

SEQ ID NO: 4283 - protein, 151 aa, Triticum aestivum
MADSMVASFWGPVTSTTELCEENYAHSSYIAEFYNTISNVPCVLLALIGLVNAFRQGFEKRFSVLHISNMILAIGSMIFHATLQLLLQQSDETPMVWEILLYMYVLYSPDWHYRSTMPTFLFLYGAAFAVVHFFARFQVVFKLHYIGLCFL

SEQ ID NO: 4284 - protein, 115 aa, Triticum aestivum
AVSALLDLISALSAFVASTPPFPHSSRYGNPAFRLWHEKLGDSVNELIAPITATATSPSDLAGAEVELAPYLLDSFGNGTRIDYGTGHETNFAAFLYCLARLGLITEPDYPAVVL

SEQ ID NO: 4285 - protein, 107 aa, Triticum aestivum
FLGPLVLQQNELLTTILLFGARACAMGSFTVLCLYAPEVYPTVVRSTGAGIATAVGRIGGVVCPLVAVAMLRSCHQMEALIVFEVILCLAAVACIFFPVETKGRGMD

SEQ ID NO: 4286 - protein, 265 aa, Triticum aestivum
  misc_feature (166)..(166): Xaa can be any naturally occurring amino acid
  misc_feature (241)..(241): Xaa can be any naturally occurring amino acid
MANAGDPASLPPSASPFSSTRALESVPFSSGNPRIEETRGVVLLHPDPPTAAAAASSSSSHLPAERKPQVFVPAVPNHMTYADFCRFCGSFVPHMLEMRIVRIDGAEDQYSVLIKFDTLSSTDSFYKHFNGKQFSSLEGDVSRVRFVEDVHYTQLIEHAHSSITSXLSKPTCPVCLERLDQDPGGILTTICNHSFHWSCISKWTGSSCPVCRYCQQQPEKSMCSVCGTSENLGICVICGTXGGHAIEHWKETEHCYSLELETQKW

SEQ ID NO: 4287 - protein, 274 aa, Triticum aestivum
  misc_feature (197)..(197): Xaa can be any naturally occurring amino acid
MAAMNSDLGGLGPRPANAPPNPFESAMYGAGPGLIRTGLGAYGEKFLGSSSEFMQSNITQYLSDPQYYFQVNSQYVRNKLKVVLFPFFHRGHWTRITEPVGGRLSYKPPIQDINAPDLYIPLMAFGTYIVIAGYALGVLGRFTPEALTLQFTRGLVGWFLQVVLIKGLLYSLGSGEAPLLDIVAYAGYGFAGTSLAXLARIFWSYLYYFIMPWFCLCTGVFLVKTMKRVLLGGPRSYERHPSRNHYFLLFLAVVQFPMLFWLGQHQWLIFPSYG

SEQ ID NO: 4288 - protein, 259 aa, Triticum aestivum
  misc_feature (211)..(211): Xaa can be any naturally occurring amino acid
PGARVGAARERENTLLSFGRAAEHAAVAFVEFDVQVTKDGCPVIFHDAARRTQKTEVLYERRVTDLLLDEFLSYGVQKEPHKVSKPLLRRMEDGRVLAWSTEEDDYLCTLQEVFEHVSPHLGFNIELKFDDNIIYPGVNLNRAPQAVLQVVFQYAGNRPPFFSTFQPDAARLTRALRSLYPLLFGADRRTAEHDDRRRNSLDNAIQVCQEXSLHGVVSEVRGVLKNPSAILKAQESNLAILTYGQLNNVREAVYIQYLM

SEQ ID NO: 4289 - protein, 299 aa, Triticum aestivum
  misc_feature (100)..(100): Xaa can be any naturally occurring amino acid
MEAAAAGAETPNLSAPATPGTPAPLFAGPRVDSLSYERKSMPRCRCLPVDAWMSPSACVLEIPAPDVSLPRKLGAEFVGTFILIFFATAAPIVNQKYGGXISPFGNAACAGLAVTTIILSTGHISGAHLNPSLTIAFAAFRHFPWLQVPAYVTAQVLGSISAGFALKGVFHPFLSGGVTVPDVTISTAQALFTEFIITFNLLFVVTAVATDTRAVGELAGIAVGAAVTLNILVAGPTTGGSMNPVRTLGPAVAAGNYRQLWIYLVAPTLGAVCGAGVYKLVKLRDVNGETPRPQRSFRR

SEQ ID NO: 4290 - protein, 276 aa, Triticum aestivum
GHFVVQEIIRTEGSRLSASNQSTPRTLANPLRDELECKKLGLQVVAGLGNELSSVKKAAAMDSDVLSSYVAKLAGGIEKITEVLRLNEELNTRDDAWRFHDTMQKFLKKADDEILRVQAQESVALSLVKEITEYFHGDSAKEEAHPFRLGAEARGAGRAAGPVSGGARAPSALTRCRSARKMPVPVPRMKAQEFRSLRAREAGSSDRRELGRVVALTTSSLPIEFYMDHEWGNRQRAGTGGGRGQRAPGTGGSTQSPQLQHNSTGSHRTCHMAMAR

SEQ ID NO: 4291 - protein, 68 aa, Triticum aestivum
  misc_feature (36)..(36): Xaa can be any naturally occurring amino acid
  misc_feature (41)..(41): Xaa can be any naturally occurring amino acid
MAGGRVAHATLKGPSVVKEIFIGLTLGLVAGGMWKXMHHWXNEQRKTRSFYDMLEKGQISVVVRGSKF

SEQ ID NO: 4292 - protein, 562 aa, Triticum aestivum
  misc_feature (36)..(36): Xaa can be any naturally occurring amino acid
  misc_feature (116)..(116): Xaa can be any naturally occurring amino acid
  misc_feature (169)..(169): Xaa can be any naturally occurring amino acid
  misc_feature (174)..(174): Xaa can be any naturally occurring amino acid
  misc_feature (200)..(200): Xaa can be any naturally occurring amino acid
  misc_feature (242)..(242): Xaa can be any naturally occurring amino acid
  misc_feature (252)..(252): Xaa can be any naturally occurring amino acid
  misc_feature (256)..(256): Xaa can be any naturally occurring amino acid
  misc_feature (271)..(271): Xaa can be any naturally occurring amino acid
  misc_feature (281)..(281): Xaa can be any naturally occurring amino acid
  misc_feature (287)..(287): Xaa can be any naturally occurring amino acid
  misc_feature (331)..(331): Xaa can be any naturally occurring amino acid
  misc_feature (355)..(355): Xaa can be any naturally occurring amino acid
  misc_feature (384)..(384): Xaa can be any naturally occurring amino acid
MATTNWTLPDHPTLPKGKTVAVVVLDGWGEASPDQXNQYNLPSTPVTDSLKNGAPEKWRLVKAHGTAVGLPSDDDMGNSEVGHNALGAGRIFAQGAKLVDAALASGKIWELEGFIXSKVRMLVDAALASGKIWEDEGFNYIKESFDKGTLHLIGLLSDGGVHSRLGHVXRLVEXASERGAKRSSLHILTDGRDVLDGSSXGFVERIHEQLGQMTGSVVQAWVGCPGYLVEAPHKLQNALLAXMTRREHDHVXDESXYLPPFVIGWMESGKXVGPIVDVGSXALTFNXKADRMVVFAKSRRFRDSEISNPGRVPKVMYAEVLQYDGELKLPXKYLVSPFWLERTSGEYLVKNGVRXTFACSETVKFGHVTFFWNGNRSGYFDETXEEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVIDK

SEQ ID NO: 4293 - protein, 147 aa, Triticum aestivum
  misc_feature (63)..(63): Xaa can be any naturally occurring amino acid
  misc_feature (84)..(84): Xaa can be any naturally occurring amino acid
  misc_feature (93)..(93): Xaa can be any naturally occurring amino acid
  misc_feature (97)..(97): Xaa can be any naturally occurring amino acid
  misc_feature (109)..(109): Xaa can be any naturally occurring amino acid
  misc_feature (112)..(113): Xaa can be any naturally occurring amino acid
  misc_feature (123)..(123): Xaa can be any naturally occurring amino acid
  misc_feature (131)..(131): Xaa can be any naturally occurring amino acid
  misc_feature (140)..(140): Xaa can be any naturally occurring amino acid
MAALAASMATSTAFAAKPRLVRPPARLSVSCSASSGDNNTPSLSASIKTFSAALALSSVLLSXSAATSPPPAAADIAGLTRARXQAFAKREKXSVKXLNPSLKEYAPDXAPXXAIQATSKKTXRRFENYGXSAALRSEGXPTNGTTD

SEQ ID NO: 4294 - protein, 160 aa, Triticum aestivum
  misc_feature (64)..(64): Xaa can be any naturally occurring amino acid
  misc_feature (75)..(75): Xaa can be any naturally occurring amino acid
  misc_feature (86)..(86): Xaa can be any naturally occurring amino acid
  misc_feature (96)..(96): Xaa can be any naturally occurring amino acid
  misc_feature (105)..(105): Xaa can be any naturally occurring amino acid
  misc_feature (120)..(120): Xaa can be any naturally occurring amino acid
  misc_feature (124)..(124): Xaa can be any naturally occurring amino acid
  misc_feature (126)..(126): Xaa can be any naturally occurring amino acid
MAALAASMATSTAFAAKPRLVRPPARLSVSCSASSGDNNTPSLSASIKTFSAALALSSVLLSSXAATSPPPAAAXDIAGLTPVQGXKRSAKAGEAXVKELNSSLXKKYAARSGPGLRIQXNNPXTXAGLTEGCLGLPTHKDNGWASPGCLNAGGWSRSTG

SEQ ID NO: 4295 - protein, 136 aa, Triticum aestivum
  misc_feature (30)..(30): Xaa can be any naturally occurring amino acid
  misc_feature (67)..(67): Xaa can be any naturally occurring amino acid
MRAVAIASPGGPEALQVREVEDLPAPGEGXEVLVAVAAAGVNRADTVQRQGRYPPPPGASPYPGLEXSGTILALGANVPPRWAVGDQVCALLTGGGYAEKVVVPAGQLLPVPEGGVAGRRRRNARGALLLPGPLNS

SEQ ID NO: 4296 - protein, 137 aa, Triticum aestivum
VALQFVCYPALAKILRTRMGLPLPSVRETIAQIVVYSLVEDYLSYWIHRLLHTEWCYRKIHRVHHEFTAPTGFAMSYSHWAENVVLSIPALAGPVLVPCHVTTQWLWFSIRLIEGINTHSGYHFPFSPSRLIPFYGG

SEQ ID NO: 4297 - protein, 120 aa, Triticum aestivum
  misc_feature (15)..(15): Xaa can be any naturally occurring amino acid
  misc_feature (39)..(39): Xaa can be any naturally occurring amino acid
  misc_feature (62)..(62): Xaa can be any naturally occurring amino acid
  misc_feature (77)..(77): Xaa can be any naturally occurring amino acid
LLLLCLLDAPKTVDXHLYTLVQLACFNTNYYLRCDPAFXQQVGHVLGRTLAPINGDNTINHXRSILGQYTADKHVVXVLFMTRCSGPNRACYSFPILLDDAPHLVGALSVFGSVTTGADT

SEQ ID NO: 4298 - protein, 297 aa, Triticum aestivum
MRAPMRGGGGRGGGRGFGFGGRSDGGGRSGGRGFGGRSAGRGRGGGRGGGRGGPGMKGGAKVVVVPHKHDGVFIAKAKEDALCTKNMVAGESVYGEKRVSVQNEDASKVEYRVWNPFRSKLAAAVLGGVDNIWIAPGTRVLYLGAASGTTVSHVSDIVGPNGLVYAVEFSHRSGRDLVNMAKKRTNVIPIIEDARHPAKYRMLVGMVDVIFSDVAQPDQARILALNASYFLKNGGHFVISIKANCIDSTQAAEAVFASEVEKLKADQFKPSEQVTLEPFERDHACVVGGYRMPKKQK

SEQ ID NO: 4299 - protein, 140 aa, Triticum aestivum
RHEAGLVYAVEFSHRSGRDLVNVAKKRTNVIPIIEDARHPAKYRMLVGMVDVIFSDVAQPDQARILALNASYFLKNGGHFVISIKANCIDSTQAAEAVFASEVEKLKADQFKPSEQVTLEPFERDHACVVGGYRMPKKQK

SEQ ID NO: 4300 - protein, 138 aa, Triticum aestivum
  misc_feature (104)..(104): Xaa can be any naturally occurring amino acid
  misc_feature (113)..(113): Xaa can be any naturally occurring amino acid
  misc_feature (122)..(122): Xaa can be any naturally occurring amino acid
MSLSNKLSITDVDLKGKRVLIRVDFNVPLDSALKVTNTQRIAGATPTIKYAIENGCKSVILMSHLGRPDGKVQPKYSLKPVVPELEALLGRSVEFASDCVGPRXEDIVNKAQXGQVVLLENXRFHLKEEGSTRTRWNK

SEQ ID NO: 4301 - protein, 163 aa, Triticum aestivum
  misc_feature (54)..(54): Xaa can be any naturally occurring amino acid
  misc_feature (69)..(69): Xaa can be any naturally occurring amino acid
  misc_feature (94)..(94): Xaa can be any naturally occurring amino acid
  misc_feature (99)..(100): Xaa can be any naturally occurring amino acid
  misc_feature (102)..(102): Xaa can be any naturally occurring amino acid
  misc_feature (108)..(108): Xaa can be any naturally occurring amino acid
  misc_feature (113)..(113): Xaa can be any naturally occurring amino acid
  misc_feature (129)..(129): Xaa can be any naturally occurring amino acid
  misc_feature (131)..(132): Xaa can be any naturally occurring amino acid
  misc_feature (140)..(140): Xaa can be any naturally occurring amino acid
  misc_feature (142)..(142): Xaa can be any naturally occurring amino acid
  misc_feature (148)..(149): Xaa can be any naturally occurring amino acid
  misc_feature (151)..(151): Xaa can be any naturally occurring amino acid
  misc_feature (154)..(154): Xaa can be any naturally occurring amino acid
  misc_feature (157)..(157): Xaa can be any naturally occurring amino acid
MAPTVMASSATSVAPFQGLKSTAGLPVSRRSNGASLGSVSNGGRIRCMQVWPIXGIKKFETLSYLPPLXSTEALLKQVDYLIRSKWVPCLELTXLGYLXXEXNASPGXTKGRXGTMWKLPMFGCTDATXVXXEVEEVKKXYXPYVRIXXFXICXKVXCVSSSL

SEQ ID NO: 4302 - protein, 98 aa, Triticum aestivum
  misc_feature (70)..(70): Xaa can be any naturally occurring amino acid
  misc_feature (76)..(76): Xaa can be any naturally occurring amino acid
MVCTKCEKKPGKVIVPDKWKEGASNTYEGGGRKINENKLLSKKSRWTPYGNTKCIICKQQAHQDGKYCHXTCAYSXKGVCAMCGNQALDTKLYKQSNV

SEQ ID NO: 4303 - protein, 192 aa, Triticum aestivum
  misc_feature (151)..(151): Xaa can be any naturally occurring amino acid
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVXPVPAFNVINGGSHAGNKLAMPEFMILSTGAASFKEAMEKWG

SEQ ID NO: 4304 - protein, 432 aa, Triticum aestivum
  misc_feature (86)..(86): Xaa can be any naturally occurring amino acid
  misc_feature (113)..(113): Xaa can be any naturally occurring amino acid
  misc_feature (141)..(141): Xaa can be any naturally occurring amino acid
  misc_feature (231)..(231): Xaa can be any naturally occurring amino acid
HRFVHSSRSIYGLKANTRSITRDIACKYIEQSKIEIEKDTPFTAARPQHTSHKTKQMRLNDVWIRTTSRGRGRKLTGTPDAHVNGXGYCTSRADERVDIMYGNIKHALSRLAXKEINTIHDFCPHSHTIVHNQKTGDIEIXVGSVRCKNMYFDQKVSAYGDTTELEEAQDEKKHEKGVRDQVEHSTNNLKNYMEKPKCKWSDPELKGPHLEIGFRVSPHGSEAIAIGASAXVIAPLVDPVQVMDPPDVEVGHREMESCSTERLDIGSVIYDLDIVLHGINTSPSSTHAATTMSLDTMKVWFDATGLKFYWRPLMMTSSVVPKMVVDDCTWRLVNLGQRKPEESDQGYEPSDAEPESESEEEDSDSASLVESDEDEEEDSDEDSEEEKGKTWDELEREATNADRDHGAESDSEEERSRRKVLTVRKTGGPPRS

SEQ ID NO: 4305 - protein, 64 aa, Triticum aestivum
IMWPFIESKRGDWYDANLPNSSLHGLNGYQVFISIAMIMGDGLFNFFSILFRTSYDMYLKRTGR

SEQ ID NO: 4306 - protein, 123 aa, Triticum aestivum
  misc_feature (15)..(15): Xaa can be any naturally occurring amino acid
  misc_feature (19)..(19): Xaa can be any naturally occurring amino acid
  misc_feature (21)..(21): Xaa can be any naturally occurring amino acid
  misc_feature (24)..(26): Xaa can be any naturally occurring amino acid
  misc_feature (39)..(39): Xaa can be any naturally occurring amino acid
  misc_feature (45)..(46): Xaa can be any naturally occurring amino acid
  misc_feature (50)..(50): Xaa can be any naturally occurring amino acid
  misc_feature (52)..(52): Xaa can be any naturally occurring amino acid
  misc_feature (55)..(55): Xaa can be any naturally occurring amino acid
  misc_feature (57)..(57): Xaa can be any naturally occurring amino acid
  misc_feature (59)..(59): Xaa can be any naturally occurring amino acid
  misc_feature (62)..(62): Xaa can be any naturally occurring amino acid
  misc_feature (65)..(65): Xaa can be any naturally occurring amino acid
  misc_feature (68)..(68): Xaa can be any naturally occurring amino acid
  misc_feature (73)..(73): Xaa can be any naturally occurring amino acid
  misc_feature (76)..(77): Xaa can be any naturally occurring amino acid
  misc_feature (82)..(82): Xaa can be any naturally occurring amino acid
  misc_feature (89)..(91): Xaa can be any naturally occurring amino acid
  misc_feature (93)..(94): Xaa can be any naturally occurring amino acid
  misc_feature (101)..(101): Xaa can be any naturally occurring amino acid
  misc_feature (107)..(107): Xaa can be any naturally occurring amino acid
  misc_feature (112)..(112): Xaa can be any naturally occurring amino acid
  misc_feature (118)..(119): Xaa can be any naturally occurring amino acid
MGTRGLALLLLAAVXLQTXLXASXXXGLLRIALKKRPIXRNSRVXXSLSXRXDLXRXGXTNXLRXEEXGDIVXLKXXMNSQXFGEISFXXXDXXFTVIFDXGSSNLXVPYDXCYFTIXXYLKA

SEQ ID NO: 4307 - protein, 90 aa, Triticum aestivum
  misc_feature (27)..(27): Xaa can be any naturally occurring amino acid
  misc_feature (30)..(31): Xaa can be any naturally occurring amino acid
  misc_feature (36)..(36): Xaa can be any naturally occurring amino acid
  misc_feature (38)..(39): Xaa can be any naturally occurring amino acid
  misc_feature (47)..(47): Xaa can be any naturally occurring amino acid
  misc_feature (57)..(57): Xaa can be any naturally occurring amino acid
  misc_feature (59)..(59): Xaa can be any naturally occurring amino acid
  misc_feature (69)..(70): Xaa can be any naturally occurring amino acid
  misc_feature (74)..(74): Xaa can be any naturally occurring amino acid
  misc_feature (77)..(78): Xaa can be any naturally occurring amino acid
  misc_feature (80)..(81): Xaa can be any naturally occurring amino acid
MINVGPGEGVSLLLRGGILSEPNQMAXGKXXHATLXGXXVVKEIFIXLTLGLVAGGXWXMHHWNEQRKXXSFYXMLXXGXXNVPCGVLKC

SEQ ID NO: 4308 - protein, 200 aa, Triticum aestivum
  misc_feature (26)..(27): Xaa can be any naturally occurring amino acid
  misc_feature (29)..(29): Xaa can be any naturally occurring amino acid
  misc_feature (54)..(54): Xaa can be any naturally occurring amino acid
GAEATDVANAVLDGTDCVMLSGESAXXAXPEVAVTIMARICVRSESSLDSDAVXFKEMIKAAPLPMSPLESLASSAVRTANKARATLIVVLTRGGTTAKLVAKYRPRVPILSVVVPVLTTDSFDWTVSSEGPARHSLIYRGLIPLLAEGSAKATDSESTEEILQAALKSAVKKQLCKAGDAVVVLHRIGVASVIKICTVK

SEQ ID NO: 4309 - protein, 147 aa, Triticum aestivum
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKISTKSPKKKTAATKE

SEQ ID NO: 4310 - protein, 163 aa, Triticum aestivum
  misc_feature (91)..(91): Xaa can be any naturally occurring amino acid
  misc_feature (102)..(102): Xaa can be any naturally occurring amino acid
STNTHLCKRASYQKKSPRKRPRGPAGRGQEWQQTAALRKRRPATMAAIHGADGRGASAIADKGHCVVYPPGGERFEVPLAYLSTTVFGELXLRMSEDEFGFXSEDRITVPCNAAVMAYVICLLKRKPSEEVERAVLSSVVMPRSNQSGIAMVCTGLGQSMAIF

SEQ ID NO: 4311 - protein, 129 aa, Triticum aestivum
LELEMAAGKLGQQLMTRLHLARTRPSATADVPRGHLAVYVGEGRKRLVIPTACLSHPAFVTLLKRVEDEFGFDHRCGGLNIPCASETEFAIVGAAAARDGNNITDDCVRAAPIDRIRSGRVIIIPFSTN

SEQ ID NO: 4312 - protein, 337 aa, Triticum aestivum
MAPLGDAVAPAAAAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAAMRAAKSTGILCSYDPNVRLPLWPSAQAARDGIMSIWKEADFIKVSDDEVAFLTQGDATDEKNVLSLWFEGLKLLIVTDGEKGCRYFTKDFKGSVPGYSVNTVDTTGAGDAFVGSLLVSVSKDDSIFYNEAKLREVLQFSNACGAICTTKKGAIPALPTTATALELISKGSN

SEQ ID NO: 4313 - protein, 160 aa, Triticum aestivum
VCIRGPNVTAGYKTADPGANEAAFLHGWFHTGDIGVMDGEGYLSLVGRIKELINRGGEKISPIEVDSVLLGHPDVAQAVSFGVPDEKYGEEIHCAVIPRESVALGEEEVVAFCRKNLAAFKVPKKVYIAADLPKTATGKIQRRIVAQHFFVPAAAAAAKA

SEQ ID NO: 4314 - protein, 395 aa, Triticum aestivum
MDGGGGGGGTSGDDGKQEKHLVLAHKLFLLSHPDVDDLSKVDLRSDVLSAVKSDDMAPLFESLAAAGVLEPDAVLLSEMRARIDEEIRKLDEKIADAEENLGESEVREAHLAKSLYFVKVGEKEKALEQLKVTEGKTVAIGQKMDLVFYTLQIGLFYMDFDLISKSIDKAKKLFEEGGDWERKNRLKVYEGLYCMATRNFKKATSLFLDSISTFTTYELFPYDTFIFYTVLTSIISLDRVSLKQKVVDAPEILAVISKVPHLSEFLNSLYNCQYKSFFVAFSGLTEQIKLDRYLQPHFRYFMREVRTVVYSQFLESYKSVTMEAMAASFGVTVDFIDQELSRFIAAGKLHCKIDKVAGVLETNRPDARNAFYQSTIKQGDFLLNRIQKLSRVIDL

SEQ ID NO: 4315 - protein, 607 aa, Triticum aestivum
QHFCRSFCPVTERSSPAPPAIGLSPSVQIFPPPAGEATPPHLSLTRASQPQPPRAQRQGRPRPPAPTLTCGPWAGDVVGVTLCLRLPPDKAKPSDANNSSSSSSWTPPKTKPSSLFGVGCAARDQRAAARSQPTATATSGGDGVHLRRGGAALLLLRVPAAAAEAAAHAPLPPPPPRAPFRRRSLSRSSDSPHAPAPPLASRAPAQGGGAAVEKDPIKLWDRYVEWLYQHKQLGLFVDVSRMGFTDDFLLRMEPLMQRAFVAMGELEKGAIANPDEGRMVGHYWLRDPGLAPNSFLRTKIEKTVDHILAFSQGIVPRMAQLGEALDAPLALVLSMGGGAPASRPQFVSEALAPDNPPLKIRFIDNTDPAGIDHQIAQLGEELKSTLVIVISKSGGTPETRNGLLEVQKAFRDAGLDFSKQGVAITQENSLLDNTARIEGWLDRFPMFDWVGGRTSELSAVGLLPAALQGIDVKEMLVGAALMDEETRNTVVKENPAALLALSWYWATDGIGSKDMVVLPYKDSLLLLSRYLQQLVMESLGKEFDLDGNRVNQGLTVYGNKGSTDQHAYIQQPISVTDNFFVTFIEVLRDRPSERAGGIYACLVYVNA

SEQ ID NO: 4316 - protein, 265 aa, Triticum aestivum
  misc_feature (148)..(148): Xaa can be any naturally occurring amino acid
  misc_feature (157)..(157): Xaa can be any naturally occurring amino acid
  misc_feature (182)..(182): Xaa can be any naturally occurring amino acid
SIDHTSNPSTRSPARATDAPAAALTASIATSSAFAAKPRLARPPARLSVSCSAPSGDNNTPSLRLHNTLSLAALALSSVLLSSAPTSPPPAAADIAGLTPCKESKAFPKREKQSVKKLNSSLKKYAPDSAPALAIQATIAKPKRRFEXNYGKFGLLXGSDGLPHLIVSGDRAALGGEFITPXGCSFLYHRPVWIGWVGRSYLIAVSGEKKPAMREIIIDVELAARIIPRGFIWPVAAYRELINGDLVVDDADIRLLSSCHACLVG

SEQ ID NO: 4317 - protein, 156 aa, Triticum aestivum
  misc_feature (62)..(62): Xaa can be any naturally occurring amino acid
  misc_feature (77)..(77): Xaa can be any naturally occurring amino acid
  misc_feature (92)..(92): Xaa can be any naturally occurring amino acid
  misc_feature (119)..(119): Xaa can be any naturally occurring amino acid
SGTEGRNTLTPRTKLICTLSPASRFVPMLENLLRAGMNVARFSFSHGSHEYRKETLSALRQXMHNTGILCGVMLDTXGPENRTGSLKEGKQXQTDKGQKITVSTDNEYQGEHDTNSMKXQKLPQDGKPGPWQTKGRREPPPLVGPPLEPNNWKLPK

SEQ ID NO: 4318 - protein, 245 aa, Triticum aestivum
MFLSRIVLRDLDSIDSPASMATSKKVVTRDEWERKLRDVKIRKEDMNRLVMNFLVTEGFVDAADKFRVESGTQPDIDLATITDRMEVKKAVQSGNVQEAIEKINDLNPTILDTNPELYFHLQQQKLIELIRAGKINEALEFAQEELAPRGEENQTFLEEIEKTVALLVFEDVKNCPYGELLDVSQRLKTASEVNAAILTSQSHEKDPKLPSLLKMLIWTQNQLNEKAAYPRINNLSTAALEDPAI

SEQ ID NO: 4319 - protein, 360 aa, Triticum aestivum
MVCIGRLRALVLRAAAGAGAGRRRWARVLCGRAVDVCVTPRPRGHGWRGFRAVAGARTKMMLDSSDSDSGAPAGQLQLQRRAVAAGTQPQDGGYASAGWQREDGKLKCGYSSFRGKRATMEDFYDVKLTEIDGHAVSLFGVFDGHGGSRAAEYLKEHLFENLMKHPKFLTDTKLAISETYQKTDADFLESESSAFRDDGSTASTAVLVGGHLYVANVGDSRAVISKAGKARALSVDHKPNRSDERKRIENAGGVVIWAGTWRVGGVLAMSRAFGNRLLKPFVVAEPEIQEELINGELESLVLASDGLWDAVENEEAVSLAKTEDVPESAARKLTEIAYSRGSADNITCIVVQFHHDKITG

SEQ ID NO: 4320 - protein, 232 aa, Triticum aestivum
  misc_feature (148)..(148): Xaa can be any naturally occurring amino acid
  misc_feature (181)..(181): Xaa can be any naturally occurring amino acid
RNSTGNTAKEDLTQHLLEDEEPKDCEEAKPALPNNKAVEKAEAGTADFLIDLEDKRSIKVLGSNTLVGLAIVTFAGVCYSLFAPAFNLATNDQWHTLRDGVPHLVVYTAYFYFCLSSLAVGVALNVWCLYRPVAGVPRSTLRAYVADXRGRGWRCWRGLVAGVGNAFTGRGGQAGGFGAGXLRPVTTLGGVVLCGESRRSSPRTYTLLGSMLFMFVLAMPLLMASSAHMQRL

SEQ ID NO: 4321 - protein, 197 aa, Triticum aestivum
QVLVPVDGNPQACIFLDTPGHEAFGAMRARGARVTDICIVVVAADDGVLPQTSEAIAHARAAGVPIIIAINKIDKEGANAERVMQELSQIGLMPEMWGGDTPMIQISALTGDNVDELLETVMLVAELQELKANPHRNAKGTVIEACLDKAKGPLATLVVQNGTLNKADIIVCGEAYGKIRALYDDRGKLVDKAGPSN

SEQ ID NO: 4322 - protein, 511 aa, Triticum aestivum
  misc_feature (385)..(385): Xaa can be any naturally occurring amino acid
MSSLHHLLLSDQSVDQRVIGFYIDLVLSSIDASCKLTVSNGPSTLNNALPDADIGIFIHVWILFGSSHIYAIKKKKPLNAGPWIIGSVLGVVGLLIIVLVVVLLCRRKKTDDKQHSKTWMPFSINGLTSLSTGSRTSYGTTLTSGLNGSYGYRFAFNVLQEATNNFDESWVIGVGGFGKVYKGALRDDTKVAVKRGNPKSQQGLNEFRTEIELLSRLRHRHLVSLIGYCDERNEMILVYEYMENGTVKSHLYGSDNPSLNWKQRLEICIGAARGLHYLHTGSAKAIIHRDVKSANILLDENLLAKVADFGLSKTGPELDQTHVSTAVKGSFGYLDPEYFRRQQLTEKSDVYSFGVVMLEVLCARPVIDPSLPREMVNLAEWGMKXWQKRGELHQIVDQKLSGAIRPDSLRKFGETVEKCLADYGVERPSMGDVLWNLEYVLQLQDVDSSTVSDVNSMNRIVDLSSQVQHVGAMESISVTMAEDGALHEPDHDLSDVSMSRVFSQLIKAEGR

SEQ ID NO: 4323 - protein, 133 aa, Triticum aestivum
  misc_feature (28)..(28): Xaa can be any naturally occurring amino acid
  misc_feature (49)..(49): Xaa can be any naturally occurring amino acid
  misc_feature (90)..(90): Xaa can be any naturally occurring amino acid
  misc_feature (110)..(110): Xaa can be any naturally occurring amino acid
  misc_feature (113)..(113): Xaa can be any naturally occurring amino acid
  misc_feature (117)..(117): Xaa can be any naturally occurring amino acid
  misc_feature (125)..(125): Xaa can be any naturally occurring amino acid
MAPTVMASSATSVAPFQGLKSTAGLPVXRRSNGASLGSVSNGGRIRCMXVWPIEGIKKFETLSYLPPLSTEALLKQVDYLIRSKWVPCLXFNKVGFIFREQNATPGYYHXRYXWTMXWKLPMFGXCTDPTQGD

SEQ ID NO: 4324 - protein, 125 aa, Triticum aestivum
  misc_feature (69)..(69): Xaa can be any naturally occurring amino acid
  misc_feature (84)..(84): Xaa can be any naturally occurring amino acid
  misc_feature (91)..(91): Xaa can be any naturally occurring amino acid
  misc_feature (102)..(102): Xaa can be any naturally occurring amino acid
  misc_feature (108)..(108): Xaa can be any naturally occurring amino acid
MAPTVMASSATSVAPFQGLKSTAGLPVSRRSNGASLGSVSNGGRIRCMQVWPIEGIKKFETLSYLPPLXTEGLLKQVDYLIRSXKWVPCLXFNKVGFIFREXNASPGXYDGRVGNVGKLNVSGGT

SEQ ID NO: 4325 - protein, 154 aa, Triticum aestivum
  misc_feature (127)..(127): Xaa can be any naturally occurring amino acid
  misc_feature (140)..(140): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDAXQVINEVEESRRSXPDAYVRSSDHNVGW

SEQ ID NO: 4326 - protein, 123 aa, Triticum aestivum
  misc_feature (76)..(76): Xaa can be any naturally occurring amino acid
  misc_feature (91)..(91): Xaa can be any naturally occurring amino acid
  misc_feature (95)..(95): Xaa can be any naturally occurring amino acid
  misc_feature (101)..(101): Xaa can be any naturally occurring amino acid
  misc_feature (107)..(107): Xaa can be any naturally occurring amino acid
MAPTVMASSATSVAPFQGLKSTAGLPVSRRSNGASLGSVSNGGRIRCMQVLAHRGHQEFETLSYLPPLSTEALLKXVDYLIRSKWVPCLQXNKVXFIFREXNASPGXYNGRIGMWKLLMFGVH

SEQ ID NO: 4327 - protein, 122 aa, Triticum aestivum
  misc_feature (68)..(68): Xaa can be any naturally occurring amino acid
  misc_feature (79)..(79): Xaa can be any naturally occurring amino acid
  misc_feature (91)..(91): Xaa can be any naturally occurring amino acid
  misc_feature (110)..(110): Xaa can be any naturally occurring amino acid
  misc_feature (115)..(115): Xaa can be any naturally occurring amino acid
MAPTVMASSATSVAPFQGLKSTAGLPVSRRSNGASLGSVSNGGRIRCMQVWPIEGIKKFETLSYLPTXSTTEALLKQVXYLIRSKWVPCLXFNKVGFIFREHNASPWVLXWPYWXMWKLLSG

SEQ ID NO: 4328 - protein, 141 aa, Triticum aestivum
  misc_feature (71)..(71): Xaa can be any naturally occurring amino acid
  misc_feature (76)..(76): Xaa can be any naturally occurring amino acid
  misc_feature (81)..(81): Xaa can be any naturally occurring amino acid
  misc_feature (97)..(97): Xaa can be any naturally occurring amino acid
  misc_feature (130)..(131): Xaa can be any naturally occurring amino acid
MAPTVMASSATSVAPFQGLKSTAGLPVSRRSNGASLGSVSNGGRIRCMQVWPIEGIKKFETLSYLPPLKHXGLLKXVDYLXSAPKWVPCLEFKQGGXTSREHNASPGVYDGRYWAMWKLPMFRCTDPTRXXQVEEARGYLT

SEQ ID NO: 4329 - protein, 183 aa, Triticum aestivum
  misc_feature (69)..(69): Xaa can be any naturally occurring amino acid
  misc_feature (119)..(119): Xaa can be any naturally occurring amino acid
MAPTVMASSATSVAPFQGLKSTAGLPVSRRSNGASLGSVSNGGRIRCMQVWPIEGIKKFETLSYLPPLXSTEALLKQVDYLIRSKWVPCLEFSKVGFIFREHNASPGYYDGRYWTMWKXLPMFGCTGPTGYSTKVEGGQKRSYPGRVISQSRIPTTRPCAFKFPPSSQPSGSPGKGKLHNANI

SEQ ID NO: 4330 - protein, 146 aa, Triticum aestivum
  misc_feature (139)..(139): Xaa can be any naturally occurring amino acid
  misc_feature (141)..(141): Xaa can be any naturally occurring amino acid
  misc_feature (143)..(143): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKXNXDXMSE

SEQ ID NO: 4331 - protein, 143 aa, Triticum aestivum
SLIAASARHYLLQPIIADHTTLESLDLTDADGQGVLTMDKWQLQELRVKPVSASGGSHRTLMPALSMRLWYAPHIELPGGLVLNGATLVAIKPTEEATRDTVGTGIAGSAGGCWVSDAFEEPYRTAVGMLLKRRTYSLEMNSF

SEQ ID NO: 4332 - protein, 338 aa, Triticum aestivum
  misc_feature (199)..(199): Xaa can be any naturally occurring amino acid
KDGAVLLGGLKEHLKTIRRSRRVVFIGCGTSYNAALAARTFVEELTGIPVTMEVASDLLDRQGPIYREDTAVFVSQSGETADTLLALDYALENGALCVGITNTVGSTLSRRTHCGIHINAGCEIGVASTKAYTSQIVVMAMMALAIGSDQISTQARREAIISGLFSLPSNASQVLKLDSEMKELASSLIDSESLLVFGXRGYNYATALEGALKVKEVALMHSEGMFAGEMKHGPLALVDENLPIIVIATRDACFSKQQSVIQQLLSRKGRLIIMCSKGDASAVNPGGSCRVIEVPKVADCLQPVINIIPLQLLAYHLTVLRGFDVDQPRNLAKSVTTQ

SEQ ID NO: 4333 - protein, 177 aa, Triticum aestivum
  misc_feature (119)..(119): Xaa can be any naturally occurring amino acid
  misc_feature (129)..(129): Xaa can be any naturally occurring amino acid
  misc_feature (145)..(145): Xaa can be any naturally occurring amino acid
  misc_feature (151)..(151): Xaa can be any naturally occurring amino acid
  misc_feature (155)..(156): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWNCXYFGCTDATQXDQRVEEVKKEYPDAYXRIIGFXTCAXXCVSSCLQHGLKIGRLTVTTAI

SEQ ID NO: 4334 - protein, 100 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEVQQRSGFIFR

SEQ ID NO: 4335 - protein, 511 aa, Triticum aestivum
AASSSSSPAASSSPRSDRGGIKSPWSRRKRKRVLSRQQWDGQFSANGKLRDGGKNVRKKVRSGGIEPGIRAEVWPFLLGVYDLNSSEEERNTIRAKKRKEYEKLRRQCQHILNGYRGSGLKSINEVNNEECSAQGSGAEGSESPCFEDVNVEKASRSLEEPKPEHSEAEQPEITMCDDVIESMEEDTSELIDAYPCIAESESSDSESSDEDDSGRISVCGEESCDPDPKFARSTSFKADIFRSSRTSEDFATWQRIIRLDAIRANAEWISFSRDQAEVPKEKALQSAASVGLKDFDHLEPHMIYHAARLVGLLEAYAIYDPEIGYCQGMSDLLSPIIAVMEEDDAAFWCFVGFMRKARHNFRLDEVGIKRQLKIVSQIIKRKDSHLYRHLQKLQAEDCFFVYRMVVVLFRRELTFEQTVCLWEVMWADQAAIRAGIGRTTWGKIRLHAPPTDDLLLYAIAACVLQRRKLIIEKYSSMDEILRECNSMAGQLDVWRLLDDAHDLVVNLHDKI

SEQ ID NO: 4336 - protein, 198 aa, Triticum aestivum
  misc_feature (60)..(60): Xaa can be any naturally occurring amino acid
GFAVYADRFVDPALGFSLGYTYWFKYIITTPNQLTAGALVISYWLPADRVNPGVWITIFXVLIVTINVLGIKYFGEIEFWLSSIKVLVILGLILLSLIIALGGADGDVRGFRYWNNPGAFNPYKGSGSWGRFLAVWQSMVTAVFAYLGTELVGVTVGEAQNPRKNVPRAIKLTFYRICVFYICSVILLGMCVPRPRPR

SEQ ID NO: 4337 - protein, 144 aa, Triticum aestivum
  misc_feature (90)..(90): Xaa can be any naturally occurring amino acid
  misc_feature (114)..(114): Xaa can be any naturally occurring amino acid
  misc_feature (127)..(127): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLXVQQVGFIFREHNASPGYYEGRYWXMWKLPKFGVTDAXQVINKVEEARRIPDRFR

SEQ ID NO: 4338 - protein, 120 aa, Triticum aestivum
  misc_feature (72)..(72): Xaa can be any naturally occurring amino acid
  misc_feature (86)..(86): Xaa can be any naturally occurring amino acid
  misc_feature (95)..(95): Xaa can be any naturally occurring amino acid
MAPTVMASSATSVAPFQGLKSTAGLPVSRRSNGASLGSVSNGGRIRCMQVWPIEGIKKFETLSYLPPLSTEXLLKQVDYLIRSKWXPCLDSASWXIFREHNALLGTTMAYWHVELPISVH

SEQ ID NO: 4339 - protein, 165 aa, Triticum aestivum
  misc_feature (58)..(58): Xaa can be any naturally occurring amino acid
  misc_feature (72)..(72): Xaa can be any naturally occurring amino acid
  misc_feature (76)..(76): Xaa can be any naturally occurring amino acid
  misc_feature (81)..(81): Xaa can be any naturally occurring amino acid
  misc_feature (100)..(100): Xaa can be any naturally occurring amino acid
  misc_feature (109)..(109): Xaa can be any naturally occurring amino acid
  misc_feature (111)..(111): Xaa can be any naturally occurring amino acid
  misc_feature (123)..(123): Xaa can be any naturally occurring amino acid
  misc_feature (130)..(130): Xaa can be any naturally occurring amino acid
MAPTVMASSATSVAPFQGLKSTAGLPVSRRSNGASLGSVSNGGRIRCMQVWPIEGIKXFETLSYLPPLSTEXLLKXVDYLXRSKWVPCLQFNKVGFIFPXAQPSPGYYXGXYWTIWNCLCSGXTEATQVXTSGRSRRIPDPIPITVSQVILTHPQLKIRKLITSI

SEQ ID NO: 4340 - protein, 174 aa, Triticum aestivum
  misc_feature (98)..(98): Xaa can be any naturally occurring amino acid
  misc_feature (109)..(109): Xaa can be any naturally occurring amino acid
  misc_feature (120)..(120): Xaa can be any naturally occurring amino acid
  misc_feature (124)..(124): Xaa can be any naturally occurring amino acid
  misc_feature (141)..(141): Xaa can be any naturally occurring amino acid
  misc_feature (150)..(150): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLDSTSWFIFXREHNASPGVLXDGGYWTMWNCXYFGXTGPTQVINEVEESKKDXPDAYFRIIXSTTSSRAWLNSSPTGSKIRKAKYH

SEQ ID NO: 4341 - protein, 178 aa, Triticum aestivum
  misc_feature (101)..(101): Xaa can be any naturally occurring amino acid
  misc_feature (138)..(138): Xaa can be any naturally occurring amino acid
  misc_feature (157)..(157): Xaa can be any naturally occurring amino acid
  misc_feature (161)..(161): Xaa can be any naturally occurring amino acid
  misc_feature (168)..(168): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREXHNASPGYYDGRYWDNVGSCLCSGGTDATKGVQRRWRXAKKGLPDAFVRIIGFQKHXQVQXVRFIASXQPGWKESRKG

SEQ ID NO: 4342 - protein, 122 aa, Triticum aestivum
  misc_feature (40)..(40): Xaa can be any naturally occurring amino acid
  misc_feature (117)..(117): Xaa can be any naturally occurring amino acid
MAPTVMASSATSVAPFQGLKSTAGLPVSRRSNGASSAASXNGGRIRCMQVWPIEGIKKFETLSYLPPLSTEALLKQVDYLIRSKWVPCLEFSKVGFIFREHNASPGYYDGRYWTMWXLPMFG

SEQ ID NO: 4343 - protein, 128 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQ

SEQ ID NO: 4344 - protein, 336 aa, Triticum aestivum
MGIDRVNTAATGRGRTVCVTGAGGFIASWLVKLLLEKGYAVHGTVRNPDDVARNAHLRALEGATERLTLFQVDLLDKESLVAAFQGCEGVFHTACPVTDDPEKMIEPAVNGTRNVFNAAAEVGGIRRVVMTSSIGSVYMDPRRSIDGEADETCWSDLEFCKNTKNWYCYAKTVAEQAAWELAKERKLDLVVINPSLVLGPLLQMAVNASTWHIAKYLDGSVQTYANAAQAYVHVQDVADAHARAYETPDAHGRYLCAGRTLHRAEVCRILAKFFPEYPVPTRCKEGAGEMKKGCRFSSRRIMDLGVGITPASQCLYDTVTSLQDKGILPRRDADMS

SEQ ID NO: 4345 - protein, 513 aa, Triticum aestivum
  misc_feature (22)..(22): Xaa can be any naturally occurring amino acid
VARKSVFRVQFRQSGNWTQFPXKIVRLAKVDFRTRKTMTEGGYQNQLFLLDFVHMTFIDSKSGLQRPIAWIDDNGRRYFPEVLIEDQIVYRRKDLGNGDHVYVRAEPNGAREINDQYGASESSAESSNFESSTEEVSSDKRVRAEKGIIRKINCDHRETVGENEPHTSLPAVFSCQPQQDKLGGQSRAQGTTSVVQKMLLQGMGTAIGSKDIIGIHRTPFLNNYREDRYNLFQKQAEITKSQHGNANVRYAWLPCSKAAVDEMMLNGTLQIKKPTRCPPYGTGVLLAPANCSINCVNYSDVDENGIIYMMLCRVVMGNVEIVHHGSKQHQPSNEYFDSGVDDLKNPQHYIVWDMNLNSHIYSEFVVTIKLPSKAKDSLFTQEDCQDSSDASLVLSPSSADSVSQDMNLEASPALGGQYEAPMLGGSMAKAPSTPWMPFSMLFAAISTKLPREKMDMINNCYEEFKAKKISRIDLVKRLRLIVGDRMLVSTIIRLQDKLPPMVKREAADAPAKA

SEQ ID NO: 4346 - protein, 594 aa, Triticum aestivum
MAAMNEKVLAKCGQNIVSLKRKRDSPAAYHADACHTSQSHQHPTGNSDIRLYVGEDRKANIACHFNKQILQSYQNYMTSASPKRILLRQSGNWKEFPEKIVKLAQVDFRTKKTITEVGYQNQLFLLDFVHMTFIDSKSGLQRPIAWIDDNGRRYFPEVLIEDQIVYRRKDLGNGDHVYVRAEPNGAREINDQYGASESSAESSNFESSTEEVSSDKRVRAEKGIIRKINCDHRETVGENEPHTSLPAVFSCQPQQDKLGGQSRAQGTTSVVQKMLLQGMGTAIGSKDIIGIHRTPFLNNYREDRYNLFQKQAEITKSQHGNANVRYAWLPCSKAAVDEMMLNGTLQIKKPTRCPPYGTGVLLAPANCSINCVNYSDVDENGIIYMMLCRVVMGNVEIVHHGSKQHQPSNEYFDSGVDDLKNPQHYIVWDMNLNSHIYSEFVVTIKLPSKAKDSLFTQEDCHDSSDASLVLSPSSADSVSQVRFFTLGASPALGGQYEAPMLGGSMAKAPSTPWMPFSMLFAAISTKLPREKMDMINNCYEEFKAKKISRIDLVKRLRLIVGDRMLVSTIIRLQDKLPPMVKREAADAPAKARGQ

SEQ ID NO: 4347 - protein, 178 aa, Triticum aestivum
  misc_feature (143)..(143): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYLTXVVRIIGFTTSQVQCVSHRKQRAARSGRLNSHHTAH

SEQ ID NO: 4348 - protein, 216 aa, Triticum aestivum
MSADELRLDLEELRRLEGLAKRPRVVSLLSNEIRSVDAKLASRAAPVPTPAPRAVAAAAAPAGLSYVTLGSFSWDQDNEKIRVYVFLENVDQDKVETTFKPMSVDIKFHDVKGKNYRCAIPKLNKEIVPEKCKIVVKPTKIVITLWKASTGNWLDLHYKEDKFKPSMDKEKDPMSGIMDLMKGMYEEGDEDMKRTIAKAWSDARSGKTADPMRGLP

SEQ ID NO: 4349 - protein, 139 aa, Triticum aestivum
  misc_feature (61)..(61): Xaa can be any naturally occurring amino acid
  misc_feature (68)..(68): Xaa can be any naturally occurring amino acid
  misc_feature (87)..(87): Xaa can be any naturally occurring amino acid
  misc_feature (90)..(90): Xaa can be any naturally occurring amino acid
  misc_feature (111)..(111): Xaa can be any naturally occurring amino acid
  misc_feature (117)..(117): Xaa can be any naturally occurring amino acid
  misc_feature (120)..(120): Xaa can be any naturally occurring amino acid
  misc_feature (123)..(123): Xaa can be any naturally occurring amino acid
  misc_feature (130)..(130): Xaa can be any naturally occurring amino acid
MLKGVTPELSCPIVLFTYYNPILKRGVGNFMSTIKQAGIHGLVVPDLPLEETALLRSEAIXMHNIELXVLLTTPTRPTVRMKGNCTXFRXFLLPCDAVRVTGARSKCNLRXVKHLPXGDXKKXTNKPVLXVPVLPTPNI

SEQ ID NO: 4350 - protein, 286 aa, Triticum aestivum
MDTPHTRTNTAVQMASPSSSLCSSLGYPRAASLGARRRAGFSSSRKLFQVKASRVDSFSKSDIIVSPSILSANFAKLGEQVKAVEVAGCDWIHVDVMDGRFVPNITIGPLIVDALRPVTDLPLDVHLMIVEPEQRIPDFIKAGADIVSVHCEQTATIHLHRTVDQIKSLGAKAGVVLNPGTPLSAIEYVLESVDLVLIMSVNPGFGGQSFIESQVKKIADLRKLCEEKGVNPWIEVDGGVSPKNAYKVIEAGANALVAGSAVFGAKDYAEAIKGIKTSKRPVAVAA

SEQ ID NO: 4351 - protein, 193 aa, Triticum aestivum
  misc_feature (117)..(117): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLRFKQVGSSSREHNASLGYYDGRYWDMWXLPISGAPTHTSVNEVEESRRIPDAYSASSDRHIASACVSSCLNHGLKIRKANSYHTGIINAFSLHPKCLVPLLLMS

SEQ ID NO: 4352 - protein, 212 aa, Triticum aestivum
  misc_feature (69)..(69): Xaa can be any naturally occurring amino acid
  misc_feature (76)..(76): Xaa can be any naturally occurring amino acid
  misc_feature (83)..(83): Xaa can be any naturally occurring amino acid
  misc_feature (102)..(102): Xaa can be any naturally occurring amino acid
  misc_feature (118)..(118): Xaa can be any naturally occurring amino acid
  misc_feature (141)..(141): Xaa can be any naturally occurring amino acid
MAPTVMASSATSVAPFQGLKSTAGLPVSRRSNGASLGSVSNGGRIRCMQVWPIEGIKKSETLSYLPPLXSTEALLXKQVDYLXIRSKWVPCLEFSKVGFIFXREHNASPGYYDGRYWXTMWKLPMSGCTDATQVVNEVEEXKKEYPDPYSAHRVHNIASASSAHRLNQPAARSGRLNTHHDSILNANLQMLGFHYFYCPKRFLGLSMAKQPL

SEQ ID NO: 4353 - protein, 112 aa, Triticum aestivum
  misc_feature (91)..(91): Xaa can be any naturally occurring amino acid
  misc_feature (102)..(102): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEXFNKVGFIFREXHNASPGYRWG

SEQ ID NO: 4354 - protein, 163 aa, Triticum aestivum
  misc_feature (77)..(77): Xaa can be any naturally occurring amino acid
  misc_feature (87)..(87): Xaa can be any naturally occurring amino acid
  misc_feature (94)..(94): Xaa can be any naturally occurring amino acid
  misc_feature (103)..(103): Xaa can be any naturally occurring amino acid
  misc_feature (112)..(112): Xaa can be any naturally occurring amino acid
  misc_feature (118)..(118): Xaa can be any naturally occurring amino acid
  misc_feature (120)..(121): Xaa can be any naturally occurring amino acid
  misc_feature (125)..(125): Xaa can be any naturally occurring amino acid
MAPTVMASSATSVAPFQGLKSTAGLPVSRRSNGASLGSVSNGGRIRCMQVWPIEGIKKFETLSYLPPLKHGGLLKAXSDYLIRSKWXVPCLQFXSKVGSSSRXAQRIPLGYXDGRYWXMXXLPSXGCTDPTSDRGGSQRRYTFRITVIASCSIALTTGASPEG

SEQ ID NO: 4355 - protein, 144 aa, Triticum aestivum
  misc_feature (13)..(13): Xaa can be any naturally occurring amino acid
  misc_feature (33)..(33): Xaa can be any naturally occurring amino acid
  misc_feature (47)..(47): Xaa can be any naturally occurring amino acid
  misc_feature (66)..(66): Xaa can be any naturally occurring amino acid
  misc_feature (74)..(75): Xaa can be any naturally occurring amino acid
  misc_feature (83)..(83): Xaa can be any naturally occurring amino acid
  misc_feature (87)..(87): Xaa can be any naturally occurring amino acid
WPRPTSVAPFQGXLKSTAGLPVKPPAPTGLASXGVSNGGRIRCMQVXWPIEGIKKFETLSYLPPLXSTEALLKXXSDYLIRSXWGAXPSEFSKGLGFIFREAQTQSPGVLTMGRVLQMWELALCFGADGHGESERWAEGKGSNP

SEQ ID NO: 4356 - protein, 516 aa, Triticum aestivum
  misc_feature (35)..(35): Xaa can be any naturally occurring amino acid
  misc_feature (151)..(151): Xaa can be any naturally occurring amino acid
  misc_feature (177)..(177): Xaa can be any naturally occurring amino acid
DMVDSAPGGPCTAVEVKEIIALSASANKLSKIKEXADEYAALIMEELDPKNLGYIELESLESLLLQTPSEAVARSTITHSSKLSKALSMRLAPSKDTSPLRHYWLQFTFFVQENWKRIWVAALWLSICIALFIWKFIQYRNRAGFNILWFXHHLFAIVYALLIVHPRSLYLTRNTVXKSTWMYIAYPVFLYSCERIVRLFRRHDSVKIQKVAVYPGNVLALYMSKPPGFKYRSGQYIFINCGAVSPYEWHPFSVTSAPGDNYLSVHIRTRGDWTSRLRTVFSEACRPPTEGESGLLRADLSVGITDSNARFPKLMIDGPYGAPAQDYREYDVLLLIGLGIGATPLISIVKDVLNHIQRGESVGGTEPDGSGKAKKKPFMTKRAYSYWVTREEGSFEWFRGVMNEVAEKDKDGVIELHNHCSSVYQEGDARSALIVMLQELNHAKKGVDILSGTSVKTHFARPNWRSVFKRIAVNHENQRVGVFYCGEPVLVAQLRQLSADFTHNTNTKFDFHKENF

SEQ ID NO: 4357 - protein, 251 aa, Triticum aestivum
TLFLSLLLLSLSLSISCRTAEEWRTRSIYQIITDRFARTDKEATPCSDLGNYCGGTFKGIENNLDYIQGMGFDAIWISPVVANTPGGYHGYWVSNLYTINEEFGTEEELHQLIEACHARDIWVMVDVVANHIGYVQNLDFSAIVPFNDIAYFNEDKDCAPFFEIMDQDGIETCWLSGLPDLNQNHPFVKSTLIAWIKEFVQKHKFDALRIDTIAHVPKQFWHEFSKAAGVYTIGEALNHNMHYISQYQGPL

SEQ ID NO: 4358 - protein, 148 aa, Triticum aestivum
  misc_feature (79)..(79): Xaa can be any naturally occurring amino acid
YWCSSKRLRLSDSMETYTTDDALSAMGFGKFQALVLAYAGMGWVVEAMELNLLSFVGPLVREEWQVSAQDESLLSSVVXYGRSAAVPSSALPPSALGGGGARPPCFPRFVALRFLVGVGVGGGHVFSSWFLEFVPAQNRGTCVVLFSL

SEQ ID NO: 4359 - protein, 140 aa, Triticum aestivum
  misc_feature (85)..(85): Xaa can be any naturally occurring amino acid
  misc_feature (88)..(88): Xaa can be any naturally occurring amino acid
  misc_feature (106)..(106): Xaa can be any naturally occurring amino acid
  misc_feature (109)..(109): Xaa can be any naturally occurring amino acid
  misc_feature (118)..(118): Xaa can be any naturally occurring amino acid
  misc_feature (131)..(131): Xaa can be any naturally occurring amino acid
  misc_feature (133)..(133): Xaa can be any naturally occurring amino acid
  misc_feature (139)..(139): Xaa can be any naturally occurring amino acid
LFLAFTGLQANQGLGMVGASPSTLVTLTACSQTDPVTGACLGGTLHSPTFWLGVAGFLVTATCLARDVKGAMIYGIVFVTAVSWXKRXPSVTVFPDTPAGNAGFSXFKXVVDFHMIKXTGGQLNFGGFRHXNXWLAISXL

SEQ ID NO: 4360 - protein, 413 aa, Triticum aestivum
  misc_feature (166)..(166): Xaa can be any naturally occurring amino acid
MYLVKDIGGAIGLMAAALVLLGTWPVVLAVLERRGRLPQHTYLDYSITNFLAAVLIALTFGQIGGDTPETPNFLTQLTRPQDYWPSIMFALAGGVVITLGTVATQYGWAYVGLSVTEVMASSLKVVIGTTLNYFLDGRINRAEVLFPGVGCFLIAACLGSLVHSSXAADNQEKAINSRNSTGNTAKEDLTQHLLEDEEPKDCEEAKPALPNNKAVEKAEAGTADFLIDLEDKRSIKVLGSNTLVGLAIVTFAGVCYSLFAPAFNLATNDQWHTLRDGVPHLVVYTAYFYFCLSSLAVGVALNVWCLYRPVAGVPRSTLRAYVADGEGRGLALLAGLVSGLGNAFTFMAGLAAGSEAVDDVQPLPLVSTFWGVVLFGEYRRSSRRTYTLLGSMLFMFVVAMAVLMASSAHRKPL

SEQ ID NO: 4361 - protein, 178 aa, Triticum aestivum
  misc_feature (15)..(15): Xaa can be any naturally occurring amino acid
MARILDLLLKEMDPXKICSLVGLCTPDGTQGVRAGSRSVLDHEGGRSNDVMCHACEMAVVWMTNQLAKNQTQDLIFKYINQLCDRIPSPMGESSVDCGRLASMPDIAFSIGGKQFVLTPEQYILKIGEGDATQCISGFTAMDIPRPRGPLWILGDIFMGAYHTVFDYGNMKIGFAKAA

SEQ ID NO: 4362 - protein, 503 aa, Triticum aestivum
MVATAKIPQRQLFIDGDWRAPALGRRLPVINPTTEASIGEIPAGTSEDVDAAVAAARAALRRNRGRDWARAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASVTCLELGDVCKEIGLPSGVLNIVTGLGHEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRDRCQRLAEEIDAGCIWVNCSQPCFCQAPWGGNKRSGFGRELGEGGIDNYLSIKQVTEYTSDAPWGWYKAPAN

SEQ ID NO: 4363 - protein, 288 aa, Triticum aestivum
  misc_feature (94)..(94): Xaa can be any naturally occurring amino acid
  misc_feature (136)..(136): Xaa can be any naturally occurring amino acid
  misc_feature (170)..(170): Xaa can be any naturally occurring amino acid
  misc_feature (210)..(210): Xaa can be any naturally occurring amino acid
  misc_feature (228)..(228): Xaa can be any naturally occurring amino acid
AADNPEIGLMGSCVLVMLMKGENVYVMNVGNSRAVLARRPEPNLDNILGKATEKDLQQLKAEIMDGLQSVQLNAEHSTSVEEEVKRIKAEHNDXATPSSTARVKGKLNVTRAFGAGYLKEPKWNSMLLGCFKIDYXGKGPYINCIPSLHHHRIGPNDKFLVLSSDGLYQXYFTNKEVVDEVEMFTAAYPKGNPAEHLVREVLLRAAREGXGLDYHELLNISHDERREXYNDDVSVIVISVQRGSSGSTTAEGSWLAVPRESCPHNAESPGPKWIVLVVCLCNKVSRQW

SEQ ID NO: 4364 - protein, 81 aa, Triticum aestivum
MSTTAHKVATQAASAAGARMKGRRPPSVVREIVYGMSLGLFAGYLWKLHHWSNQRRTREFYALLDEGRITVVVDEPAGAKD

SEQ ID NO: 4365 - protein, 233 aa, Triticum aestivum
  misc_feature (85)..(85): Xaa can be any naturally occurring amino acid
VGNRDGRQVQVVADQFMRAGLYDGWLPHLFVGNLLKGQTVGVIGAGRIGSAYARMMIEGFKMNLIYFDLYQSTRLEKFVTAFGPXLKANGEQPVTWKRASSMEEVLREADVISLHPVLDKTTYHLINPERLAMMKKEAVLVNASRGPVIDEVALVEHLRANPMFRVGLDVFEDEPYMKPGLAEMRNAVVVPHIASASKWTREGMATLAALNVLGKIKGYPVWGNPNAVEPFLD

SEQ ID NO: 4366 - protein, 172 aa, Triticum aestivum
CYSSSLPSPPSIPPAACSIFLTTAAASSPLCARGSSIRLLSQMEMPTGSSQAGGRFPVPHRSLSLDIKGNKTDIVISKYEDNFLVIVTQIGCMGTILAAKKDESVFSDPTYNVSVLFGKRDEPLLLACARQLIEHISGSGSARPLVISLGLKDHSQGTLKDVVSAIVDNRLW

SEQ ID NO: 4367 - protein, 120 aa, Triticum aestivum
  misc_feature (69)..(69): Xaa can be any naturally occurring amino acid
  misc_feature (86)..(86): Xaa can be any naturally occurring amino acid
  misc_feature (108)..(108): Xaa can be any naturally occurring amino acid
MCGIFGYINYLVEKDRKYILDTLINGLQRLEYRGYDSAGLAIDGDKKNEVYAVKEVGKVASLKKLVEEXNFDLNKVFDSQRRVSPXTRWGNQRSPNRRVQLASPKGPXPNWGPPFVQKWV

SEQ ID NO: 4368 - protein, 339 aa, Triticum aestivum
  misc_feature (13)..(13): Xaa can be any naturally occurring amino acid
  misc_feature (27)..(27): Xaa can be any naturally occurring amino acid
  misc_feature (32)..(32): Xaa can be any naturally occurring amino acid
  misc_feature (38)..(38): Xaa can be any naturally occurring amino acid
  misc_feature (54)..(54): Xaa can be any naturally occurring amino acid
  misc_feature (113)..(113): Xaa can be any naturally occurring amino acid
  misc_feature (213)..(213): Xaa can be any naturally occurring amino acid
  misc_feature (257)..(257): Xaa can be any naturally occurring amino acid
MAFALNASCYPSXFQSSLLPRRMAAAXVMIPXRRRNVXPVIRAVAVAPPAPAPXAKPAAVRSRPVSVTMAKLMAKGKTALIPYITAGDPDLATTAEALHLLDACGADVIELGXVPCSDPLSWYCAVQPGLGIAEGLSLAAAAVGRPCLRWVNEVAAGGDAWAAAVAENEEALVLWSREKPDLMRIARCKTDRNAHRLWPLIAVACICWLNAKXDQSRVWRSPTMPAIPERENLGGSRKASAGVIYLVSINVVTGPPXNIVGLRLKSLIRQSRKGHWTTLLLLVFVISEPHARIAESSLELRYGLIIGSGLVKHWGHAASPSLGLRRLQASGRSMEHARP

SEQ ID NO: 4369 - protein, 172 aa, Triticum aestivum
MVNRYLPFFQGVVLNQATPTHHPIPGNGNVAVNFDDEPPLLEELDIDTGLIWRKAVSILHPLRSVDPSLHAEADLSGPALILLSLAFFQLLAGKLHFGIVLGWATAASVFLYFISSMLLSPGRGGRGDLSLYRCASLLGYSIMSMTIFSAVSLFLPRGGGLIFAVGMGFVPR

SEQ ID NO: 4370 - protein, 111 aa, Triticum aestivum
  misc_feature (76)..(76): Xaa can be any naturally occurring amino acid
MAAAGGVSTDDVPILQAENLTSNVKSVYYSRTFLSIIGGVVAGIWGFTGLMGFVFYFLIMMVASIGLLAKSKFSSXAYFDSWTRISIEGVFGGLMSFVLFWTFAYDIVHIF

SEQ ID NO: 4371 - protein, 291 aa, Triticum aestivum
  misc_feature (24)..(24): Xaa can be any naturally occurring amino acid
  misc_feature (144)..(144): Xaa can be any naturally occurring amino acid
MAKDIEAVPPGGEYGAKDYSDPPXAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGXVGLVKGFQSAFYVRYGGGANELSSGFSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRASATKLGSSASFGRN

SEQ ID NO: 4372 - protein, 161 aa, Triticum aestivum
MAAGDGEPVLQSKSVCVVGGGMAGLAAARELRREGHAVAVMEQSSDVGGQWLYDPRTDVEDPLGAAVPVRVPSSIYACLRLISPREAIGFSDFQFLPSQGAGRDPRRFPGHREMHCYLQDFCDAFGLMDAVRLNTRVLRVALTAMSTSKATRRWAVRSVRR

SEQ ID NO: 4373 - protein, 75 aa, Triticum aestivum
CEGGLDMWEVRCVCGARDDDGERMVACDACDVWHHTRCVGLADSDAVPPLFLCILCGGALLAAGPMLEEALTLAK

SEQ ID NO: 4374 - protein, 162 aa, Triticum aestivum
  misc_feature (94)..(94): Xaa can be any naturally occurring amino acid
  misc_feature (118)..(119): Xaa can be any naturally occurring amino acid
  misc_feature (129)..(129): Xaa can be any naturally occurring amino acid
  misc_feature (137)..(137): Xaa can be any naturally occurring amino acid
  misc_feature (142)..(142): Xaa can be any naturally occurring amino acid
  misc_feature (153)..(153): Xaa can be any naturally occurring amino acid
  misc_feature (158)..(158): Xaa can be any naturally occurring amino acid
NFEEVDFDRTDAVDKVMDDFDTSRNDVVEEEEFVQGMRKWLDEARRSVPVGGAFSSKFIHEYHERTRQEHDELVDRSDEAVESVENPGWCIAKXVALLLLGSAAAAAFADPLVDAVHXXSNATRIPSFXLLIALPLXTIQRXSRIIFATRRTXDCPSXSEVY

SEQ ID NO: 4375 - protein, 145 aa, Triticum aestivum
  misc_feature (70)..(70): Xaa can be any naturally occurring amino acid
  misc_feature (74)..(74): Xaa can be any naturally occurring amino acid
  misc_feature (94)..(94): Xaa can be any naturally occurring amino acid
  misc_feature (107)..(107): Xaa can be any naturally occurring amino acid
  misc_feature (109)..(109): Xaa can be any naturally occurring amino acid
  misc_feature (112)..(113): Xaa can be any naturally occurring amino acid
  misc_feature (116)..(116): Xaa can be any naturally occurring amino acid
  misc_feature (127)..(127): Xaa can be any naturally occurring amino acid
  misc_feature (133)..(133): Xaa can be any naturally occurring amino acid
  misc_feature (138)..(138): Xaa can be any naturally occurring amino acid
FVKAPGGAPANVAIAVARLGGGAAFVGKLGDDEFGRMLAKILRDNGVDAGGVVFDPGARTALAFVTLRAXGERXSCSNRNPSADMLLTAERVKXRLIKEGCIFHYGXIXLIXXACXTTHLTHEVAKXAGASLXYDPNXRRILASL

SEQ ID NO: 4376 - protein, 118 aa, Triticum aestivum
  misc_feature (7)..(7): Xaa can be any naturally occurring amino acid
  misc_feature (10)..(10): Xaa can be any naturally occurring amino acid
  misc_feature (16)..(16): Xaa can be any naturally occurring amino acid
  misc_feature (38)..(39): Xaa can be any naturally occurring amino acid
  misc_feature (44)..(44): Xaa can be any naturally occurring amino acid
  misc_feature (52)..(52): Xaa can be any naturally occurring amino acid
  misc_feature (62)..(62): Xaa can be any naturally occurring amino acid
  misc_feature (79)..(80): Xaa can be any naturally occurring amino acid
  misc_feature (83)..(83): Xaa can be any naturally occurring amino acid
  misc_feature (90)..(90): Xaa can be any naturally occurring amino acid
  misc_feature (98)..(98): Xaa can be any naturally occurring amino acid
  misc_feature (105)..(107): Xaa can be any naturally occurring amino acid
  misc_feature (110)..(110): Xaa can be any naturally occurring amino acid
  misc_feature (114)..(114): Xaa can be any naturally occurring amino acid
MAPAVTXSSXTTVAPXQGLKSTAGLPVSRRTSASLGSXXNGGRXRCMQVWPXEGIKKYETLXYLPPLATEALLKQVDYXXRSXWVPCLEXARWLRFRXHNSPPGXXXGRXWTMXKHGA

SEQ ID NO: 4377 - protein, 121 aa, Triticum aestivum
  misc_feature (57)..(57): Xaa can be any naturally occurring amino acid
  misc_feature (65)..(65): Xaa can be any naturally occurring amino acid
  misc_feature (75)..(75): Xaa can be any naturally occurring amino acid
  misc_feature (92)..(92): Xaa can be any naturally occurring amino acid
  misc_feature (98)..(98): Xaa can be any naturally occurring amino acid
  misc_feature (101)..(102): Xaa can be any naturally occurring amino acid
  misc_feature (108)..(108): Xaa can be any naturally occurring amino acid
  misc_feature (114)..(115): Xaa can be any naturally occurring amino acid
MSGVKKVTDVAAKAGKAIDWDGLAKILVSDEARKDFANLRRTSEDVNHQLQDQFSQXEPKAIDWXEYYKKGFGFXSCWYFKELNDTFRFPKXFTLSPXNIXXFDALFXQIKEQXXNLFKDQ

SEQ ID NO: 4378 - protein, 423 aa, Triticum aestivum
  misc_feature (199)..(199): Xaa can be any naturally occurring amino acid
  misc_feature (207)..(207): Xaa can be any naturally occurring amino acid
  misc_feature (217)..(217): Xaa can be any naturally occurring amino acid
SFSLPPPPPSPAAPLTGTRYQAGSRRPAPRRPAWPPPPRTARLLVPSPVPLLSLSPDPLWRLVAWLGWLLNPGPTVATADAWATQCPSGVFATSRCNLKIESLDNVFGRISQCVVWYSDVVFARILQNASVYALASGQVIAGVVTKVGTDVNGFKVGNHVAVWKYVNSCRDCDNCNSFLEKNLSKFVCTKHGLYQVGAXRLDNSDVXIAVPKRYSYXVHYGYRVGKAAPLVCAGITMYTPMMRHNMKQPGKSLGVVGLGGLGHMAVKFGKAFGLKVTVLSTSESKREEAISLLGADNFVVSSDKSQMESLKNSLDFIVDTASGDHPFDPYLALLKVGGIMALVGFPGEIRVHPATLNLGARTLSGSVTGGTKDTQEMINFCTANKIYPDIELIKIDYINEALERLVNRDVRYRFVIDIESSLK

SEQ ID NO: 4379 - protein, 168 aa, Triticum aestivum
MAALPLATAEVCDANSHLITGGELRALQPIFQIYGRRQVFAGPVVTLKVFEDNVLVREFLEEKGQGRVLVVDGGGSLRCAILGGNPVQQAQNNGWAGIVVNGCIRDVDEINGCDIGVRALASHPMKANKKGMGEKHVPVTIAGTRICDGEWLYADTDGILVSRTELIV

SEQ ID NO: 4380 - protein, 100 aa, Triticum aestivum
  misc_feature (42)..(42): Xaa can be any naturally occurring amino acid
  misc_feature (51)..(51): Xaa can be any naturally occurring amino acid
VNEFHQGLSLYTDSWTGTPYTGPTIHSVLTGKHLLTKYDYVXHGKLYKISXEDNSSKDKGPTKVEIYASFGGLLMLLKGDPSSAANLELDQRLFLLIRKV

SEQ ID NO: 4381 - protein, 199 aa, Triticum aestivum
  misc_feature (104)..(104): Xaa can be any naturally occurring amino acid
  misc_feature (127)..(127): Xaa can be any naturally occurring amino acid
  misc_feature (140)..(140): Xaa can be any naturally occurring amino acid
  misc_feature (147)..(147): Xaa can be any naturally occurring amino acid
  misc_feature (161)..(161): Xaa can be any naturally occurring amino acid
  misc_feature (167)..(167): Xaa can be any naturally occurring amino acid
GGGGARGRGGGGARGGAKTIVEPHRHPGIFVARGKEDMLVTKNLSPGESVYGEKRISVENSGPTNEDGTPSTTKTEYRVWNPFRSKLAAGVLGGLDEIFIKPGXKVLYLGFCLRVPPVSHVADIVGXTGTVFAVEFSHRXPGRDLIXMATHRTNVIPIIEXDARHPXRYRMLAPMVDVIPASSSPTPLWFNPIFIGGDH

SEQ ID NO: 4382 - protein, 306 aa, Triticum aestivum
PRVRAAVTRSRSLARLRAQRDFLRATALAAAAGPFRSISDLPLLAHAIATFLSMYPDYASTSDVDRLRLDHYSHLDAPGAGRVCLDYCGFGLFDSSWDSSSSFTLSELNANLSNHALYGGAEPGTAENDIKERILEYLNVPASEYALVFTVSRGSAFKLLAECYPFENNRRLLTTSHPAGQSVNWMAQSARAKGAKTRTAWFRWPTLKLCSTELRKEIVGKRKARRRDAAVGLFVFPAQSRVTGAKYSYQWMALAQQNGWHVMLDAGALGPKDMDSLGLSLFRPDFIITSFYRVFGSDPTGFGCLL

SEQ ID NO: 4383 - protein, 137 aa, Triticum aestivum
GSIPESLYTNGGLKLRVVWTISSLIAAATRHYLLREIVKEHPTLERVALTDAGGQGTLSMGRDQLREFRDRPLAAAPAAAANRTQVPACNMKLRYAPLLELSDGTRIHGATLVVIKARRRRRRERTRTSGAGAFDGP

SEQ ID NO: 4384 - protein, 153 aa, Triticum aestivum
  misc_feature (6)..(6): Xaa can be any naturally occurring amino acid
  misc_feature (14)..(14): Xaa can be any naturally occurring amino acid
  misc_feature (22)..(22): Xaa can be any naturally occurring amino acid
  misc_feature (24)..(24): Xaa can be any naturally occurring amino acid
  misc_feature (29)..(30): Xaa can be any naturally occurring amino acid
  misc_feature (36)..(36): Xaa can be any naturally occurring amino acid
  misc_feature (41)..(41): Xaa can be any naturally occurring amino acid
  misc_feature (47)..(47): Xaa can be any naturally occurring amino acid
  misc_feature (49)..(49): Xaa can be any naturally occurring amino acid
  misc_feature (54)..(54): Xaa can be any naturally occurring amino acid
  misc_feature (57)..(58): Xaa can be any naturally occurring amino acid
  misc_feature (62)..(62): Xaa can be any naturally occurring amino acid
  misc_feature (85)..(85): Xaa can be any naturally occurring amino acid
  misc_feature (106)..(106): Xaa can be any naturally occurring amino acid
  misc_feature (112)..(112): Xaa can be any naturally occurring amino acid
  misc_feature (114)..(114): Xaa can be any naturally occurring amino acid
  misc_feature (121)..(121): Xaa can be any naturally occurring amino acid
  misc_feature (126)..(126): Xaa can be any naturally occurring amino acid
  misc_feature (129)..(129): Xaa can be any naturally occurring amino acid
  misc_feature (131)..(131): Xaa can be any naturally occurring amino acid
  misc_feature (137)..(137): Xaa can be any naturally occurring amino acid
  misc_feature (143)..(144): Xaa can be any naturally occurring amino acid
EIQATXSAGSLAEXPVPVAAGXRXLSVSXXMSKVMXKGKTXLIPYIXAXDPDLXTTXXALRXLDALGADVVELGMPFSDASADGXVIKDSAARALAAGATADAIMXMLKEVXPXLSCPVGXFSYFXPIXQXGMGSFXPPVKEXXGERYNNPFL

SEQ ID NO: 4385 - protein, 122 aa, Triticum aestivum
  misc_feature (75)..(75): Xaa can be any naturally occurring amino acid
  misc_feature (92)..(92): Xaa can be any naturally occurring amino acid
  misc_feature (101)..(101): Xaa can be any naturally occurring amino acid
ASAISVDDNRVGLLYKHVFPPILAPHISFIGLPFRTIPFLVFQLQSKWVAGVLSGRLELPSQEAMMRDVDAFYSXWKLRGCPKRRTHDLGTXYPLEYEDWXAERCGLGRMEGWRRDMFLATC

SEQ ID NO: 4386 - protein, 263 aa, Triticum aestivum
  misc_feature (101)..(101): Xaa can be any naturally occurring amino acid
GRGAGLTISPQGNSYEPLGPILGTNYRTRLDTKAGLVTGPEFPGISSPRVRDWSTRTLTWTEIESRSSSITFTSVQEESEVKLEAERSEAGRSGKRARGGXAGLLDKAKGFVADKIAHMPKPEASLDKVSFKGMTREAITVHSHVNVTNPYSHRIPICDIAFTLKCGGKEVASGTIPDPGWIEDSGEVTKLEVPAKVPYDFLISLMKDLGRDWDIDYELLVKLTIDLPIIGNFTIPLQTAGEFKLPTLSDFFGGSAKTEEATA

SEQ ID NO: 4387 - protein, 197 aa, Triticum aestivum
  misc_feature (112)..(113): Xaa can be any naturally occurring amino acid
  misc_feature (179)..(181): Xaa can be any naturally occurring amino acid
  misc_feature (189)..(190): Xaa can be any naturally occurring amino acid
  misc_feature (194)..(194): Xaa can be any naturally occurring amino acid
HEALEKGALCVGVTNTVGSTLSRKTHCGIHINAGCEIGVASTKAYTSQIVVMAMIALAIGSDQLSTQPRRESIITGLSSLPSHVSEVLKLDAEMKELASSLIDSESLLVFGXXYNYATALEGALKVKEVALMHSESMLAGEMKHGPLALVDENLPIIVIATRDSCFSKQKSVIQQLLSXXXRLIIMCSXXDISXVGP

SEQ ID NO: 4388 - protein, 373 aa, Triticum aestivum
MGNCAGVQGNAEINPTFSAPNTSGNNSKSSNSSNATDTSTFGKSSSSSVPPTPRTEKEILQSSNLRKFTFSELRSSTRNFRTDSLLGEGGFGSVFKGWIDERTFTPVKPGTGMIVAVKKLKLDSFQGHKEWLAEVNYLGQLSHPNLVKLIGYCLEDEQRLLVYEFMPKGSLEHHLFRRAPHFQPLSWSLRMKVALEAARGLAFLHSDEAKVIYRDFKTSNVLLDSEYNAKLSDFGLAKDGPSGDKSHVSTRVMGTQGYAAPEYLATGHLTTKSDVYTYGVVLLELLTGQRALDKNRPPGQHNLVEWARPYINSKRRVIHVLDPRLGSQYSLPAAQKAAALAMQCLSMDARCRPDMDQVVTALEKLPEVKKTYK

SEQ ID NO: 4389 - protein, 120 aa, Triticum aestivum
VMWAKNQLAQDQTRDFILKYINTLCGYIPSPMGESSVDCKKLASMPEVAFSIGGKKFALTPEQYILKIGEGDATKCISGFVAMDIPPPRGPIWILGEKFMGAYHTVFDYGKMKVGFAKAA

SEQ ID NO: 4390 - protein, 96 aa, Triticum aestivum
  misc_feature (81)..(81): Xaa can be any naturally occurring amino acid
DVVDLVLIMSVNPGFGGQSFIESQVKKIAELRRLCAEKGVNPWIEVDGGVGPKNAYKVIEAGANAIVAGSAVFGAPDYAEXIKGIKTSQRPLAVAA

SEQ ID NO: 4391 - protein, 139 aa, Triticum aestivum
LIFFGGIANTFMLAAGLSIGKSLAEADLVNEAKAIIDEARERGASVPIPTDVVTAKEFSPTAAATVKQVADIEADDMILDIGPDTAKALASQLEKAGTIVWNGPVGVFEFDQFGNGTKTLAEAIAKSSAFSIAGGGDTL

SEQ ID NO: 4392 - protein, 476 aa, Triticum aestivum
MGRAFVYVVLGGGVAAGYAALEFARRGGYSRGELCIISEEPVAPYERPALSKGYLLPEDPSRLPKFHTCVGANDELLTTKWYKEQGIELVLGTRVISADVRRKTLLTATGETISYKTLIIATGARALKLEEFGISGSDAANICYLRNLEDADKLVNAMSSCSGGNAVVIGGGYIGMECAAALVTNKIKVTMVFPEKHCMGRLFTEKIAEYYESYYTLKGVTFTKGTVLTSFEKDSTGKVTSVILKDGNHLPADMVVVGIGIRANTSLFEGQLLMEKGGIKVNGQMQTSDSSVYAVGDVAAFPIKLFDGDIRRLEHVDSARRTARHAVAAILEPSKSRDVDYLPFFYSRVFTLSWQFYGDNVGEVIHYGDFTSNSPRFGAYWVSKGQITGAFLEGGDRDDYEALSVVVWRKTKVSDMSELERQGLAFAIQESKKDVPDSGVTLGEKPTFVWYATAGVVAAVSISAFGYWYGRKRRRW

SEQ ID NO: 4393 - protein, 186 aa, Triticum aestivum
  misc_feature (153)..(153): Xaa can be any naturally occurring amino acid
MGTVDKYVGVAGPESGGVDVEWSHHIGRSWMPQKAKEVVPQSLQEVNKGVDQAQWRIPLWGSFGMEISRVLGGGIVPGSLILVGGDPGVGKSSLMLQLASNILEGFKAKESSPVVYVSGEESIEQIGNRADRMSITSSNLYLYSGTDIEDILXKSTLSPRALISIDQTVMSDISGMLVICTVKECT

SEQ ID NO: 4394 - protein, 266 aa, Triticum aestivum
  misc_feature (243)..(243): Xaa can be any naturally occurring amino acid
GQSCGFLQFPTFGLKAWKQTFFFDFSLTYVGAGMICSHLVNLSTLFGAVLSWGIMWPLISKQKGIWYPANVPESSMTSLFGYKSFMCVALIMGDGLYHFIKLTGITAKSLHAQSNRKHVKRAANEDTVSFHDLQRNEVFTREYIPNWLAYAGYASLSIIAIIVIPTMFRQAKWYYVVVAYVLAPVLGFSNAYGAGLTDMSMSYNYGKIALFIFAAWGGKDDGVIAGLVGCAIVNTSEVSADLXHDYKTGICTDITEILLSGSHQYG

SEQ ID NO: 4395 - protein, 169 aa, Triticum aestivum
  misc_feature (9)..(9): Xaa can be any naturally occurring amino acid
MAPTVMASXDTSVAPFQGFKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGC

SEQ ID NO: 4396 - protein, 76 aa, Triticum aestivum
  misc_feature (31)..(31): Xaa can be any naturally occurring amino acid
  misc_feature (33)..(33): Xaa can be any naturally occurring amino acid
RENGRRDDRRYSRLKYLLDSWGIDKFRAEAXKXYGKKFEDFRPLPEWQFNSYLGWQEQGDGKLFYGVHVDNGRLGG

SEQ ID NO: 4397 - protein, 241 aa, Triticum aestivum
  misc_feature (146)..(146): Xaa can be any naturally occurring amino acid
  misc_feature (155)..(155): Xaa can be any naturally occurring amino acid
  misc_feature (168)..(168): Xaa can be any naturally occurring amino acid
YRSGIPGSTHASGTKQKKKMTVAYLKEKPVGQGSTPSTPSSSSGMRSAAARLLGTGNGSRTLSFAGSNGVSRAVSGSSRVGGGVGMSTGVGGSQAVANYDGKGTYIIFNTADTLFISDLNSHDKDPVKSIHFSNSNPLCHAFDSGXAKMGHDLIXGMGPGDVYSNVHXRQQLQDPGKEPVMSSTFYQIKTKDGNCQQHLVLHGFQNKDFVQQCRWNRCNPRWSYWDSNCRIKQLRLHQSST

SEQ ID NO: 4398 - protein, 106 aa, Triticum aestivum
  misc_feature (85)..(85): Xaa can be any naturally occurring amino acid
IPSTRHSDPDSAGSSFSILLGNSPHLDGQYAVFGRVTKGDDTLTKLERLPTRREGIFVMPIERINILSTYYYDIDLESCEAEKSXLRRRLSESASEVSDGERKCFA

SEQ ID NO: 4399 - protein, 202 aa, Triticum aestivum
VRANDEWVSYSPSQASVSKERAIESAKAVFLKDYDHLEPYRIHHASRLVAILEAYAIYDQEIGYCQGMSDLLAPLLAVLEEDDEAFWCFAGFMRKARHNFRLDEVGIRRQLNMVARIIKYKDFHLYRHLEMLQAEDCFFVYRMVVVMFRRELTFEQTLCLWEVMWADQAANRAEIAKSSWRKLQLGAPPTDDLLLYAIAASV

SEQ ID NO: 4400 - protein, 438 aa, Triticum aestivum
MGPPAPQAGRFTDLVSIGIRESLLEPQFVSEALAPDNPPLKIRFIDNTDPAGIDHQIAQLGEELKSTLVIVISKSGGTPETRNGLLEVQKAFRDAGLDFSKQGVAITQENSLLDNTARIEGWLDRFPMFDWVGGRTSELSAVGLLPAALQGIDVKEMLVGAALMDEETRNTVVKENPAALLALSWYWATDGIGSKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVEEVTPRAVGALVALYERAVGIYASLVNINAYHQPGVEAGKKAAGEVLALQKRVLTVLNEASCKDPAEPLTLEQIADRCHCPEDIEMIYKIIQHMAANDRALIAEGSCGSPRSVKVYLGECNVDDV

SEQ ID NO: 4401 - protein, 122 aa, Triticum aestivum
SCRIRHELSFSTTKPWQRENESYTSINAAAQVGNPTSVYEYWASLLRLRKTYKDVLVYGDFQLIDSDNDNIFAYLRTSTDKKVLVLANFRPFNVTWKKPDGLGALGPILIENETTRYQKASA

SEQ ID NO: 4402 - protein, 222 aa, Triticum aestivum
  misc_feature (69)..(69): Xaa can be any naturally occurring amino acid
  misc_feature (101)..(101): Xaa can be any naturally occurring amino acid
  misc_feature (113)..(113): Xaa can be any naturally occurring amino acid
  misc_feature (139)..(139): Xaa can be any naturally occurring amino acid
DIGVIAKIESIDALKNLEEIIRASDGVMVARGDLGAQIPLEQVPSIQQRIVRMCRQLNKPVIVASQLLXESMIEYPTPTRAEVADVSEAARQRADALMLSXGESAMGRYPEKXLSVLRSVSLRIERWWREEKRQEHWDXSVPSSFSDKISEELHSAAKWQQLRIDPFRYTKVLMAPPHMPPQPRPRLPLGREPMGPFGTSTMDNFKEELFPQQGQNYSRKKG

SEQ ID NO: 4403 - protein, 250 aa, Triticum aestivum
  misc_feature (104)..(104): Xaa can be any naturally occurring amino acid
  misc_feature (198)..(198): Xaa can be any naturally occurring amino acid
  misc_feature (207)..(208): Xaa can be any naturally occurring amino acid
  misc_feature (210)..(211): Xaa can be any naturally occurring amino acid
  misc_feature (225)..(225): Xaa can be any naturally occurring amino acid
KKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFXKDDWVHYAKMTEEIGEQVQIVGDDLLVTNPTRVAKAIKEKSCNALLLKVNQIGSVTESIEAVKMSKRAGWGVMTSHRSGETEDTFIADLAVGFXTGQIKTGAXXHXXRLAKYNQLLRIEEXLALLLTRCKFVHCGYKRAGSMLYSN

SEQ ID NO: 4404 - protein, 284 aa, Triticum aestivum
RHEGPLTSADLMGEASGEGLRVAYQGCPGAYSEAAAKKAYPSCETVPCEYFETAFQAVEKWAADRAVLPLENSLGGSIHRNYDLLLRHRLHIVGEVRLAVRHCLLANRGVKIENLRSAMSHPQALAQCEQTLTQLGIEHREAVDDTAGAAKQIAEENLQDTAAVASSLAAQLYGLDILAENIQDDADNVTRFMMLAREPIIPRTDKPFKTSIVFSLEEGPGQLFKALAVFALRKINLTKMESRPHKKKPLRVADDNSTPLKHFDYLFYVDFEASMADPNAQNAL

SEQ ID NO: 4405 - protein, 449 aa, Triticum aestivum
MYRAKRAALSPKVKRRVGKYELGRTIGEGTFAKVRFAKNTETMEPVAIKILDKEKVQKLRLVEQIRREICTMKLIKHPNVVRLHEVMGSKARIFIVLEYITGGELFDTIYTNGRLKEEEARKYFQQLINAVDYCHSRGVYHRDLKLENLLLDAAGNLKVSDFGLSALTEQVKADGLLHTTCGTPNYVAPEVIEDRGYDGAAADIWSCGVILFILLAGFLPFEDENIIALYKKISEAQFTCPSWFSTGAKKLITRILDPNPATRITIPQILEDPWFKKGFKPPVFDDKYETSFDDVYAAFGDSEDQHVKEETEHKPTSMNAFELISLNQGLNLDNLFEAKEEHKRETRFTSQCPPKEIISKIAEAARPLGFDIQKKNYKMRMENPKAGRKGNLNVATEVFQVAPSLHVVELKKAKGDTLEFQMFYRSLSTQLKDVVWKCGGEVEDNGTAA

SEQ ID NO: 4406 - protein, 276 aa, Triticum aestivum
  misc_feature (217)..(217): Xaa can be any naturally occurring amino acid
  misc_feature (271)..(271): Xaa can be any naturally occurring amino acid
MAAASFGLMDKAYFVGRGEILSWVNATLQLSLNKVEEAASGAVQCQLLDMVHPGSVPMHKVNFDAKTEYDMIQNYKILQDVFNKLRIGKNIEVNKLVKGRPLDNLEFLQWLKRYCDSVNGGIMNENYNPVERRSKGCKERTHKGPNKSSKSLQANRLSSANSADGGALNSNTDLASPIGKVVNAVNEEHYMEQIQQLSEKIADLKVSVDNTEKERDXYFSKLRDIEILCQRPELEHLPMTKGIRKILYAADAKDSSLPEANEIITRSPGMXSDEAE

SEQ ID NO: 4407 - protein, 423 aa, Triticum aestivum
MARKKIREYDSKRLLKEHLKRLAGIDLHILSAQVTQSTDFAELVNQHPWLSTTKLVVKPDMLFGKRGKSGLVALNLDVAQVKEFVKERLGVEVEMGGCKAPITTFIVEPFVPHDQEYYLSVVSERLGSTISFSECGGIEIEENWDKVKTVFLPTEKPMTPDACAPLIATLPLEARGKIGDFIKGVFAVFQDLDFSFIEMNPFTMVNGEPYPLDMRGELDDTASFKNFKKWGNLEFPLPFGRVLSSTESFIHELDDKTSASLKFTVLNPKGRIWTMVAGGGASVIYADTVGDLGYASELGNYAEYSGAPNQEEVLQYARVVLDCATADPDGRKRALLIGGGIANFTDVAATFSGIIQALREKESKLKASRMHLYVRRGGPNYQTGLAKMRKLGAEIGVPIEVYGPEETMTGICKQAIECIMAAS

SEQ ID NO: 4408 - protein, 110 aa, Triticum aestivum
  misc_feature (29)..(29): Xaa can be any naturally occurring amino acid
SYDSEKPLLSKIKYPGVHIIFVRYEERIXDPHIRASHHYASLNFEYHLPYIADFTRAKVTRIFHCALRHVRGPSCARMFLDYLSEAKEESFVKSITVLERGFNGWELSWK

SEQ ID NO: 4409 - protein, 231 aa, Triticum aestivum
MAALTASIATSTAFAAKPRLARPPARLSVSCSASSGDNTTPSLSASIKTFSAALALSSVLLSSAATSPPPAAADIAGLTPCKESKAFAKREKQSVKKLNSSLKKYAPDSAPALAIQATIEKTKRRFENYGKFGLLCGSDGLPHLIVSGDQRHWGEFITPGVLFLYIAGWIGWVGRSYLIAVSGEKKPAMREIIIDVELAARIIPRGFIWPVAAYRELINGDLVVDDADIGY

SEQ ID NO: 4410 - protein, 147 aa, Triticum aestivum
  misc_feature (45)..(45): Xaa can be any naturally occurring amino acid
  misc_feature (51)..(51): Xaa can be any naturally occurring amino acid
  misc_feature (65)..(65): Xaa can be any naturally occurring amino acid
  misc_feature (70)..(70): Xaa can be any naturally occurring amino acid
  misc_feature (81)..(81): Xaa can be any naturally occurring amino acid
  misc_feature (103)..(103): Xaa can be any naturally occurring amino acid
  misc_feature (113)..(113): Xaa can be any naturally occurring amino acid
  misc_feature (136)..(136): Xaa can be any naturally occurring amino acid
  misc_feature (141)..(141): Xaa can be any naturally occurring amino acid
  misc_feature (145)..(146): Xaa can be any naturally occurring amino acid
MAPTVMASSATSVAPFQGLKSTAGLPVSRRSNGASLGSVSNGGRXRCMQVXWPIKGIKKFRRPVXLPTLXTTEGLLKASRXLIRSKWVPLPRIQTKVGFNLPXSNKHPPGVLXMAGYWDNVGSCLSSGCTDATKLXTRLEXVKKXXP

SEQ ID NO: 4411 - protein, 99 aa, Triticum aestivum
  misc_feature (90)..(90): Xaa can be any naturally occurring amino acid
  misc_feature (95)..(95): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLXFSKVXFIFR

SEQ ID NO: 4412 - protein, 136 aa, Triticum aestivum
  misc_feature (35)..(35): Xaa can be any naturally occurring amino acid
  misc_feature (58)..(58): Xaa can be any naturally occurring amino acid
  misc_feature (72)..(72): Xaa can be any naturally occurring amino acid
  misc_feature (85)..(85): Xaa can be any naturally occurring amino acid
  misc_feature (90)..(90): Xaa can be any naturally occurring amino acid
  misc_feature (92)..(92): Xaa can be any naturally occurring amino acid
  misc_feature (96)..(96): Xaa can be any naturally occurring amino acid
  misc_feature (99)..(100): Xaa can be any naturally occurring amino acid
  misc_feature (102)..(103): Xaa can be any naturally occurring amino acid
  misc_feature (105)..(105): Xaa can be any naturally occurring amino acid
  misc_feature (110)..(110): Xaa can be any naturally occurring amino acid
  misc_feature (118)..(118): Xaa can be any naturally occurring amino acid
  misc_feature (133)..(133): Xaa can be any naturally occurring amino acid
MAPAVMASSATTVAPFQGLKSTAGLPVGRRSSGSXQQASSNGGRIRCMQVWPIEGIKXKFENLSYLATLSKXGLLKQVHYLIRSXKWVAXLXFNKXGFXXRXXNXSPGYXEGRYWAMXELPMFRCTDPNKVLXEGE

SEQ ID NO: 4413 - protein, 118 aa, Triticum aestivum
  misc_feature (82)..(82): Xaa can be any naturally occurring amino acid
  misc_feature (86)..(86): Xaa can be any naturally occurring amino acid
ATSVAPFQGLKSTAGLPVSRRSNGASLGSVSNGGRIRCMQVWPIEGIKKFETLSYLPPLSTEALLKQVDYLIRSKWVPCLRXSKLXHLPVEHNALLGTTMARVLACGTAYFGCTDPHR

SEQ ID NO: 4414 - protein, 124 aa, Triticum aestivum
  misc_feature (48)..(48): Xaa can be any naturally occurring amino acid
HDSPRPPRRPSCLTEYYTVLTNPCKGPQYPPTECCDAFKEFACPFAAXINNQSTNCADTMFSYICFHGYPKGLFADECLKGKEGVSCEGIPAVDTGVPSGGRQVQGVSRPLVVFLCGLGALLFP

SEQ ID NO: 4415 - protein, 181 aa, Triticum aestivum
  misc_feature (88)..(88): Xaa can be any naturally occurring amino acid
  misc_feature (118)..(118): Xaa can be any naturally occurring amino acid
  misc_feature (129)..(129): Xaa can be any naturally occurring amino acid
  misc_feature (137)..(137): Xaa can be any naturally occurring amino acid
  misc_feature (166)..(166): Xaa can be any naturally occurring amino acid
MAPAVMASSATTVAPFQGLKSTAGLPVSRRSSGSLGRVSNGGRIRCMQVWPIEGIKKFETLSYLPPLSTEALLKQVDYLIRSKWVPCXLRFSKVGFRLPVSTTSSPRVITNGRYWTMXKLPYVRCTDAXTQVLNEVXEEVKKEYPDAYVRRNRASTTCAQVQCVSXFIAFRPPGCEESGKA

SEQ ID NO: 4416 - protein, 254 aa, Triticum aestivum
EAGILMIIIMSFSFTLATHSFRRSVVKLPSPLHHLAGFNAFWYAHHLLVIAYILLVVHSYFIFLTREWYKKTTWMYLIVPVLFYACERIIRKFRENNYHAEIVRAAIYPGNVLSIHMKKPQGFKYKSGMYLFVKCPEVSPFEWHPFSITSAPGDDYLSVHIRTLGDWTSELRMLFGKACEAQVTSKKATLTRLETTVVADARTEDTRFPKVYIDGPYGAPAQNYRKYDILLLIGLGIGATPFISILKDMLNNLK

SEQ ID NO: 4417 - protein, 95 aa, Triticum aestivum
  misc_feature (7)..(7): Xaa can be any naturally occurring amino acid
  misc_feature (11)..(11): Xaa can be any naturally occurring amino acid
  misc_feature (18)..(18): Xaa can be any naturally occurring amino acid
  misc_feature (22)..(22): Xaa can be any naturally occurring amino acid
  misc_feature (29)..(29): Xaa can be any naturally occurring amino acid
  misc_feature (36)..(36): Xaa can be any naturally occurring amino acid
  misc_feature (40)..(40): Xaa can be any naturally occurring amino acid
  misc_feature (45)..(45): Xaa can be any naturally occurring amino acid
  misc_feature (48)..(48): Xaa can be any naturally occurring amino acid
  misc_feature (50)..(50): Xaa can be any naturally occurring amino acid
  misc_feature (63)..(63): Xaa can be any naturally occurring amino acid
  misc_feature (67)..(67): Xaa can be any naturally occurring amino acid
  misc_feature (69)..(69): Xaa can be any naturally occurring amino acid
  misc_feature (83)..(85): Xaa can be any naturally occurring amino acid
  misc_feature (90)..(90): Xaa can be any naturally occurring amino acid
  misc_feature (93)..(94): Xaa can be any naturally occurring amino acid
NKENTLXSPFXGLAVHPXDGIXQAISHVXALFLLPXHFRXHIALXFRXAXWTANIHDCIHGKXWPVXGXGDHTSHHTTYRHNXXXYTVWXDWXXG

SEQ ID NO: 4418 - protein, 372 aa, Triticum aestivum
MDLSNGSPVISDPMAMSQSLMGVLPSNMMPFSVRPGGYSGAGGAGVNVSRRKIEEVLVSGLLDAMKSSSPRKKHNVVFGQENLPEEDPAYSAWMAKCPSALASFKQIVASAQGKKIAVFLDYDGTLSPIVDDPEKAVMSPVMRAAVRNVAKYFPAAIVSGRSRKKVLEFVKLKELCYAGSHGMDIMTSSSAHYEHNTEKGKEANLFQPARDFLPMIDEVSKALLEVTSGIEGASVEDNKFCVSVHYRNVDEKDWELVARLVNEVLEDFPALKVTNGRMVLEVRPVIDWDKGKAVEFLLQSLGLSDSENVIPIYIGDDRTDEDAFKVLRERNCGYGILVSQVPKETEAFYSLRDPSEVMEFLNSLVRWKKHSL

SEQ ID NO: 4419 - protein, 162 aa, Triticum aestivum
  misc_feature (81)..(81): Xaa can be any naturally occurring amino acid
  misc_feature (90)..(90): Xaa can be any naturally occurring amino acid
  misc_feature (100)..(100): Xaa can be any naturally occurring amino acid
  misc_feature (102)..(102): Xaa can be any naturally occurring amino acid
  misc_feature (110)..(110): Xaa can be any naturally occurring amino acid
  misc_feature (122)..(123): Xaa can be any naturally occurring amino acid
  misc_feature (147)..(147): Xaa can be any naturally occurring amino acid
MAPAVMASSATTVAPFQGLKSTAGLPVSRRSSGSLGRVSNGGRIRCMQVWPIEGIKNSETLSYLPPLSTEASLKQVDYLIXRSKWVPCLXFNKVGFSFRXAXSPPGYNDXPYWTMLELAIFXXTDPASLNKVEESKRIPDPIPLIGXTQFILNSIKHGSREG

SEQ ID NO: 4420 - protein, 125 aa, Triticum aestivum
YSDEWHADLLGCCSEPALCLKTFFFPCGTFSRIASIAKNKPMSSGEACNDIMAYSLILSCCCYTCCVRRKLRQRLNIVGGCCDDFLSHVMCCCCALVQEWREVEIRGAYGGKTKITPPAHQYMEH

SEQ ID NO: 4421 - protein, 131 aa, Triticum aestivum
MSYYDRRGESSVLEAFTLSPLPYPVILILMMVTLLLGASWFFSYEDFMEEASEQFSWFLLGVPIALVLLIRWISSVDTFEGYFGFYPTESRWRGYPAAPSEGSSPWGVAMVVVLLLLLASFHSTFQDMWKP

SEQ ID NO: 4422 - protein, 94 aa, Triticum aestivum
MAMGSLAFATALVFVFVFAIAVPAVAAAAQAPAPAPTSDGTSIDQGIAYLLMIMALVLTYLIHPLGRLRPVTSSSERADFLLHFWVGFCSGSLE

SEQ ID NO: 4423 - protein, 163 aa, Triticum aestivum
MPRGGFSGSLRSPKIDVVIDMGNPFLNRTVDGFLKIGAVGACKVAAEETFECLHRGDVSKHKVEHALKKMCQEGPYWGTVAGVYVGMVYGVERVRGRSDWKNAMIGGPVPRPLSAAASHSRRHQGPIAPSTPGPAATALDFPAGLSFLRYRNCICCALVVLYD

SEQ ID NO: 4424 - protein, 258 aa, Triticum aestivum
  misc_feature (74)..(74): Xaa can be any naturally occurring amino acid
  misc_feature (90)..(90): Xaa can be any naturally occurring amino acid
  misc_feature (105)..(105): Xaa can be any naturally occurring amino acid
  misc_feature (126)..(126): Xaa can be any naturally occurring amino acid
  misc_feature (221)..(221): Xaa can be any naturally occurring amino acid
MGRKFFVGGNWKCNGTVEQVESIVNTLNAGQIASTDVVEVVVSPPYVFLPTVKAKLRPEIQVAAQNCWVKKGGXAFTGEVSAEMLVNLGXVPWVILGHSERRSLXGEKSSEFVGEKVAYALAQGLXKVIACVGETLEQREAGSTMAVVAEQTKAIADKIKDWTNVVVAYEPVWAIGTGKVATPAQAQEVHANLRDWLKTNVSPEVAESTRIIYGGSVTGAXSCKELAAQPDVDGFLVGGASLKPEFIDIINAATVKSA

SEQ ID NO: 4425 - protein, 171 aa, Triticum aestivum
  misc_feature (54)..(54): Xaa can be any naturally occurring amino acid
  misc_feature (63)..(63): Xaa can be any naturally occurring amino acid
  misc_feature (79)..(79): Xaa can be any naturally occurring amino acid
  misc_feature (97)..(97): Xaa can be any naturally occurring amino acid
  misc_feature (112)..(112): Xaa can be any naturally occurring amino acid
  misc_feature (130)..(130): Xaa can be any naturally occurring amino acid
  misc_feature (135)..(135): Xaa can be any naturally occurring amino acid
MGRKFFVGGNWKCNGTVEQVESIVNTLNAGQIASTDVVEVVVSPPYVFLPTVKXAKLRPEIQXVAAQNCWVKKGGAFTXGEVSAEMLVNLGVPWVIXLGHSERRSLMGESSXFVGEKVAYALAQGLEGNXCVGEXLEQREAGLTMAVVAEQTKQCDKIRTGQLVSPTLAMR

SEQ ID NO: 4426 - protein, 171 aa, Triticum aestivum
RRRTKKRTHVGSNNGPATKLASSKSSKTPKTMVIRIGAGEVGPSVSQLVKDVRLMMSPDTAARLKERRANRLRDYITMAGPLSVTHLMLFSRSESGNTNLRVAITPRGPTLNFQVEKYSLCKDVRKAYKRPRGRGKEYITAPLLVMNNFTTPSSADTKAENKVPKHLEVSR

SEQ ID NO: 4427 - protein, 142 aa, Triticum aestivum
  misc_feature (87)..(87): Xaa can be any naturally occurring amino acid
  misc_feature (92)..(92): Xaa can be any naturally occurring amino acid
  misc_feature (102)..(102): Xaa can be any naturally occurring amino acid
  misc_feature (104)..(104): Xaa can be any naturally occurring amino acid
  misc_feature (112)..(112): Xaa can be any naturally occurring amino acid
  misc_feature (119)..(119): Xaa can be any naturally occurring amino acid
  misc_feature (122)..(122): Xaa can be any naturally occurring amino acid
  misc_feature (125)..(125): Xaa can be any naturally occurring amino acid
  misc_feature (134)..(134): Xaa can be any naturally occurring amino acid
  misc_feature (141)..(141): Xaa can be any naturally occurring amino acid
MAPAVMASSATTVAPFQGLKSTAGLPVGRRSSGSLSSVSNGGRIRCMQVWPIEGIKNSETLSYLPPLSTGGLPGNRSDYLDSAQKWXPCLRXNKFGFLFPLXNXPPGYYDGXRYWDMLXLPXFRXTGPTQVLNXVEESKKXT

SEQ ID NO: 4428 - protein, 89 aa, Triticum aestivum
PGCKYYARDFRGVVPSYKIQQVDTTGAGDAFVGALLRKIVQDPSSLQNQEKLEEAIKFANACGAITTTKKGAIPSLPTEIEVLQLMENA

SEQ ID NO: 4429 - protein, 182 aa, Triticum aestivum
MAKRHLLLVTTCLWALSCALLLHASSDGFLRVNLNKKRLDKEDLTAAKLAQQGNRLLKTGSSDSDPVPLVDYLNTQYYGVIGLGSPPQNFTVIFDTGSSNLWVPSAKCYFSIACYLHSRYNSKKSSSYKADGETCKITYGSGAISGFFSKDNVLVGDLVVKNQKFIEATRETSVTFIIGKFD

SEQ ID NO: 4430 - protein, 190 aa, Triticum aestivum
  misc_feature (72)..(72): Xaa can be any naturally occurring amino acid
  misc_feature (85)..(85): Xaa can be any naturally occurring amino acid
  misc_feature (93)..(93): Xaa can be any naturally occurring amino acid
  misc_feature (103)..(103): Xaa can be any naturally occurring amino acid
  misc_feature (113)..(113): Xaa can be any naturally occurring amino acid
  misc_feature (117)..(117): Xaa can be any naturally occurring amino acid
  misc_feature (125)..(125): Xaa can be any naturally occurring amino acid
  misc_feature (129)..(129): Xaa can be any naturally occurring amino acid
  misc_feature (139)..(139): Xaa can be any naturally occurring amino acid
  misc_feature (157)..(157): Xaa can be any naturally occurring amino acid
DPYIDGPIIQASVARALASGTTMDAVLEMLREVTPELSCPVVLLSYYKPIMSRSLAEMKEAGVHGLIVPDLXPYVAAHSLWSEAXKNNNLELXVLLTTPTIPXEDKDEGDLPXLQEXSVYLGERXRMTXPRPNVNPQWXIIQEVKKVTNNPFPFGSXIPTQKTLTNAQWGLTGDYPERMVRNWPTVSQQG

SEQ ID NO: 4431 - protein, 308 aa, Triticum aestivum
MRAPMRGGGGRGGGRGFGDSGGRGGRGRGFGGRSDGGGRSGGRGFGGRSAGRGRGGGRGGGRGGPGMKGGAKVVVVPHKHDGVFIAKAKEDALCTKNMVAGESVYGEKRVSVQNEDASKVEYRVWNPFRSKLAAAVLGGVDNIWIAPGTRVLYLGAASGTTVSHVSDIVGPTGLVYAVEFSHRSGRDLVNMAKKRTNVIPIIEDARHPAKYRMLVGMVDVIFSDVAQPDQARILALNASYFLKNGGHFVISIKANCIDSTQAAEAVFASEVEKLKADQFKPSEQVTLEPFERDHACVVGGYRMPKKQK

SEQ ID NO: 4432 - protein, 221 aa, Triticum aestivum
  misc_feature (147)..(147): Xaa can be any naturally occurring amino acid
  misc_feature (170)..(170): Xaa can be any naturally occurring amino acid
VRFAAGLCGFFSLTGAWGVVPSFWLASGGSGGGAFLAGPFWAAGARPGAEGWDCGFHLPSSAWTNPWRALGVACQVAGLRGLGASHAGLREEFRPFWSPAASVQIERGRAVALGCWGKRPAVPGRARRLSRSAIGRAPVLVPLFDRXYIPCTPSLAGNTVCFVTDDRVLXCGLEVVHFCTRESSLQPMDISSPFAAIPYCGTSPPCFRRSLDASCGGQAPR

SEQ ID NO: 4433 - protein, 151 aa, Triticum aestivum
  misc_feature (3)..(3): Xaa can be any naturally occurring amino acid
  misc_feature (9)..(10): Xaa can be any naturally occurring amino acid
  misc_feature (13)..(13): Xaa can be any naturally occurring amino acid
  misc_feature (16)..(16): Xaa can be any naturally occurring amino acid
  misc_feature (20)..(22): Xaa can be any naturally occurring amino acid
  misc_feature (25)..(25): Xaa can be any naturally occurring amino acid
  misc_feature (27)..(28): Xaa can be any naturally occurring amino acid
  misc_feature (30)..(33): Xaa can be any naturally occurring amino acid
  misc_feature (35)..(35): Xaa can be any naturally occurring amino acid
  misc_feature (38)..(38): Xaa can be any naturally occurring amino acid
  misc_feature (41)..(41): Xaa can be any naturally occurring amino acid
  misc_feature (43)..(43): Xaa can be any naturally occurring amino acid
  misc_feature (57)..(57): Xaa can be any naturally occurring amino acid
  misc_feature (60)..(60): Xaa can be any naturally occurring amino acid
  misc_feature (62)..(62): Xaa can be any naturally occurring amino acid
  misc_feature (81)..(82): Xaa can be any naturally occurring amino acid
  misc_feature (91)..(92): Xaa can be any naturally occurring amino acid
  misc_feature (94)..(95): Xaa can be any naturally occurring amino acid
  misc_feature (101)..(101): Xaa can be any naturally occurring amino acid
  misc_feature (103)..(103): Xaa can be any naturally occurring amino acid
  misc_feature (105)..(105): Xaa can be any naturally occurring amino acid
  misc_feature (108)..(108): Xaa can be any naturally occurring amino acid
  misc_feature (111)..(112): Xaa can be any naturally occurring amino acid
  misc_feature (117)..(117): Xaa can be any naturally occurring amino acid
  misc_feature (122)..(122): Xaa can be any naturally occurring amino acid
  misc_feature (124)..(124): Xaa can be any naturally occurring amino acid
  misc_feature (126)..(126): Xaa can be any naturally occurring amino acid
  misc_feature (136)..(136): Xaa can be any naturally occurring amino acid
  misc_feature (142)..(142): Xaa can be any naturally occurring amino acid
QGXSSDKIXXMEXPEXLLDXXXFKXMXXEXXXXDXQVXVSXPXSHSIPICDIAFTLXCDXKXVAIGTIPDPGWIEDSGEVXXLEVPAKVPXXFXXSFMKDXGXDXDIXYKXXVKLSXDLPIXGXFXIPLQTAGEFXLTTLSXFFGGSAKEA

SEQ ID NO: 4434 - protein, 80 aa, Triticum aestivum
  misc_feature (17)..(17): Xaa can be any naturally occurring amino acid
  misc_feature (29)..(29): Xaa can be any naturally occurring amino acid
  misc_feature (34)..(34): Xaa can be any naturally occurring amino acid
  misc_feature (43)..(43): Xaa can be any naturally occurring amino acid
MAGGRVAHATLKGPSVXKEIFIGLTLGLXAGGMXNMHHWNEQXKTRSFYDMLENGQDRSVPILEATKVQSPNVFQFLVFA

SEQ ID NO: 4435 - protein, 243 aa, Triticum aestivum
  misc_feature (175)..(175): Xaa can be any naturally occurring amino acid
  misc_feature (209)..(209): Xaa can be any naturally occurring amino acid
MATNIEDVPSVELMTELLRRAKCSSKPDKRIILVGPPGSGKGTQSPLIKDEYCLCHLATGDMLRAAVAAKTPLGIKAKEAMDKGELVSDDLVVGIIDEAMKKPSCQKGFILDGFPRTVVQAQKLDEMLAKQGAKVDKVLNFAIDDAILEERITGRWIHPSSGRSYHTKFAPFPKXPGVDDVSGEPLIQRKDDTAEVLKSRLEAFHIQTXEPVIDYYSKNGLVANLHAEKPPKEVTAELQKALS

SEQ ID NO: 4436 - protein, 241 aa, Triticum aestivum
MAANLEDVPSVDLITEVLRRAKCSSKPDKRIILIGPPGSGKGTQSPLIKDEYCLCHLATGDMLRAAVAAKTPLGIKAKEAMNKGELVSDDLVVGIIDEAMKKPSCQKGFILDGFPRTVVQAQKLDDMLAKQGAKVDKVLNFAIDDAILEERITGRWIHPSSGRSYHTKFAPPKTPGVDDVTGEPLIQRKDDTAAVLKSRLEAFHMQTEPVIDYYSNPRVRANLHAEKPPKEVTVEVQKALS

SEQ ID NO: 4437 - protein, 77 aa, Triticum aestivum
RDTRIFVQEPGIISSPTHESVAHGWWVGVISEVLSDQKYKVYFKAYKEQDEFELEQLRRHCDWVGGRWMQASPALEM

SEQ ID NO: 4438 - protein, 196 aa, Triticum aestivum
IKSPNILLDQSMHARVADFGLSREEMLTRNGANIRGTYGYLDPEYVSSRSFTKKSDVYSYGVLLFELIAGRNPQQGLMEYVELAAINADGKTGWEEIADSRLEGAFDVEELNDMAAAAYKCVSRVSRKRPSMRDVVQALIRVVKHSHSSRNHHGRRLPPGRTDDESVDLEASEDQSSASGHQRQESVGSVSELPDV

SEQ ID NO: 4439 - protein, 274 aa, Triticum aestivum
MPRYDERDRYGGNTRLYVGRLPSRTRTRDLEDLFGRYGRVRHVDMKHEFAFVEFSDPRDADEARYNLDGRDFDGSRMIVEFAKGVPRGQGGGGDRDRGGRGGDREYMGRGPPPGSGRCFNCGIDGHWARDCKAGDWKNRCYRCGDSGHIERDCQNSPKNLKRGKSYSRSPSPRRGRVRDRSYSRSPRGSRSPMRSPRDSRSPRRSASPAKGRARSPTPPGSRSPAPRDNSRSPMKADSPKNMSPAANGRSLSPRDGEDNGHHRAPSGSASPGGG

SEQ ID NO: 4440 - protein, 223 aa, Triticum aestivum
  misc_feature (160)..(160): Xaa can be any naturally occurring amino acid
MPRYDERDRYGGNTRLYVGRLPSRTRTRDLEDLFGRYGRVRHVDMKHEFAFVEFSDPRDADEARYNLDGRDFDGSRMIVEFAKGVPRGQGGGGDRDRGRGGDREYMGRGPPPGSGRCFNCGIDGHWARDCQAGDWKNRCYRCGDSGHIERDCQNSPKNLXSRSRSYSRSVSPRRDERRSRSPRDSRSPRRSPRDSRSPRRSPRDSRSPMKSPRGSRSPMRSPP

SEQ ID NO: 4441 - protein, 323 aa, Triticum aestivum
MPRYDERDRYGGNTRLYVGRLPSRTRTRDLEDLFGRYGRVRHVDMKHEFAFVEFSDPRDADEARYNLDGRDFDGSRMIVEFAKGVPRGQGGGGDRDRGRGGDREYMGRGPPPGSGRCFNCGIDGHWARDCKAGDWKNRCYRCGDSGHIERDCQNSPKNLKRGKSYSRSPSPRRGRVRDRSYSRSRSRSYSRSVSPRRDERRSRSPRDSRSPRRSPRDSRSPRRSPRDSRSPMKSPRGSRSPMRSPRDSRSPRRSASPVKGRARSPTPPGSRSPAPRENSRSPMKADSPNNMSPAANGRSPSPRDGEDNGNHRAPSGSASPGGG

SEQ ID NO: 4442 - protein, 300 aa, Triticum aestivum
  misc_feature (99)..(99): Xaa can be any naturally occurring amino acid
  misc_feature (134)..(134): Xaa can be any naturally occurring amino acid
  misc_feature (247)..(247): Xaa can be any naturally occurring amino acid
  misc_feature (291)..(291): Xaa can be any naturally occurring amino acid
FDVGGGKGRAGSDEGEDSDDDEWAPPPELYTGGERSGMVVRDRSKRKNVADEVFKQAKRKGAKQGPARRQSSSSRSFPGASRLLTGETVQPDAPQPPRXIVHNIYFWSDGFTVDDGPLRRGGEKFLSAPSENSXLRADLSGSICKSECPTELAPADGMSKVNVNLIRKEEKCPEPVKRPAPFQGGGRILAAPSENSAPSGISLAAAASSTATTTAPKTITVDDSLPSTSLQIRFADGSRVVGRFNTXHTISDVRAFIHTTRPGETSDYTLQVGFPPKPLDDATKTIEEAGXANSVIIQRV

SEQ ID NO: 4443 - protein, 122 aa, Triticum aestivum
NMAKKRTNVIPIIEDARHPARYRMLVGMVDVIFSDVAQPDQARILALNASYFLKNGGHFVISIKANCIDSTLPAEAVFAAEVEKLKADQFKPAEQVTLEPYERDHACVVGGYRMPKKQKATS

SEQ ID NO: 4444 - protein, 305 aa, Triticum aestivum
  misc_feature (284)..(284): Xaa can be any naturally occurring amino acid
FSLVALRKVMVIDYKLTYPSGTATAMLINSFHTTSGAELAEKQVSCLGKYLSISFVWNCFKWFFSGVGDSCGFDNFPSLGLAAFKNTFYFDFSPTYIGCGLICPHIVNCSTLLGAIISWGFLWPYISTKAGEWYPAGLGSNDFKGLYGYKVFISVSVILGDGIYNLIKIIYATIKEIMNARSKQGRLPLVRAQDDDESSELSSEEKLLNDVFVRDSIPPWLAGSGYVGLAAISTATVPMMFPQLKWYLVLSAYVVAPLLAFCNLYRTGLTDWNLASTYGKIGLXFASWVGQHGGVIAYNLWGHES

SEQ ID NO: 4445 - protein, 170 aa, Triticum aestivum
VASSATSVAPFQGLKSTAGLPVSRRSNGASLGSVINGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 4446 - protein, 140 aa, Triticum aestivum
  misc_feature (125)..(125): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCNXPTQVINEVEESRRIT

SEQ ID NO: 4447 - protein, 169 aa, Triticum aestivum
  misc_feature (54)..(54): Xaa can be any naturally occurring amino acid
  misc_feature (70)..(70): Xaa can be any naturally occurring amino acid
  misc_feature (79)..(79): Xaa can be any naturally occurring amino acid
  misc_feature (97)..(97): Xaa can be any naturally occurring amino acid
  misc_feature (100)..(100): Xaa can be any naturally occurring amino acid
  misc_feature (149)..(149): Xaa can be any naturally occurring amino acid
MAPTVMASSATSVAPFQGLKSTAGLPVSRRSNGASLGSVSNGGRIRCMQVWPIXEGIKKFETLSYLPPLXTEALLKQVXYLDPSKWVPCLRFSKLGXLPXEHNASPGYYDGRYWAMWNCLCSGCTDATQVINEGGGVKKDTLTLFRIIXSTNLKCMRSYPLNNCKIPEG

SEQ ID NO: 4448 - protein, 116 aa, Triticum aestivum
PTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWNC

SEQ ID NO: 4449 - protein, 154 aa, Triticum aestivum
  misc_feature (91)..(91): Xaa can be any naturally occurring amino acid
  misc_feature (106)..(106): Xaa can be any naturally occurring amino acid
  misc_feature (110)..(110): Xaa can be any naturally occurring amino acid
  misc_feature (113)..(113): Xaa can be any naturally occurring amino acid
  misc_feature (119)..(119): Xaa can be any naturally occurring amino acid
  misc_feature (124)..(124): Xaa can be any naturally occurring amino acid
SATSVAPFQGLKSTAGLPVSRRSNGASLGSVSNGGRIRCMQVWPIEGIKKFETLSYLPPLSTEALLKQVDYLIRSKWVPCLEFSKLGSSSXEHNASPGYYDGRYWXTMWXLPXFGCTDXTQVIXRLEGVKEGYPDPKSDHRQMVSACVTSSPTT

SEQ ID NO: 4450 - protein, 138 aa, Triticum aestivum
  misc_feature (112)..(112): Xaa can be any naturally occurring amino acid
MAPTVMASSATSVAPFQGLKSTAGLPVSRRSNGASLGSVSNGGRIRCMQVWPIEGIKKVPRTLSYFANRSSNGRALPQSKVELPDPASKVGCPWPSEFKQRLGSILPVEHNXPLGYYDGPVLGMLELPISGCTDARST

SEQ ID NO: 4451 - protein, 209 aa, Triticum aestivum
  misc_feature (92)..(92): Xaa can be any naturally occurring amino acid
  misc_feature (108)..(108): Xaa can be any naturally occurring amino acid
  misc_feature (116)..(116): Xaa can be any naturally occurring amino acid
  misc_feature (156)..(156): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREHNASPGXYYDGRYWXTMWKLPMFGCTDATQVINEVEEVKKEYLTRIPHIGFDNMXQVQCVSSSPNGLQGSGRLNSNHTGILSAMRLEPMLWFPPLPLVSRKVHVSHMK

SEQ ID NO: 4452 - protein, 183 aa, Triticum aestivum
  misc_feature (130)..(130): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVXKQVEEVKERITLTPNVRINRIHNIVSACVSSSPARAQDRKAKQYSHRHLMVCL

SEQ ID NO: 4453 - protein, 141 aa, Triticum aestivum
  misc_feature (58)..(58): Xaa can be any naturally occurring amino acid
  misc_feature (99)..(99): Xaa can be any naturally occurring amino acid
  misc_feature (117)..(117): Xaa can be any naturally occurring amino acid
  misc_feature (131)..(131): Xaa can be any naturally occurring amino acid
MAPTVMASSATSVAPFQGLKSTAGLPVSRRSNGASLGSVSNGGRIRCMQVWPIEGIKXFETLSYLPPLSTEALLKQVDYLIRSKWVPCLEFNKVGFIFXVEHNASPGVLTMAGTGQXGTAMFRMHRRHQVXNEVEEVKKDT

SEQ ID NO: 4454 - protein, 175 aa, Triticum aestivum
MGPTLMASSATSVAPFQGLKSTAGLPVSRRSNGASLGSVSNGGRIRCMQVWPIEGMGGWGSLSYLPPLTHKTLLKQVDYLIRSKWVPCLEFSKVGFIFREHNAFPGYYDGRYWTMWKLPMFGCPDPTQVINEVEEVKKEYPDAYVRIIGFDNMRQVQCVSFIAFKPPGCEESGKA

SEQ ID NO: 4455 - protein, 154 aa, Triticum aestivum
  misc_feature (58)..(58): Xaa can be any naturally occurring amino acid
  misc_feature (80)..(80): Xaa can be any naturally occurring amino acid
  misc_feature (108)..(108): Xaa can be any naturally occurring amino acid
  misc_feature (115)..(115): Xaa can be any naturally occurring amino acid
  misc_feature (121)..(122): Xaa can be any naturally occurring amino acid
  misc_feature (125)..(125): Xaa can be any naturally occurring amino acid
MAPTVMASSATSVAPFQGLKSTAGLPVSRRSNGASLGSVSNGGRIRCMQVWPIEGIKXFETLSYLPPLSTEASSSRSDYXIRSKWVPCLRFNKVGSSPVEHNHLLGYXNGRIGHXELPIFXXNDXQSDNEVEEVKKDTLPYFRSGTNASRHQTL

SEQ ID NO: 4456 - protein, 350 aa, Triticum aestivum
  misc_feature (25)..(25): Xaa can be any naturally occurring amino acid
  misc_feature (36)..(36): Xaa can be any naturally occurring amino acid
MATVSFSSPASFAGDNSGALTSATXLRFPPNFVRRXLAERALLGSDASLAVHAGERLGRRIATDAITTPVVNTSAYWFSSSQELIDFKEGRHASFEYGRYGNPTTEALEKKMSALEKAESTVFVASGMYASVAMLSTLVPAGGHIVTTTDLYRKTRIYMETELPKRGITMTVIRPADMDALQDALDNNNVSLFFTETPTNPFLRCIDIELVSNMCHNKGALLCIDSTFASPINQKALTLGADIVVHSATKYIAGHNDVIGGCISGRDELVSKVRIYHHVVGGVLNPNASYLILRGMKTLHLRVQCQNSTALRMAQFLEEHPKIARVYYPGLPSHPEHHIAKSQMTGFWWC

SEQ ID NO: 4457 - protein, 95 aa, Triticum aestivum
MADNDEDTLAPNSEPLDLVRLCLDEVVFVKLRGDRELKGRLHAYDSHCNLVMGDVEETVYVMDDDEDDTLKKVHKKLEMLFVRGDSVVLISPRGT

SEQ ID NO: 4458 - protein, 125 aa, Triticum aestivum
MDTLLGSGRFLARRPPLALAPRCSRGSPEKGGGSDKGDTSSTDWDKAWSTFKKKGKKTLFSEFSPNKYVSWNPRRSEYPLSEEVDPIRRTERSNLMLWTSPKFTLVMAIVIVSTLLIYTIVVPPK

SEQ ID NO: 4459 - protein, 283 aa, Triticum aestivum
  misc_feature (225)..(225): Xaa can be any naturally occurring amino acid
VGYMSGGCKSDDGSLSCGYSSFRGKRASMEDFFDIKSSKIDDKQINLFGIFDGHGGSRAAEYLKEHLFENLMKHPQFMSDTKLAISETYKKTDSDFLDSEINTHRDDGSTASTAVLLGNHLYVANVGDSRAVISKSGKAIALSDDHKPNRSDERKRIESAGGIVMWAGTWRVGGVLAMSRAFGNRLLKQFVVAEPEIQDQEIDDELEFLILASDGLWDVVPNEDXAVSLVKMEEDPEAAARKLTETAFGRGSGDNITCVVVKFQHSKTGGGDSPPISPPGNQI

SEQ ID NO: 4460 - protein, 123 aa, Triticum aestivum
  misc_feature (23)..(23): Xaa can be any naturally occurring amino acid
IEGFKMNLIYFDLYQSTRLEKFXQFLKANGEQPLTWKRASSMEEVLKEADVISLHPVLDKTAYYLINPERLAMMEEVVLVNASRGPVIDEVALVEHLRANHMFHVGLDVFEDEPYMKPGLAEM

SEQ ID NO: 4461 - protein, 790 aa, Triticum aestivum
  misc_feature (558)..(558): Xaa can be any naturally occurring amino acid
MTMMAMPEAPCLCARPSLAARARRPGSGPAPRLRRWRPNATAGKGVGEVCAAVVEAATKVEDEGEEDEPVAEDRYALGGACRVLAGMPAPLGATALAGGVNFAVYSGGATAAALCLFTPEDLKADRVTEEVPLDPLMNRTGNVWHVFIEGELHNMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFALVEEGTXHKKYNLLNGGKPGPDDILNHDLHYRDLTIYPILSFKRFRLRQMRNFFVCLIVSQGVLLVYIGDNNGHTNGGNNNIYCHDSYVNYFRWDKKEQYSELHQFCCLMTKFRKECEGLGLEDFPTAKRLQWHGHQPGKPDWSENSRFVAFSMKDERQGEIYVAFNTSHLPAVVELPERAGRRWEPVVDTGKPAPYDFLTDDLPDRALTIHQFSHFLYSNLYPMLSYSSVILVLRPDV

SEQ ID NO: 4462 - protein, 167 aa, Triticum aestivum
  misc_feature (5)..(5): Xaa can be any naturally occurring amino acid
  misc_feature (83)..(83): Xaa can be any naturally occurring amino acid
  misc_feature (113)..(113): Xaa can be any naturally occurring amino acid
  misc_feature (124)..(124): Xaa can be any naturally occurring amino acid
  misc_feature (127)..(127): Xaa can be any naturally occurring amino acid
  misc_feature (146)..(146): Xaa can be any naturally occurring amino acid
  misc_feature (151)..(151): Xaa can be any naturally occurring amino acid
GGRGXRTPRGGRGGGGRGGRGGGMKGGSKAVVVAHKHAGVFISKSKEDALCTKNMVPGESVYGEKRVSVQNEDGTKVEYRVWXNPFRSKLAAAVLGGVDNIWIAPGTRVLYLXAAPGTTVSHVXDIXRPDGLVYLLSLSQDGRDFXNMAKXGQSNIEQASKRWLDVM

SEQ ID NO: 4463 - protein, 286 aa, Triticum aestivum
  misc_feature (118)..(118): Xaa can be any naturally occurring amino acid
  misc_feature (180)..(180): Xaa can be any naturally occurring amino acid
RRRRVPVGLDRASPAAPHGPLAAARPGAAGGRGGQRLGPPRGVGRRVQAGPLPLLRECRWPRRRRDPVQRPRPLPARKVPTYKVTPMQLKRDKSNIIWRQFDGHEPENYWYRVCEGRXAAKVIQRPWYAIWKSKRLMNIVTEIAGRMDWDYDGLHVVRGWKAMNKKMCPNLDADTSPDAXVDKVTKLIKAPWRNLYIATNEPFYNYFDKLRSHYHVHLLDDYKELWSNTSEWYNETTAINNGKDLPFDAYMKVIVDTEVFYRSKAKVETFNNLTRDCKDGINTCNL

SEQ ID NO: 4464 - protein, 447 aa, Triticum aestivum
  misc_feature (241)..(241): Xaa can be any naturally occurring amino acid
MDVDCEVSAAAAAAVTNGLGGGEQAAAAPVSADQLDVEAYAAQYSGRTRVARLLFIAERCGVEAIQLEALRMAHDEARAREDTVLYLDAVLKINGRLGPRYRHDQAWVDSVNRRAEQRKEKLETELNGYRTNLIKESIRMGYNDIGDFFYAHGHLSEAFKSYIRTRDYCTTSKHIVQMCMHVILVSIELGQFAHVTNYVSKAEQTPDTLDAVIVAKLRAAAGLANLETKKYKLAARKFLEXTGPELGSNYSEVIAPQDVAVCGALCALASFDRSELKSKVIDNINFRNFLELVPEVRELVNDFYASRYGSCLEHLEKLKPNLLLDIHLREHLGTLYNDIRHKAIIQYTLPFISVDLNTMASAFKSSVSMLEKELAALITENKIQARIDSHNKILYARHADQRNATFQRALQTGNEFERDIKAMLLRANLIKHDFNQKNWPGQRKMNL

SEQ ID NO: 4465 - protein, 161 aa, Triticum aestivum
MGTRGLALLLLAAVLLQTLLPASHAEGLVRIALKKRPIDRNSRVATSLSDREDLLGGGGANTLRSEEEGDIVSLKNYMNAQYFGEIGVGTPPQKFTVIFDTDSSNLWVPSIKCYFSIACYLHARCKERACKTYKKNGKPAGIRGETGGMGGCGEGDGGAGG

SEQ ID NO: 4466 - protein, 162 aa, Triticum aestivum
  misc_feature (58)..(58): Xaa can be any naturally occurring amino acid
  misc_feature (73)..(73): Xaa can be any naturally occurring amino acid
  misc_feature (78)..(78): Xaa can be any naturally occurring amino acid
  misc_feature (105)..(105): Xaa can be any naturally occurring amino acid
  misc_feature (126)..(126): Xaa can be any naturally occurring amino acid
  misc_feature (129)..(129): Xaa can be any naturally occurring amino acid
MAPSVMASSATTVAPFQGLKSTAGMPVARRSGNSSFGNVSNGGRIRCMQVWPIEGIKXFETLSYLPPLTVEDXLKAVXVPAPSNWVPCPDSSKGPVCPTVENHRXPGYYQRKYWTIWNCQGSVDRXTQXLKDPRRQKGSPILTVKLKLFNPKTPGSGEKPQK

SEQ ID NO: 4467 - protein, 132 aa, Triticum aestivum
  misc_feature (104)..(104): Xaa can be any naturally occurring amino acid
MLVYQDLLSGDELLSDSFTYKELENGVLWEVEGKWVTQGPVDVDIGANPSAEGGEDESVDDTAVKVVDIVDTFRLQEQPPFDKKSFVSYIKKYIKNLTAVLGAXEKADEFKKGVEGCNQFLLNKLKDSNFCW

SEQ ID NO: 4468 - protein, 114 aa, Triticum aestivum
  misc_feature (7)..(7): Xaa can be any naturally occurring amino acid
  misc_feature (10)..(10): Xaa can be any naturally occurring amino acid
  misc_feature (20)..(21): Xaa can be any naturally occurring amino acid
  misc_feature (28)..(28): Xaa can be any naturally occurring amino acid
  misc_feature (37)..(37): Xaa can be any naturally occurring amino acid
  misc_feature (49)..(49): Xaa can be any naturally occurring amino acid
  misc_feature (53)..(53): Xaa can be any naturally occurring amino acid
  misc_feature (58)..(58): Xaa can be any naturally occurring amino acid
  misc_feature (60)..(60): Xaa can be any naturally occurring amino acid
  misc_feature (64)..(64): Xaa can be any naturally occurring amino acid
  misc_feature (67)..(67): Xaa can be any naturally occurring amino acid
  misc_feature (69)..(69): Xaa can be any naturally occurring amino acid
  misc_feature (72)..(72): Xaa can be any naturally occurring amino acid
  misc_feature (77)..(77): Xaa can be any naturally occurring amino acid
  misc_feature (80)..(81): Xaa can be any naturally occurring amino acid
  misc_feature (87)..(88): Xaa can be any naturally occurring amino acid
  misc_feature (94)..(94): Xaa can be any naturally occurring amino acid
  misc_feature (101)..(101): Xaa can be any naturally occurring amino acid
  misc_feature (103)..(103): Xaa can be any naturally occurring amino acid
  misc_feature (107)..(107): Xaa can be any naturally occurring amino acid
  misc_feature (109)..(110): Xaa can be any naturally occurring amino acid
MAPTVMXSSXTSVAPFQGLXXTAGLPVXRRSNGASLXSVSNGGRIRCMXVWPXEGITXFXTLSXLPXLXSTXALLKXVDXXSAPRWXXCLEFSXVGFIFRXHXASPXYXXGRYW

SEQ ID NO: 4469 - protein, 175 aa, Triticum aestivum
MAPTVMASSATSVAPFQGLKSTAGLPVSRRSTSAGLGSVSNGGRISCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 4470 - protein, 74 aa, Triticum aestivum
  misc_feature (42)..(42): Xaa can be any naturally occurring amino acid
PRFIVTQDQRLWAKFITPGVLFLYITVWIGWVVPIYLIAVDXHNKVSMQEIITSVELASRIFTREFIWAVAASF

SEQ ID NO: 4471 - protein, 83 aa, Triticum aestivum
  misc_feature (48)..(48): Xaa can be any naturally occurring amino acid
EGFYWGSGPEYYFGSEYSIFRFRDARDGKNTILAVASAGAVFSAVSIXGKDMVVIDAFMAGALARASQFFNDHVFLLSCHSSF

SEQ ID NO: 4472 - protein, 157 aa, Triticum aestivum
  misc_feature (40)..(40): Xaa can be any naturally occurring amino acid
  misc_feature (123)..(123): Xaa can be any naturally occurring amino acid
  misc_feature (130)..(130): Xaa can be any naturally occurring amino acid
  misc_feature (135)..(135): Xaa can be any naturally occurring amino acid
  misc_feature (139)..(139): Xaa can be any naturally occurring amino acid
  misc_feature (142)..(142): Xaa can be any naturally occurring amino acid
  misc_feature (144)..(144): Xaa can be any naturally occurring amino acid
  misc_feature (151)..(151): Xaa can be any naturally occurring amino acid
MAPTVMASSATSVAPFQGLKSTAGLPVSRRSNGASSAASXNGGRIRCMQVWPIEGIKKFETLSYLPPLSTEALLKQVDYLIRSKWVPCLEFSKVGFIFREHNASPGYYDGRYLTMWKLPMFRXTDAKKVXNEVEXVKKXYPXAXVRIIRFXKWARMR

SEQ ID NO: 4473 - protein, 177 aa, Triticum aestivum
  misc_feature (99)..(99): Xaa can be any naturally occurring amino acid
  misc_feature (112)..(112): Xaa can be any naturally occurring amino acid
  misc_feature (130)..(130): Xaa can be any naturally occurring amino acid
  misc_feature (134)..(134): Xaa can be any naturally occurring amino acid
  misc_feature (149)..(150): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFXREHNASPGYYDGXRYWDNVELPMFGCTDATXVINXVEESRRIPDPYVRIXXSTTCSRECVNLTLQATGARSGKAKSHH

SEQ ID NO: 4474 - protein, 112 aa, Triticum aestivum
  misc_feature (21)..(22): Xaa can be any naturally occurring amino acid
  misc_feature (53)..(53): Xaa can be any naturally occurring amino acid
  misc_feature (65)..(65): Xaa can be any naturally occurring amino acid
  misc_feature (68)..(68): Xaa can be any naturally occurring amino acid
  misc_feature (70)..(70): Xaa can be any naturally occurring amino acid
  misc_feature (77)..(78): Xaa can be any naturally occurring amino acid
  misc_feature (81)..(81): Xaa can be any naturally occurring amino acid
  misc_feature (85)..(85): Xaa can be any naturally occurring amino acid
  misc_feature (88)..(88): Xaa can be any naturally occurring amino acid
  misc_feature (90)..(90): Xaa can be any naturally occurring amino acid
  misc_feature (92)..(92): Xaa can be any naturally occurring amino acid
  misc_feature (94)..(96): Xaa can be any naturally occurring amino acid
  misc_feature (101)..(101): Xaa can be any naturally occurring amino acid
  misc_feature (103)..(103): Xaa can be any naturally occurring amino acid
  misc_feature (105)..(107): Xaa can be any naturally occurring amino acid
  misc_feature (109)..(109): Xaa can be any naturally occurring amino acid
MAPTVMASSATSVAPFQGLKXXVGLPVSRRSNGASLGSVSNGGRIRCMQVWPXEGIMKFETLSYXPPXRXETLLKQXXYLXRSKXVPXLXFXSXXXFILRXLXEXXXYXESS

SEQ ID NO: 4475 - protein, 103 aa, Triticum aestivum
PHRNAKGTVIEACLDKAKGPLATLVVQNGTLNKGDILVCGEAFGKIRAMYDDRGSLVDQAAPSNAVQIIGLNNVPLAGDEFESVDDLDVARERANARADAMRI

SEQ ID NO: 4476 - protein, 119 aa, Triticum aestivum
MHDFCFTIPYGFAVLAGGLLGYLRRGSTASLAGGAGVGGLLLLAGFVSLKAFEKRRNSYLALALETLCALALTFVMGQRYLETSKIMPASVVAGLSVLMSAFYLFKIATGGNHFSPKKE

SEQ ID NO: 4477 - protein, 145 aa, Triticum aestivum
  misc_feature (33)..(33): Xaa can be any naturally occurring amino acid
  misc_feature (39)..(39): Xaa can be any naturally occurring amino acid
  misc_feature (44)..(45): Xaa can be any naturally occurring amino acid
  misc_feature (48)..(48): Xaa can be any naturally occurring amino acid
  misc_feature (51)..(51): Xaa can be any naturally occurring amino acid
  misc_feature (58)..(58): Xaa can be any naturally occurring amino acid
  misc_feature (68)..(68): Xaa can be any naturally occurring amino acid
  misc_feature (71)..(71): Xaa can be any naturally occurring amino acid
  misc_feature (75)..(75): Xaa can be any naturally occurring amino acid
  misc_feature (77)..(78): Xaa can be any naturally occurring amino acid
  misc_feature (80)..(82): Xaa can be any naturally occurring amino acid
  misc_feature (85)..(85): Xaa can be any naturally occurring amino acid
  misc_feature (87)..(87): Xaa can be any naturally occurring amino acid
  misc_feature (92)..(92): Xaa can be any naturally occurring amino acid
  misc_feature (98)..(98): Xaa can be any naturally occurring amino acid
  misc_feature (103)..(104): Xaa can be any naturally occurring amino acid
  misc_feature (107)..(107): Xaa can be any naturally occurring amino acid
  misc_feature (110)..(110): Xaa can be any naturally occurring amino acid
  misc_feature (112)..(113): Xaa can be any naturally occurring amino acid
ALSLSLSLSLSLSLSLSISADTSVAPFQGLKSXAGLPVXRRSNXXSLXSVXNGGRIRXMQVWPIEGIXKFXTLSXLXXLXXXALXKXVDYLXRSKWVXCLEFXXVGXIFXEXXHPWVIWSVRTCGTYVRMNEKQVINWRSQEGYL

SEQ ID NO: 4478 - protein, 131 aa, Triticum aestivum
  misc_feature (70)..(70): Xaa can be any naturally occurring amino acid
  misc_feature (81)..(81): Xaa can be any naturally occurring amino acid
  misc_feature (90)..(90): Xaa can be any naturally occurring amino acid
  misc_feature (99)..(99): Xaa can be any naturally occurring amino acid
  misc_feature (101)..(101): Xaa can be any naturally occurring amino acid
MAPTVMASSATSVAPFQGLKSTAGLPVSRRSSSAGLGSVSNGGRIRCMQVWPIEGIKNSETLSYLPPSPXEASLKQVDYLXRSNWVPCLXFNKLVPFPXRXHSPGYMAILAWNCYFGSTKVSVRRYLSVTA

SEQ ID NO: 4479 - protein, 148 aa, Triticum aestivum
MDAWSGVSADAAAAGANGLGGGWRADVEAAAATSGLGGWGEASAELLDVEAYVAPYSGRTRLARLMAISYKCGVEAIQFEALRVAHDEAKAGEDTMFYLYVVREIDGRLGQGYLLDQAWVDSGNRRAEQRKETLLSQLQIYQSNQIRE

SEQ ID NO: 4480 - protein, 154 aa, Triticum aestivum
  misc_feature (93)..(93): Xaa can be any naturally occurring amino acid
  misc_feature (126)..(126): Xaa can be any naturally occurring amino acid
VSDKIKLIDNLLGKVDSLIICGGMAFTFKKTLENVNIGDSLFDKAGSETVGALVEKAKKNKVKIVLPVDYITADKFAKDAKTATATDEEGIPXGWMGLDCGKKSIELYKAAIGEASTILWNGPPGXVFEFDAFANGTKETPICSGRPAQQRKCD

SEQ ID NO: 4481 - protein, 109 aa, Triticum aestivum
MLPSYLYDFPFLGDDSTITVDDNCVDPLYKHIFPPEVAPHLSFIGLPWKIIPFPLFELQSKWVARVLSGRVKLPSKDKMMEDVKAFYSKLEALGWPKRYTHNFSNHQVA

SEQ ID NO: 4482 - protein, 108 aa, Triticum aestivum
MAVASMVHAPSLLAVQTFRGQKNAAANRSPRAAAFRVRAAKLPAGVRVPRAQPKLSEPFLGFTKTAEVWNSRACMMGLIGTFIVELILHKGVLEIIGFEVGKGLDIPL

SEQ ID NO: 4483 - protein, 198 aa, Triticum aestivum
  misc_feature (96)..(97): Xaa can be any naturally occurring amino acid
  misc_feature (99)..(99): Xaa can be any naturally occurring amino acid
  misc_feature (124)..(124): Xaa can be any naturally occurring amino acid
  misc_feature (127)..(127): Xaa can be any naturally occurring amino acid
  misc_feature (134)..(134): Xaa can be any naturally occurring amino acid
  misc_feature (141)..(141): Xaa can be any naturally occurring amino acid
  misc_feature (153)..(153): Xaa can be any naturally occurring amino acid
  misc_feature (160)..(160): Xaa can be any naturally occurring amino acid
  misc_feature (165)..(165): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCPSSSAKGXXCXSFFVERPTAIAPGVTLRWAPGIGSXCWXKLPLCVXVAPDGHXQVINEVEGARRXPDAYVRXIGFDXMRQVQCGDVHRLKPPGCEESGKAYNGSLTTRHI

SEQ ID NO: 4484 - protein, 204 aa, Triticum aestivum
  misc_feature (65)..(65): Xaa can be any naturally occurring amino acid
  misc_feature (78)..(78): Xaa can be any naturally occurring amino acid
  misc_feature (116)..(116): Xaa can be any naturally occurring amino acid
  misc_feature (119)..(119): Xaa can be any naturally occurring amino acid
MAPTVMASSATSVAPFQGLKSTAGLPVSRRSNGASLGSVSNGGRIRCMQVWPIEGIKKFETLSYXPPLSTEALLKQVXYLDSAPKWVPCLRVQQGGFIFPLSTTHPLGYYDGRYWXTMXETAYFRCTDPPSVQRSGGVKKEYLDPYSASSVRQLRKSMRQIALSHGLQESARLNTHHTGNIKCNAVAPTFCGGSFTSLPKLSRK

SEQ ID NO: 4485 - protein, 180 aa, Triticum aestivum
  misc_feature (54)..(54): Xaa can be any naturally occurring amino acid
  misc_feature (73)..(73): Xaa can be any naturally occurring amino acid
  misc_feature (92)..(92): Xaa can be any naturally occurring amino acid
  misc_feature (96)..(96): Xaa can be any naturally occurring amino acid
  misc_feature (108)..(108): Xaa can be any naturally occurring amino acid
  misc_feature (116)..(116): Xaa can be any naturally occurring amino acid
  misc_feature (120)..(120): Xaa can be any naturally occurring amino acid
  misc_feature (126)..(126): Xaa can be any naturally occurring amino acid
  misc_feature (129)..(129): Xaa can be any naturally occurring amino acid
  misc_feature (137)..(137): Xaa can be any naturally occurring amino acid
  misc_feature (143)..(143): Xaa can be any naturally occurring amino acid
  misc_feature (150)..(150): Xaa can be any naturally occurring amino acid
MAPTVMASSATSVAPFQGLKSTAGLPVSRRSNGASLGSVSNGGRIRCMQVWPIXEGIKNSETLSYLPPLSTEXLLKQVDYLDPSKWVPCLRXSKVXSSSVEHNASPGXYYDGRYWXTMWXLPISGXTDXTQVINEVXKRSRRXPDAYSAXRFDNMRKCMRNSSPTTGSRIRKANSHHTGN

SEQ ID NO: 4486 - protein, 102 aa, Triticum aestivum
  misc_feature (28)..(28): Xaa can be any naturally occurring amino acid
  misc_feature (65)..(65): Xaa can be any naturally occurring amino acid
  misc_feature (82)..(82): Xaa can be any naturally occurring amino acid
  misc_feature (93)..(94): Xaa can be any naturally occurring amino acid
  misc_feature (96)..(96): Xaa can be any naturally occurring amino acid
MAPTVMASSATSVAPFQGLKSTAGLPVXSRRSNGASLGSVSNGGRIRCMQVWPIEGIKKFETLSXLPPAQHGGLLKQVDYLXIRSKWVPCLRXXAXLGFNFR

SEQ ID NO: 4487 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCPDATQVINEVEEVKKEYPDAYVRIIGFDNMRQVQWVSFIAFKPPGCEESGKA

SEQ ID NO: 4488 - protein, 148 aa, Triticum aestivum
  misc_feature (105)..(105): Xaa can be any naturally occurring amino acid
MAQWNGMEQAATIAQLVGVDALGLISTIVQAAQTVQRNKETCQELVQDVQLINGLLRMLQNPEMMQREEIVNALNGLEGTLREAYSLVSSCQDCSTTYRIFMGWXHTDQFRRVKKKIAKHSASTYDLHADITVVPKNNMLSPSSSVVS

SEQ ID NO: 4489 - protein, 140 aa, Triticum aestivum
  misc_feature (94)..(94): Xaa can be any naturally occurring amino acid
  misc_feature (98)..(98): Xaa can be any naturally occurring amino acid
  misc_feature (131)..(131): Xaa can be any naturally occurring amino acid
ENYWYRVCEGRAAKVIQRPWYAIWKSKRLMNIVTEIAGRMDWDYDGLHVVRGWKAQNKQMYPNLDSDTSPDALVDKVTKLVKPMRDLYIATNDXYNYXDNSGTLHVHLLDDYKDFGSNTSEWYNETTTLNXGQTIPFDPT

SEQ ID NO: 4490 - protein, 233 aa, Triticum aestivum
  misc_feature (155)..(155): Xaa can be any naturally occurring amino acid
  misc_feature (182)..(182): Xaa can be any naturally occurring amino acid
ILFFSPCPPLSPPAPPISRRTLRPLAAPPAPRPPPPPPGHLLPPTAAGGAMGVGGEEFAVGVVISAKTTLGEEFEGQIVSFDRPSNLLVIQEGVGRAERGERRNVRVLKANYIQEFSVVGKYDDPLDPAGCVLDLAAIHAREEAALRQAEIEAEXRIGVGVTPKPQRLFVALSKNLPGIVVXTDIVDKERRFVVCSPYLPENLSNGTSAANEWVKKVLDFERKRQHVRVPGQF

SEQ ID NO: 4491 - protein, 138 aa, Triticum aestivum
  misc_feature (125)..(125): Xaa can be any naturally occurring amino acid
  misc_feature (130)..(130): Xaa can be any naturally occurring amino acid
ARGRGVRGLSGGERKRVSIGLEMLVDPSLLLLDEPTSGLDSTTAARIVGTLRRMAAGGGRTVVVTIHQPSSRLYHMFDKVLLLSAEGRPIYYGRAADALSYFASVGFASPLSVNPADLMLDLANXILPEXNGDPGGGS

SEQ ID NO: 4492 - protein, 159 aa, Triticum aestivum
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKRTAEKEPKEGKSPKKTAKSPKKADKKA

SEQ ID NO: 4493 - protein, 156 aa, Triticum aestivum
MDASATGAGAKGKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKTAKSPKKADKKA

SEQ ID NO: 4494 - protein, 220 aa, Triticum aestivum
  misc_feature (77)..(77): Xaa can be any naturally occurring amino acid
MARKGGERKKAVTRSVKAGLQFPVGRIGRFLKKGRYAQRVGSGAPVYLAAVLEYLAAEVLELAGNAAKDNKKSRIVXPRHLLLAIRNDQELGKLLAGVTIAHGGVLPNINPVLLPKRALEKAEKEAQSPKSPRKKTEKKAPAPRRQEDPQEEDRRRQEDHRRRQEGRRRRREGGRRRRRRGVDMAPSRRLVLHLRGKRGRERAWDPVCNAWSGVRTGSSL

SEQ ID NO: 4495 - protein, 147 aa, Triticum aestivum
MAGRKAGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPKKSPAAAEKEAKSPKKKTTTKSPKKKTAATKE

SEQ ID NO: 4496 - protein, 130 aa, Triticum aestivum
MGDGVSTYAVDEALVSMGFGKFQAFVLAYSGMAKISEAMEMMLLSFVGQSVHAEWGLSAQEESFITSVVFLGMLVGAYCWGLVSDNYGRRVGFNFTALVTGGAGLLSAFAPNYSSLIVLRFLVAVGPVFR

SEQ ID NO: 4497 - protein, 250 aa, Triticum aestivum
MAAAAASMARRLLSPTTSSPSTAIRLLISRRIASAPSIPHAPAAAAREMLRPAAVASSSSFLLRGAGGARGMARRPGGDGYSPARGGGGGGAGGDRAPTEMAPLFPGCDYKHWLIVMDKPGGEGASKHQMIDCYVQTLAKVLGSEEEAKRKIYNVSCERYFGFGCEIDEETSNKLEGIPGVLFVLPDSYVDPEHKDYGAELFVNGEIVQRSPERQRRVEPVPQRASDRPRYNDRTRYARRRENQQQQQQR

SEQ ID NO: 4498 - protein, 147 aa, Triticum aestivum
MAGRKAGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKTTTKSPKKKAAAAKE

SEQ ID NO: 4499 - protein, 146 aa, Triticum aestivum
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSAAAEKEAKSPKKKAATKSPKKKAAATKE

SEQ ID NO: 4500 - protein, 154 aa, Triticum aestivum
  misc_feature (43)..(43): Xaa can be any naturally occurring amino acid
MEASAAGAVAKAKKYVVGRKLGGGPRKQAVARSVKAGLQFPVXGRIGRFLKKGRYAQRVGMGAPVYLASVLEYLAAELLELAGNAAKDNKKSRIIPRHLLLAIRNDQELGRLLAGVTIAHGGVLPNINPVLLPKKAADKEPKSPKKAAKSPKKA

SEQ ID NO: 4501 - protein, 150 aa, Triticum aestivum
MAGRKGGERKKAVTRSVKAGLQFPVGRIGRFLKKGRYAQRVGSGAPVYLAAVLEYLAAEVLELAGNAAKDNKKTRIVPRHLLLAVRNDQELGRLLAGVTIAHGGVIPNINPVLLPKKSAAAAAEKEATAKSPKKKAAAKSPKKKAAATKE

SEQ ID NO: 4502 - protein, 185 aa, Triticum aestivum
  misc_feature (174)..(174): Xaa can be any naturally occurring amino acid
MASPALISDTDQWKALQAHVGAIHKTHLRDLMTDADRCKAMTAEFEGVYLDYSRQQATTETIDKLFKLAEAAKLKEKIDKMFKGEKINTTENRSVLHVALRAPRDAVINSDGVNVVPEVWAVKDKIKQFSETFRSGSWVGATGKPLTNVVSVGIGGSFLGPLFVHAALQIDPKXAESAKGWQLRL

SEQ ID NO: 4503 - protein, 526 aa, Triticum aestivum
MAMAMRRAAALGARHILAASASASSRVASRRHMGSVDAGAAMDKIRAAGLLRTRGLIGGQWVDAYDGKTTEVQNPATGEVLANVACMGNRETADAITSANTTFYTWSKLTASERSKALRKWHDLLMSHKEELALLMTLEQGKPMKEALGEVNYGASFIEFFAEEAKRVYGDIIPPTLADRRLLVLKQPIGVVGAITPWNFPLAMITRKVGPALACGCTVVVKPSEFTPLTALAAADLALQAGIPAGALNVVMGNAPEIGGELMQSTQVRKITFTGSTAVGKKLMAGSANTVKKVSLELGGNAPCIVFDDADIDVAVKGSLAAKFRNSGQTCVCANRILVQEGIYEKFASAFVKAVQSLQVGNGLEESTSQGPLINEAAVEKVEKFVGDATSKGANIMLGGKRHSLGMSFYEPTVVGNVSNDMLLFREEVFGPVAPLIPFKTEEEAIHLANDTNAGLAAYMFTKSIARSWRVSEALEYGLVGVNEGLISTEVAPFGGVKQSGLGREGSKYGMDDYLEIKYVCMGNLG

SEQ ID NO: 4504 - protein, 161 aa, Triticum aestivum
MHPKARIHADPAAPEPDRIDGLPDSLVLLILNKLEDVHSLGRCSAASKRFNGLVPHVHDVCVKIDRVVAVDGDGEDALNLISPKPRNILSHFLKLMLFTIIKPFHSARGPNGAGRPLFPQLAHHSPAQVLRSFTHVRNLHIELPSGDVGTEDGVLLKWRAE

SEQ ID NO: 4505 - protein, 293 aa, Triticum aestivum
REQKLELHRGGGRSRTSGSPGLQEFGTSPNLRGRRSHPIIAPPPPPPAPPDPSLPRHPPGRDRRPPAAGGGGGGSPATGAMEADGAASAEAKPLTPEEEALRRNTDCVYFLASPLTCKKGNQCDFRHSEGARMNPRDCYYWLNGNCLNPKCSFRHPPIDGMFGASTPGIPAVSSHYAAYNSGKQMVPCYYFQKGNCIKGDKCPFSHGPQPAGNNPPEQVAKVSSFPLEQPQTQKNEFLGVKEFAQTNHLIQQGGPISGDRSKSVNRAAANFARTAAAAIPADLASSAVKSLPK

SEQ ID NO: 4506 - protein, 213 aa, Triticum aestivum
  misc_feature (198)..(198): Xaa can be any naturally occurring amino acid
MAHFCPPSPSRFAPSPHIARVGSVDLSVQQILRATQNFSHSFKLGEGGFGTVYRAVLSDGQVVAVKRAKKDQFAGPSDEFSNEVELLAKIDHRNLVRLLGYTDKGNERIIITEYVPNGTLREHLDGQHGRTLDFNQRLEIAIDIAHALTYLHLYAEKTIIHRDVKSSNILLTDSYRAKVSDFGFARSGPSDTEKTHIXTKVKGTAGYLDPEYL

SEQ ID NO: 4507 - protein, 126 aa, Triticum aestivum
RAAARAGARGAKVTDICIIVVSADDGVQPQTNEAIAHAKAARVPVVIAINKVDKEGANPERVMQELSQIGLMPEMWGGDTPMVQISALKGENVDELLETVMLVAELLELKANPHRNAKGTSAATTL

SEQ ID NO: 4508 - protein, 109 aa, Triticum aestivum
  misc_feature (87)..(87): Xaa can be any naturally occurring amino acid
MATETLIPLESNPEVMNKFLQKLGVSSQWGIVDVMGLEPEMLSWVPRPVLSVMLLFPVSDAYEEHKQKEESDILSKGQEVSSNIFYXKQFISNACGTVALVQSVANNTE

SEQ ID NO: 4509 - protein, 129 aa, Triticum aestivum
  misc_feature (10)..(10): Xaa can be any naturally occurring amino acid
  misc_feature (19)..(19): Xaa can be any naturally occurring amino acid
  misc_feature (22)..(22): Xaa can be any naturally occurring amino acid
  misc_feature (24)..(24): Xaa can be any naturally occurring amino acid
  misc_feature (30)..(30): Xaa can be any naturally occurring amino acid
  misc_feature (35)..(35): Xaa can be any naturally occurring amino acid
  misc_feature (42)..(42): Xaa can be any naturally occurring amino acid
  misc_feature (47)..(47): Xaa can be any naturally occurring amino acid
  misc_feature (49)..(49): Xaa can be any naturally occurring amino acid
  misc_feature (52)..(52): Xaa can be any naturally occurring amino acid
  misc_feature (70)..(70): Xaa can be any naturally occurring amino acid
  misc_feature (79)..(79): Xaa can be any naturally occurring amino acid
  misc_feature (97)..(97): Xaa can be any naturally occurring amino acid
  misc_feature (101)..(101): Xaa can be any naturally occurring amino acid
  misc_feature (103)..(104): Xaa can be any naturally occurring amino acid
  misc_feature (112)..(112): Xaa can be any naturally occurring amino acid
MAPTVMASSXTSVAPFQGXKSXAXLPVSRXSNGAXLGSVSNXGRIRXMXVWXIEGIKKFETLSYLPPVKXGRASSSRSXYLIRSKWVPCLEFSKVGXSIFXVXXASPGYYDXRVLGQWEGCLVCTGPQG

SEQ ID NO: 4510 - protein, 168 aa, Triticum aestivum
SGGTGTRNLFPPYGTGTVPGHSPRGGAQVGRAKAGFRDMYLGLRTFTAECVVGIGAGLEASPALGLIGVGSTVVVEGVVGEQQEPFEEGDERKKAAAVCEGSGDVGERVVDCVCGADDDDGERMACCDICEAWQHTRCAGVADTEDVPHVFLCSRCDNDVASFPALNC

SEQ ID NO: 4511 - protein, 101 aa, Triticum aestivum
  misc_feature (71)..(71): Xaa can be any naturally occurring amino acid
  misc_feature (82)..(82): Xaa can be any naturally occurring amino acid
  misc_feature (84)..(84): Xaa can be any naturally occurring amino acid
MAPTVMASSATSVAPFQGLKSTAGLPVSRRSNGASLGSVSNGGRIRCMQVWPIEGIKKFETLSYLPPLSTXALLKQVDYLIXRXKWVPCLEVQAKVGFIFR

SEQ ID NO: 4512 - protein, 123 aa, Triticum aestivum
  misc_feature (60)..(60): Xaa can be any naturally occurring amino acid
  misc_feature (72)..(72): Xaa can be any naturally occurring amino acid
  misc_feature (80)..(80): Xaa can be any naturally occurring amino acid
  misc_feature (82)..(82): Xaa can be any naturally occurring amino acid
  misc_feature (98)..(98): Xaa can be any naturally occurring amino acid
  misc_feature (101)..(101): Xaa can be any naturally occurring amino acid
  misc_feature (109)..(109): Xaa can be any naturally occurring amino acid
  misc_feature (114)..(114): Xaa can be any naturally occurring amino acid
  misc_feature (118)..(118): Xaa can be any naturally occurring amino acid
  misc_feature (121)..(122): Xaa can be any naturally occurring amino acid
MAPTVMASSATSVAPFQGLKSTAGLPVSRRSNGASLGSVSNGGRIRCMQVWPIEGIKKFXTLSYLPPLKHGXLLKQVRLXLXRSKWVPCLEFNKLGSXSRXAQRTPGVXNGRYXTMWXLPXXR

SEQ ID NO: 4513 - protein, 212 aa, Triticum aestivum
  misc_feature (134)..(134): Xaa can be any naturally occurring amino acid
  misc_feature (148)..(148): Xaa can be any naturally occurring amino acid
  misc_feature (158)..(158): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWDNVESLPMFRVEPTPHKVINXVEEVKKEYPDAYVXRIIGFDNMRXVQCVSFIAFKPPGCEGVRQRAKTATHDRPYIKCHLQVLQLLTLLLGFSFLHLIS

SEQ ID NO: 4514 - protein, 162 aa, Triticum aestivum
  misc_feature (94)..(94): Xaa can be any naturally occurring amino acid
  misc_feature (132)..(133): Xaa can be any naturally occurring amino acid
  misc_feature (137)..(137): Xaa can be any naturally occurring amino acid
  misc_feature (154)..(154): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFNKXWVHPPVNNNASLGYYDGRYWDNVESLPNFGCTGPTQVXXLEGXQEGLPDAYFRIIGSTTXRQVQCVSS

SEQ ID NO: 4515 - protein, 467 aa, Triticum aestivum
  misc_feature (274)..(274): Xaa can be any naturally occurring amino acid
  misc_feature (338)..(338): Xaa can be any naturally occurring amino acid
TFPGRKSLTFGTPSSSEQCWRTLSLTSTPVKSITPTNLSQRTLVPLTQVYVNDQFLNWDPENRIKVRIISARAYHSLFMHNMCIRPTEEELESFGTPDFTIYNAGKFPCNRYTHYMTSSTSVDINLGRREMVILGTQYAGEMKKGLFGVMHYLMPKRRILSLHSGCNMGRDGDVALFFGLSGTGKTTLSTDHNRLLIGDDEHCWSDNGVSNIEGGCYAKCIDLSREMEPEIWNAIRVVRQLQDRGGQHPHRGDPCRWTQSLISHEADEERDAVXIVFFQNKAVVCVCVPCRSTMMMMTKNGSMCGSVSFCHRLVLCFRYVQMHCAFVFGTRIGLPDMXSVLSAETLQSSRATGWLVNTGWSGGRYGVGKRIKLPYTRKIIDAIHSGELLTANYQKTEVFGLEIPTAIEGVPSEILDPINTWTDKAAYKETLLKLAGLFGKNFEVFASYKIGEDSTLTEEILAAGPKV

SEQ ID NO: 4516 - protein, 210 aa, Triticum aestivum
  misc_feature (119)..(119): Xaa can be any naturally occurring amino acid
  misc_feature (176)..(176): Xaa can be any naturally occurring amino acid
  misc_feature (186)..(186): Xaa can be any naturally occurring amino acid
SARGPARRRGLADSLACAWPFSWIGRRWLKEDAAAAARSAPAPPADTVAAWYRALECGDRRSAAAEEHRGGGPEGVTPPCDAAHPRCDRRTDTGTGRAPPIRTSVSNISSIYSRAFLSXIHSMFHYGVVGHLEPCNANEHFCRCHEDDTIMLEFKHYAAGSRWRQTTVSRKDHREXKGDETNGFYXGARKMRSKPKTRSRRRLWPVDVLS

SEQ ID NO: 4517 - protein, 164 aa, Triticum aestivum
  misc_feature (133)..(133): Xaa can be any naturally occurring amino acid
  misc_feature (135)..(135): Xaa can be any naturally occurring amino acid
  misc_feature (149)..(149): Xaa can be any naturally occurring amino acid
  misc_feature (157)..(158): Xaa can be any naturally occurring amino acid
ISGRARHVTRRRPHPPPKGQGEGRGIPNPKPRPSARPRLTRSRRPCPVPTTRSLARFHEIPQPAADSLPSPPGSRSALPAGLAGRGQWGKGPRGDGPSAAAPAGVAVAEEGEEDQFDRLPDAVLLDVFNRIGXVXALGRCALVSRRFHXLVPLVDSXXVRVDCV

SEQ ID NO: 4518 - protein, 299 aa, Triticum aestivum
MAAAAPTHAPVSSSACRAGFSSSGVSFPNFRSAAASAPGWRRREPYPAVSVVSSSPQSVAGAITVDTEVDTLLDSVKWDSKGLAVAIAQNVDTGAILMQGFANKEALAKTISTRKATFFSRSRSSLWTKGETSMNFINVHDIFLDCDHDSIIYLGKPDGPTCHTGAETCYYTSVYDALQSSKPNEGRQVMTTLYSLEDTISRRHEEKVTDGGGKPSWTKKLLLDNQLLCSKIREEAGELIQTLLENEDQSRAASEMADLLYHAMVLLRVKDVKMEQVLEVLRKRFSQSGIEEKASRNKS

SEQ ID NO: 4519 - protein, 369 aa, Triticum aestivum
  misc_feature (260)..(260): Xaa can be any naturally occurring amino acid
  misc_feature (292)..(292): Xaa can be any naturally occurring amino acid
  misc_feature (311)..(311): Xaa can be any naturally occurring amino acid
  misc_feature (320)..(320): Xaa can be any naturally occurring amino acid
FITSTHASDGTEMKNDSPINMPSQELGLKISETARCGTEIHDERSILKRSNLSAFTRYHTPMASPKCCPTLIGSHRSMVPGGATFRGSCSPQDNSSEAVETNSTCKMESNSDAAQIKQGSNGSSNNNDMGSSTKNAIAKPCTDRERVMSPSLVKSNQQTSAFHPVQHQVSPADAARKDKASEEIVNAVKVGHSSEAQQSSVQHHHHAHYYRHVIAQQQTLIDRASNARCGSSNASDLPLEGHAANYGVNGSISGSNNGSXTQNASSSAPNIARPNMDSGAMDKTEAGGWHRXVGAGPSGNGNDMVCQNQLXHGEAAVNKXFRQKRKDRNFGKKVRYQSRKRLPEQGPRVRGQFVRQSGQEDEAGQAEDR

SEQ ID NO: 4520 - protein, 228 aa, Triticum aestivum
MATLSSCSRLSTGGGAVQRRPRWPASAATITCHRSSSSSSSARVVRTGAAAAPAAATAPAVPQTNECSLPTWAEFELGKAPVYWKTMNGLPPSAGEGLILFYNPAATKMTPNAQFGIAFNGGFNQPIMCGGEPRQMTLQERGSADPPIYTIRIRVPQHAMTLVFSFTNGVDWDGPYTLKFRVPKPWLNKPLSFFNEGLADELNREGACDRAIFPDENVVITSCEMGSY

SEQ ID NO: 4521 - protein, 94 aa, Triticum aestivum
SQDNCMLGMGSGQPNRVDRLRIVFRKGGQTGKGDALASHAFFPFSWKDAEEEACENRINTIAQPGVRMMDKDAVDCCNKYGVSLLITGDCHFRH

SEQ ID NO: 4522 - protein, 109 aa, Triticum aestivum
  misc_feature (76)..(76): Xaa can be any naturally occurring amino acid
  misc_feature (93)..(93): Xaa can be any naturally occurring amino acid
MAPISKPEITSNIQWVAQMNVDVEPTHGRKTSIIGTIGPKTNSVDMITQLRNAGLNVVRMNFSHGSYEYHQSVIEXTRKSVEIYPGRPVAIAXLDNKGPEIRTGKIWKG

SEQ ID NO: 4523 - protein, 101 aa, Triticum aestivum
  misc_feature (28)..(28): Xaa can be any naturally occurring amino acid
  misc_feature (51)..(51): Xaa can be any naturally occurring amino acid
  misc_feature (72)..(72): Xaa can be any naturally occurring amino acid
  misc_feature (84)..(84): Xaa can be any naturally occurring amino acid
WVISVALDAPISQIPDCAVKQDRLMHVXASSHVTTEMHEDPLPPLRLLGHXSISYPRATAVTENLALPGDIXLHLDALPDIYDXYDGNTYSHTSSFPRIMQ

SEQ ID NO: 4524 - protein, 163 aa, Triticum aestivum
  misc_feature (74)..(74): Xaa can be any naturally occurring amino acid
  misc_feature (110)..(110): Xaa can be any naturally occurring amino acid
  misc_feature (114)..(114): Xaa can be any naturally occurring amino acid
  misc_feature (119)..(119): Xaa can be any naturally occurring amino acid
  misc_feature (126)..(126): Xaa can be any naturally occurring amino acid
  misc_feature (129)..(129): Xaa can be any naturally occurring amino acid
  misc_feature (136)..(136): Xaa can be any naturally occurring amino acid
  misc_feature (142)..(143): Xaa can be any naturally occurring amino acid
GVVLLTSQLSDANTNCPSGLTTVQRQEDANLYRDTFVTSLAEIPGLIVSAILVEWIGRKATMWSMLFTCCAFLXPLVLHQDELLTTALPIPVLAHVPWVLHIPSLNAPEXYPTXIRSTXFGPTTSXGKXGGLMPLXAVRMLXXCHKNLWCYPPGWLIPGKPGR

SEQ ID NO: 4525 - protein, 168 aa, Triticum aestivum
  misc_feature (56)..(56): Xaa can be any naturally occurring amino acid
  misc_feature (87)..(87): Xaa can be any naturally occurring amino acid
  misc_feature (99)..(99): Xaa can be any naturally occurring amino acid
MLVYQDKLSGDELLSDSFPYRELENGVLWEVDGHWVVQGAVDVDIGPNPSAEGGGXDEGVVDQPGKGVALVATFRLKNQPVFAKKQXISHMKRYIKNLXASLKGDDLDAFKKNVESATKYLLSKLKDLQFFVGESMHDDGGVVFAYYKEGAADPTFLYFAHGLKEVKC

SEQ ID NO: 4526 - protein, 170 aa, Triticum aestivum
  misc_feature (34)..(34): Xaa can be any naturally occurring amino acid
  misc_feature (67)..(67): Xaa can be any naturally occurring amino acid
  misc_feature (125)..(125): Xaa can be any naturally occurring amino acid
MLVYQDKLSGDELLSDSFPYRELENGVLWEVDGXWVVQGAVDVDIGANPSAEGGGDDEGVDDQAVKXVVDIVDTFRLQEQPAFDKKQFISHMKRYIKNLSAKLEGDDLDAFKKNVESATKYLSLXKLKDLQFFVGESMHDDGGVVFAYYKEGAADPTFLYFAHGLKEVKC

SEQ ID NO: 4527 - protein, 514 aa, Triticum aestivum
MPGGGFAVSAPSGVEFEAKITPIVIISCIMAATGGLMFGYDVGISGGVTSMDDFLREFFPAVLRRKNQDKESNYCKYDNQGLQLFTSSLYLAGLTATFFASYTTRRLGRRLTMLIAGVFFIIGVIFNGAAQNLAMLIIGRILLGCGVGFANQAVPLFLSEIAPTRIRGGLNILFQLNVTIGILFANLVNYGTSKIHPWGWRLSLSLAGIPAAMLTLGALFVTDTPNSLIERGHLEEGKAVLKRIRGTDNVEPEFNEIVEASRIAQEVKHPFRNLLQRRNRPQLVIAVLLQIFQQFTGINAIMFYAPVLFNTLGFKSDASLYSAVITGAVNVLATLVSVYAVDRAGRRALLLEAGVQMFLSQVAIAVVLGIKVTDKSDNLGHGWAILVVVKVCTYVASFAWSWGPLGWLIPSETFPLETRSAGQSVTVCVNLLFTFLMAQAFLSMFCHLKFAMFILFSAWVLVISVFVLFFLPDTKNVPMEEMTDKVWKQHWLWKRFMDDDDQHHNIANGKNAPV

SEQ ID NO: 4528 - protein, 232 aa, Triticum aestivum
  misc_feature (33)..(33): Xaa can be any naturally occurring amino acid
  misc_feature (61)..(61): Xaa can be any naturally occurring amino acid
  misc_feature (136)..(136): Xaa can be any naturally occurring amino acid
MATAAGSSSQIGNLELLGVGGVGECRLMLRFVXVKLVVVEFSATRVGSSFFSQALNVDDEXTVKFEIWETAGQERYHSLAPMYYRGAAAAIVVYDITNQASFTRAKKKVQELQAQGNQNTVVARAGNKADLLKARXVEIEEPMTYAQENGLFFMESSAKTATNANDIFYEIAKRFLQGQAAQNPQATRMVLSQGPLQRVLSAASCCSSRSILNLVTFVVCEKFWDRNLARLS

SEQ ID NO: 4529 - protein, 101 aa, Triticum aestivum
ITTAESAELGTHSSLNGNSRALATVTAIIDGTGSVGAAIGPLLTGYISSKSWSAVITMLMAAALLAGLLLTKLVCAELKGKTPSNASKDVADAEGTYSDEV

SEQ ID NO: 4530 - protein, 100 aa, Triticum aestivum
  misc_feature (39)..(39): Xaa can be any naturally occurring amino acid
  misc_feature (68)..(68): Xaa can be any naturally occurring amino acid
  misc_feature (70)..(70): Xaa can be any naturally occurring amino acid
  misc_feature (74)..(74): Xaa can be any naturally occurring amino acid
  misc_feature (79)..(79): Xaa can be any naturally occurring amino acid
  misc_feature (85)..(85): Xaa can be any naturally occurring amino acid
  misc_feature (88)..(88): Xaa can be any naturally occurring amino acid
  misc_feature (90)..(90): Xaa can be any naturally occurring amino acid
  misc_feature (96)..(97): Xaa can be any naturally occurring amino acid
SSATTAAPFQGLKSTAGLPVSRRSCSAGLSSVSNGGRIXRCMQVWPIEGIKKFETLSYLPPLSKEALXKXVDYXIRSSXVPASNXTKXGXSSGEQXXSPR

SEQ ID NO: 4531 - protein, 66 aa, Triticum aestivum
  misc_feature (3)..(3): Xaa can be any naturally occurring amino acid
  misc_feature (14)..(14): Xaa can be any naturally occurring amino acid
  misc_feature (18)..(18): Xaa can be any naturally occurring amino acid
  misc_feature (23)..(23): Xaa can be any naturally occurring amino acid
  misc_feature (27)..(28): Xaa can be any naturally occurring amino acid
  misc_feature (35)..(35): Xaa can be any naturally occurring amino acid
  misc_feature (40)..(41): Xaa can be any naturally occurring amino acid
  misc_feature (49)..(49): Xaa can be any naturally occurring amino acid
QAXGRVAHATLKGXCVVXEIFIXLTLXXVAGGMWXMHHWXXHTKTRSFXDMLEKGQDRRCVLKCRF

SEQ ID NO: 4532 - protein, 172 aa, Triticum aestivum
  misc_feature (94)..(95): Xaa can be any naturally occurring amino acid
  misc_feature (109)..(109): Xaa can be any naturally occurring amino acid
  misc_feature (120)..(120): Xaa can be any naturally occurring amino acid
  misc_feature (129)..(129): Xaa can be any naturally occurring amino acid
  misc_feature (132)..(132): Xaa can be any naturally occurring amino acid
  misc_feature (135)..(135): Xaa can be any naturally occurring amino acid
  misc_feature (144)..(144): Xaa can be any naturally occurring amino acid
  misc_feature (156)..(156): Xaa can be any naturally occurring amino acid
  misc_feature (159)..(159): Xaa can be any naturally occurring amino acid
  misc_feature (164)..(164): Xaa can be any naturally occurring amino acid
  misc_feature (168)..(168): Xaa can be any naturally occurring amino acid
GASGKDIAMEVRRVAKEVHLVAKSMEEVTQELAKVLSKYSASLHLQLHVERLCEDGRVVFGDGSSILADTIIYCTGFNYSFPFLDTEGAVTVDXXCVGPLFEHVFPPSXAPSLSFVGIPXKVFAPWVLXAQXKWXAQVLSGKRXLPPEEEIVRSVXDIXRQEAXGAPXNYTT

SEQ ID NO: 4533 - protein, 179 aa, Triticum aestivum
MAFAPKASSSAPSLSRPMRCGTVASVAVPVPLPGRPVVRAVAAAAVASLEPAVTVPAPALAGRSASLSAAGKRGLSVAEAMSRGRANGKTAFIPYITAGDPDLATTAEALKLLDSLGADVIELGLPFSDPSADGPVIQASAARALAAGATTDAVMSMLKEVTPELSCPVVIFSYFSPIL

SEQ ID NO: 4534 - protein, 376 aa, Triticum aestivum
  misc_feature (287)..(288): Xaa can be any naturally occurring amino acid
  misc_feature (296)..(296): Xaa can be any naturally occurring amino acid
  misc_feature (305)..(305): Xaa can be any naturally occurring amino acid
  misc_feature (312)..(312): Xaa can be any naturally occurring amino acid
  misc_feature (317)..(317): Xaa can be any naturally occurring amino acid
MAKGTPATGWAAKDPSGVLSPYSFSRRALKDDDVTIKVLFCGICHTDLHIAKNEWGNALYPVVPGHEIVGVVTDAGPGVKNFKAGDTVGVGYFVDSCRSCVSCGSGHENHCPTLVLTSNAVDYDGATTQGGFSDVLVVDQGYVVRVPEGLPLDGAAPLLCAGVTVYSPMMEFGLNAPGKHLGVVGLGGLGHMAVKFGKAFGMTVTVISSSPSKREEAVERLGADAFLVSQDPEQMKAAAGTMDGIIDTVSAGHPIVPLLELLKPRGQLVVVGAPSTPLELPAYAIIXXGQRVAGNXVGSIGSCQXMLDFAGXHGITXTSRRQDDYVHTPSNAGKDHLKYVCHQFPGPIGPPLNHPVVCTLSPTKRIGVFPMGGGQP

SEQ ID NO: 4535 - protein, 125 aa, Triticum aestivum
MDILLGSGRFLARRLPPLALVPRCSRGSPDKSGSDKGETSTDWDKAWASFKNKGKRTLFSDFSPNKYVTWNPRRSEYPLSEEVDPIKRTERSNLMLWTSPQFTLVGAIIIVLTLLIYTLVVPPPK

SEQ ID NO: 4536 - protein, 278 aa, Triticum aestivum
  misc_feature (62)..(62): Xaa can be any naturally occurring amino acid
  misc_feature (83)..(83): Xaa can be any naturally occurring amino acid
  misc_feature (88)..(88): Xaa can be any naturally occurring amino acid
  misc_feature (123)..(123): Xaa can be any naturally occurring amino acid
RGGRPRDFSGNARPFSRVPPFRLFSARGSPALFPGRGSNFPPIWLGLMGFSHWETSIITGFXPVATGLGGVFGGVVGDPVSRXFPDAXRIALAQISSGPALPVGAVLLLGLPTDPSTGPAHAXVFFVMGFAISWNASSTNNPIFAEIVPAKARTTVYALDKCFESVFASFAPPVVGILAERVFGYKPVSSESSVDMDRENAAALAKAMYVELAVPMAICSLTYALLYCTYPRDRDTVNLMASEEDDGGESSAFRAHQDEESSPVGSLTQRLIPTTTTD

SEQ ID NO: 4537 - protein, 145 aa, Triticum aestivum
MAKMLVSDEARKEFNTLRRTFEDVNHQLQTKFSQEPQPIDWEYYRKGIGSKVVDMYKEAYESIEIPKYVDTVTPQYKPKFDALLVELKEAEKESLKESERIEKELAELQEMKKNISTMTADEYFAKHPEVKQKFDDEIRNDNWGY

SEQ ID NO: 4538 - protein, 207 aa, Triticum aestivum
METEVGSPATATAAPINFSLPVDSEHKAKSIKIFSFGNPHMRAFHLGWMSFFTCVVSTFAAAPLIPIIRDNLNLTKADIGNAGVASVSGAIFSRLAMGAICDLLGPRYGCAFLVMLSAPAVFCMSVIDGPGGYITIRFLIGVSLATFVSCQYWISTMFNSKIIGTVGGLTAGWGDMGGGATQLIMPLVFDGILACGATRFTAWRIAY

SEQ ID NO: 4539 - protein, 147 aa, Triticum aestivum
  misc_feature (83)..(83): Xaa can be any naturally occurring amino acid
  misc_feature (91)..(91): Xaa can be any naturally occurring amino acid
  misc_feature (97)..(97): Xaa can be any naturally occurring amino acid
  misc_feature (101)..(101): Xaa can be any naturally occurring amino acid
  misc_feature (123)..(123): Xaa can be any naturally occurring amino acid
  misc_feature (130)..(131): Xaa can be any naturally occurring amino acid
  misc_feature (136)..(137): Xaa can be any naturally occurring amino acid
  misc_feature (140)..(140): Xaa can be any naturally occurring amino acid
KQVKWYYVVIAYVVAPMLGFANSYGTGLTDINMGYNYGKIALFVFAGWAGKDNGVIAGLVAGTLVKQLVLISADLMQDFKTGXLTQTSPKXMMIAQXFGTXMGCITPPHFMLFYKHLILGTIXTWGGPYXXYTAIXXLGXEGSNVTE

SEQ ID NO: 4540 - protein, 156 aa, Triticum aestivum
MDASATGAVSKAKKYVVGRKLGGGPRKKAVARSVKAGLQFPVGRIGRFLKKGRYAQRVGMGAPVYLASVLEYLAAELLELAGNAAKDNKKSRIIPRHLLLAIRNDQELGKLLAGVTIAHGGVLPNINPVLLPKKTAEKDPKSPKKAPKSPKSPKKA

SEQ ID NO: 4541 - protein, 131 aa, Triticum aestivum
MARSVSYVSAAKLVSMARGNPRLAIIDVRDEERSYQAHIAGSHHFASGSFEARMPELVRAASGKDTLVFHCALSQVRGPTCARMFSDYLSETKEDSGIKNIMVLELGFNGWEGSGQPVCRCTDAPCKGTCC

SEQ ID NO: 4542 - protein, 166 aa, Triticum aestivum
  misc_feature (92)..(92): Xaa can be any naturally occurring amino acid
  misc_feature (102)..(102): Xaa can be any naturally occurring amino acid
  misc_feature (116)..(116): Xaa can be any naturally occurring amino acid
  misc_feature (146)..(146): Xaa can be any naturally occurring amino acid
  misc_feature (148)..(148): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREXHNASPGYYDGRYWXTMWKLPMFGCTDATQVINEVEEVKKEYPDXYXRIIGFDNIRQVQCVSSSP

SEQ ID NO: 4543 - protein, 197 aa, Triticum aestivum
MSAVNLTNVAVLNNPTSFVNPFQFEISYECLVALEDDLEWKLIYVGSAEDENYDQQLESVLVGPVNVGTYRFVLEADPPDPSKIREEDIIGVTVLLLTCSYMGQEFIRVGYYVNNDYDDEQLREEPPAKLLIDRVQRNILTDKPRVTKFPINFHPETSGGQQQDQPQSAVPENHTSKGSKAKRRSLTGSGNLGMPKF

SEQ ID NO: 4544 - protein, 160 aa, Triticum aestivum
  misc_feature (55)..(56): Xaa can be any naturally occurring amino acid
  misc_feature (121)..(121): Xaa can be any naturally occurring amino acid
  misc_feature (128)..(128): Xaa can be any naturally occurring amino acid
  misc_feature (132)..(132): Xaa can be any naturally occurring amino acid
  misc_feature (136)..(136): Xaa can be any naturally occurring amino acid
  misc_feature (147)..(147): Xaa can be any naturally occurring amino acid
  misc_feature (152)..(152): Xaa can be any naturally occurring amino acid
VNPRLGFNVELKFDDSLEYTEEELTRILQAILKVVFEYAKDRPILFSSFQPDAAXXMRKLQGTYPVYFLTNGGTELYADVRRNSLEEAVKLCLAGGLQRIVSEARGIFRHPAAVPKIKEAXLSLLTYXTLNXVPEXVYMQHLIGVNXVIVEXVPEINRGF

SEQ ID NO: 4545 - protein, 109 aa, Triticum aestivum
  misc_feature (14)..(14): Xaa can be any naturally occurring amino acid
  misc_feature (26)..(26): Xaa can be any naturally occurring amino acid
NFEYQNYTVITSMXKGPKYPPKDCLXILSREFACPFNNYINDESNDCASTMFSYINLYGKYPPGLFAHECREGKLGLSCEGVPQKDVVKSGVQKGSKQLACFDYSHCVD

SEQ ID NO: 4546 - protein, 160 aa, Triticum aestivum
  misc_feature (32)..(32): Xaa can be any naturally occurring amino acid
  misc_feature (34)..(34): Xaa can be any naturally occurring amino acid
  misc_feature (43)..(43): Xaa can be any naturally occurring amino acid
  misc_feature (61)..(61): Xaa can be any naturally occurring amino acid
  misc_feature (81)..(81): Xaa can be any naturally occurring amino acid
  misc_feature (94)..(94): Xaa can be any naturally occurring amino acid
  misc_feature (105)..(105): Xaa can be any naturally occurring amino acid
SGSATAHLINSFHTPQGAIQAKQQVSILFKSXSXSFLWSMFHXAFYTAGDSCGFGSFPTFXDGGVQPGGFYFRLLARTYFXGGGWIPAPYIIKXSRLLIGGAINXPWGGNQCWAPFRRSKEGGGPGYRPNPPQTKPNGPSNGLTKVSILPRPMDMGGTAS

SEQ ID NO: 4547 - protein, 341 aa, Triticum aestivum
  misc_feature (51)..(51): Xaa can be any naturally occurring amino acid
  misc_feature (158)..(158): Xaa can be any naturally occurring amino acid
MAQTPPIPRVSLGTQGLEVSKLGFGCMGLTGSYNSPVEDDAGIAVITHAFXAGVTFFDTSDVYGPHANEILLGKALKQLPREQVQVATKFGIQRDAQGKSTICGRPEYVRACCEASLHRLGVDHIDLYYQHRIDTTIPIEDTIGELKKLVGEGKVKYXGLSEASPDTIRRAHAVHPISAVQMEWSLWARDIEPEIVPLCRELGIGIVPYSPIARGFFGGRGVTQQVSAESSLKGHPRFSAENLEKNKQLYLKMEELAKKHQCSPAQLALSWVLHQGDDVVPIPGTTKIKNLDSNIDSLTVRLTEDDLKEISNEIREEDVAGGRQYTSFAKFTWNYADTPKK

SEQ ID NO: 4548 - protein, 73 aa, Triticum aestivum
  misc_feature (22)..(22): Xaa can be any naturally occurring amino acid
MIEVVLNDRLGKKVRVKCNDDXTIGDLKKLVAAQTGTRADKIRIQKWYTIYKDHITLKDYEIHDGMGLELYYN

SEQ ID NO: 4549 - protein, 196 aa, Triticum aestivum
TWMVIFSLFWTLGTILEASLAWVVLPALNWRWLLVFTALPCFLLLPFFGLTPESPRYLCAQNRMSDATAVLERMANANQSALPPGILTYNRQTKFDDDALASESECLLPVREKECTVDNAKSSESGCLASLRILLSRKLLRSTLLLWFVFYANSFAYYGLVLLTSQLSDANKNCASGVNVGLHQKVTNLYKDTFIT

SEQ ID NO: 4550 - protein, 497 aa, Triticum aestivum
  misc_feature (261)..(261): Xaa can be any naturally occurring amino acid
MARKMLKDGEAPLVADDGGTYDYDLFVIGAGSGGVRGSRTAAGFGAKVAICELPFHPISSEWLGGHGGTCVIRGCVPKKILVYGASFRGEFDDAKQFGWEINGDINYNWKKLLENKTQEIVRLNGVYKRILGGSGVTMIEGAGSIVDAHTVEVTQPDGSKQRHTTKHILIATGSRATLVDIPGKELAITSDEALSLEELPKRAVILGGGYIAVEFASIWKGLGAEVDLFYRKELPLRGFDDEMRTVVASNLEGRGIRLHPXGTNLTELSKTADGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAEAKNDLLVYTSSFNPMKNSISKRVEKSTMKLVVDADTDKVLGAAMCGPDAAEIMQGIAVALKAGATKATFDSTVGIHPSAAEEFVTMRTLTRRVSPPSKPKTNL

SEQ ID NO: 4551 - protein, 403 aa, Triticum aestivum
  misc_feature (156)..(156): Xaa can be any naturally occurring amino acid
SIIKQALAVGCFPRVKIIHTSKKYLGQIYSPDINWILMVLCIAVTAGFKNQSQIANAYGTAVIMVMRGTTFLMIPIMLLVWRSRWASARRFTVLSLAVEIPYLTAVLKKIDQGGWVPLVFAAAILLVMYVWHYGTLKRYEFEMHSKVSMAWILGLXGPSLGLVRVPGIGLVYTELASGVPHIFSHFITNLPAIHSTLVFVCVKYLPVYTVPLDERFLVKRIGPKNFHMFRCVARYGYKDIHRKDDDFEKMLFSSLLLFIRLESMMEEYSDSDEYSALDQQELIDEASSDARSAADLSYASRDSIVPVRSPNHLGAMSSAQATTATPGFETVGDEVTFLNSCRDAGVVHILGNTVIRARRDSGPLKKLAIDYLYAFLRKICRENSAIFNVPHESLLNVGQVFYV

SEQ ID NO: 4552 - protein, 195 aa, Triticum aestivum
  misc_feature (64)..(64): Xaa can be any naturally occurring amino acid
STLLLWFVFYANSFAYYGLVLLTAQLSNANRSCASGLKYVKSETDASLYKDTFVTSLAEIPGSXASALLVEWFGRKATMWCLLFTCCGFLGPLVFYQSELWTTGLLFGARACAMGSYTVVCLYAPEVYPTSVRSTGVGIATAMGRVGGIICPLVAVGMLRSCHQMEAIIVFEVVLFLAAIACMLFPFETKGRAMN

SEQ ID NO: 4553 - protein, 120 aa, Triticum aestivum
HYRTSLYKKAGWYRSGIPGISSTHASATGLLFGARACAMGSYTVVCLYAPEVYPTSVRSTGVGIATAMGRVGGIICPLVAVGMLRSCHQMEAIIVFEVVLFLAAIACMLFPFETKGRAMN

SEQ ID NO: 4554 - protein, 366 aa, Triticum aestivum
  misc_feature (84)..(84): Xaa can be any naturally occurring amino acid
MALLKAARVADVPSLDVVVPDHLAAAARVLDAESAAAMKRQQRGAGRRFAVIGHRGKGMNALASPDRRLQEVKENSIRSFNASXPIIFHDNFIITEEHGKISEKRVTDLQLEDFLQYGPQNKQGKNGKPLLRKMKDGRVLNWSVQSDDPLCTLQEAFEKVNPRLGFNVELKFDDNLVYQDEELTHILQAILKVVFECAKDRPIIFSSFQLDAAQLMRKLQSTYPVYFLTNGGTEVYADVRRNSLEEAVKLCLATGMQGIVSEARAVFRFPTAIPKIKEADLSLLTYGTLNNVPEAVYMQHLMGVNGVIVDLVPEITGAVSDLIALPETDVEINDLSGQVAKDAASTPNFTQREISFLLRLMPELVQ

SEQ ID NO: 4555 - protein, 162 aa, Triticum aestivum
  misc_feature (116)..(116): Xaa can be any naturally occurring amino acid
  misc_feature (127)..(127): Xaa can be any naturally occurring amino acid
  misc_feature (134)..(134): Xaa can be any naturally occurring amino acid
  misc_feature (143)..(143): Xaa can be any naturally occurring amino acid
  misc_feature (154)..(154): Xaa can be any naturally occurring amino acid
AENKVLDPKKAQNIAILLRALNVTKEEVSDALCEGNTENFGADLLETLLKMAPTKEEEIKLREFKEESSPVKLNPAEKFLKAVLDVPFAFKRVDAMLYIANFDAEVNYLKKSFETXEAACDELRSSXLFLKLLXEAVLKTGNXMNVGTNRGDHXFKLDTLLK

SEQ ID NO: 4556 - protein, 198 aa, Triticum aestivum
  misc_feature (112)..(112): Xaa can be any naturally occurring amino acid
  misc_feature (132)..(132): Xaa can be any naturally occurring amino acid
  misc_feature (139)..(139): Xaa can be any naturally occurring amino acid
  misc_feature (147)..(147): Xaa can be any naturally occurring amino acid
  misc_feature (156)..(156): Xaa can be any naturally occurring amino acid
  misc_feature (162)..(162): Xaa can be any naturally occurring amino acid
  misc_feature (176)..(176): Xaa can be any naturally occurring amino acid
IMSFWDRLCKVLHVRKVTVMDISKKQGMDYRLLHAITTGHPWYGEWGYKFGAGSFAHTSDTYQEAVDVLSGIHLALYSSHRSPIRTPLQNTIALYWSLSDRQLVTVRDLFRXFIMHLLHQARKDAETSKPTXDEHRELXSNVLCMWXTNEDINRAXTAMLKXLRAVKLGRWVSWRXLKGTASKVLITGTLIPQVGEMM

SEQ ID NO: 4557 - protein, 255 aa, Triticum aestivum
RLVPEEAIPEVSTYLCESFGNKARIDYGTGHEANFMAWLLCLEKLNVLEQKDDTVVVLRIFVKYIRVMRHLQFEYWLEPAGSHGVWGLDDYHFLPFLFGSSQLLDHKYIKPKSIHDKDVVDQFHQSYMYLACIHFINSVKTTASLRWHSPMLDDISACKTWAKVNQGMIKMYKAEVLAKLPIMQHFMFGSLISFDGGQVMSAELDSHCGHVHNTDNQETENEQEYPECCGIPVPSAIAAAAVSKNTSIFRPLPFD

SEQ ID NO: 4558 - protein, 144 aa, Triticum aestivum
MPRAGLSAGSSKVDVAIDLGNPLLNRTVDGFLKIGAVGACRVAAEDAFDCLQSGSVSKRKLEKTLEKMCKEGAYWGAVAGVYVGMEYGVERVRGEYDWKNALIGGIASGALISAASNNKGNKIAKDAITGGAIATAVEFINYLT

SEQ ID NO: 4559 - protein, 163 aa, Triticum aestivum
  misc_feature (110)..(110): Xaa can be any naturally occurring amino acid
MPSAGVSAGSNKVDVAIDLGNPLLNRTVDGFLKIGAVGACRVVAEDAFDCIHRGDISKRQLEETLKKMCKEGAYWGAVAGVYVGMEYGVERARGDRDWKNALLGGIATGXALVSAATNNKGNKIAQDAITGGAIATAVEFINYLHLGVRPSIFAATFLSGKTE

SEQ ID NO: 4560 - protein, 145 aa, Triticum aestivum
  misc_feature (130)..(130): Xaa can be any naturally occurring amino acid
MPSAGLEAGSNKVDVAVDLGNPLLNRTVDGFLKIGAVGACRVVAEDAFDCIHRGDISKRQLEETLKKMCKEGAYWGAVAGVYVGMEYGVERARGDRDWKNALIGGIATGALVSAATNNKGNKIAQDAITXGGAIATAVEFINYLT

SEQ ID NO: 4561 - protein, 336 aa, Triticum aestivum
MAPLGDAVAPASAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAAMRAAKSAGILCSYDPNVRLPLWPSAQAARDGIMSIWKEADFIKVSDEEVAFLTQGDATDEKNVLSLWFEGLKLLIVTDGEKGCRYFTKDFKGSVPGYSVNTVDTTGAGDAFVGSLLVSVSKDDSIFYNEAKLREVLQFSNACGAICTTKKGAIPALPTTATALELISKGSN

SEQ ID NO: 4562 - protein, 232 aa, Triticum aestivum
  misc_feature (213)..(213): Xaa can be any naturally occurring amino acid
MEPPRSRRTRNAAVPTACFLLLLLTLPLSARHHDSTAVPTLRHAVHRAALSSPFYAARPRGDCQELQSLDGAEARCAYLLSHTPCAPAGYVDYLRLFYCGFAGAGHPAAGYAASLLWLVVLFYLLGDTASEYFCASLEGLSAALRLSPAVAGVTLLSLGNGAPDVFASVVSFAAGDGGDGGGVGLNSALGGALFVSTVVAGVVALAAGSRGGXVVELRGFVRDLCFLFFALC

SEQ ID NO: 4563 - protein, 369 aa, Triticum aestivum
  misc_feature (309)..(309): Xaa can be any naturally occurring amino acid
DEHAASATPLLAPYKMGKFDLSHRVVLAPLTRQRSFGNVPQPHAILYYQQRATKGGLLIAEATGVSDTAQGYKDTPGIWTKKQVEAWKPIVDGVHVKGGIFFCQIWHVGRVSNHNFQPNGQAPISSTDKPIKPATRADGIGLAKISTPRRLQTDEIQLVIEDFRVAARNAIEAGFDGVEIHGAHGYLIDQFLKDQVNDRTDKYGSLENRCRFALEVVQAVADEIGADKVGIRLSPFASYSDASDSNPEALGLYMAQALNKLGILYCHMVEPRMVNIGEKLETPHSLHAMRDAFKGTFIVAGGIGRDDGXKAIADGYADLVAFGRLFLSNPDLPRRFEIDGPLNKYNRDTFYLSDPVIGYTDYPFLPSDV

SEQ ID NO: 4564 - protein, 370 aa, Triticum aestivum
MSNAASATPLLAPYKMGKFDLSHRVVLAPLTRERSFGNVPQPHAVLYYQQRATKGGLLIAEATGVSDTAQGYKDTPGIWTKKQVEAWKPIVDGVHAKGGIFFCQIWHVGRVSNHAFQPNGQAPISSTDKPIKPATRADGIGLAKVSTPRRLETDEIPLVIDDFRVAARNAIEAGFDGVEIHGAHGYLIDQFLKDQVNDRTDKYGGSLENRCRFALEVVQAVADEIGADKVGIRLSPFASYSEASDSNPEALGLYMAQALNKLGILYCHMVEPRMVNIGEKLETPHSLRPMRDAFKGTFIVAGGYGRDDGDKAIADGYADLVAYGRLFLSNPDLPRRFEMDGPLNKYNRDTFYLSDPVIGYTDYPFLPSDV

SEQ ID NO: 4565 - protein, 145 aa, Triticum aestivum
  misc_feature (2)..(2): Xaa can be any naturally occurring amino acid
  misc_feature (17)..(17): Xaa can be any naturally occurring amino acid
  misc_feature (22)..(22): Xaa can be any naturally occurring amino acid
  misc_feature (28)..(28): Xaa can be any naturally occurring amino acid
  misc_feature (33)..(33): Xaa can be any naturally occurring amino acid
  misc_feature (37)..(37): Xaa can be any naturally occurring amino acid
  misc_feature (40)..(40): Xaa can be any naturally occurring amino acid
  misc_feature (44)..(44): Xaa can be any naturally occurring amino acid
  misc_feature (55)..(55): Xaa can be any naturally occurring amino acid
  misc_feature (58)..(58): Xaa can be any naturally occurring amino acid
  misc_feature (91)..(91): Xaa can be any naturally occurring amino acid
  misc_feature (96)..(96): Xaa can be any naturally occurring amino acid
  misc_feature (104)..(104): Xaa can be any naturally occurring amino acid
  misc_feature (114)..(114): Xaa can be any naturally occurring amino acid
  misc_feature (120)..(120): Xaa can be any naturally occurring amino acid
  misc_feature (135)..(135): Xaa can be any naturally occurring amino acid
MXPNVMGSSGTSVAPFXGLKSXAGLPVXRRSNXANLXSVXSNGXRIRCMQVWAIXGIXKFETLSYLPTLNTEALLKQVDYLIRSKWVPCLXEFNKXGFIFREHXNASPGYYDGXRYWTMXETAYVPGCTDPHKVXKPSGRSKKEP

SEQ ID NO: 4566 - protein, 214 aa, Triticum aestivum
  misc_feature (21)..(21): Xaa can be any naturally occurring amino acid
MAASAGAGAGGRKLRNAKLVXLGDVGTGSSRLDAPVRQWASFVAFQESTIGAACFSSETWAVNDDDGQVTKSWATRPAMEDGDHSLAPMYYRGAAAAIVVYEITNAASFTRAKKWVQELQAQGNPNTVMALAGNKADMLEARQVPVEEATTYAQENGLFFIETSAKTAINVNDVFYELAKRLLAGQQAQNPQAGMVLSQRPAERMVSSTSCCSS

SEQ ID NO: 4567 - protein, 235 aa, Triticum aestivum
  misc_feature (98)..(98): Xaa can be any naturally occurring amino acid
  misc_feature (103)..(103): Xaa can be any naturally occurring amino acid
  misc_feature (119)..(119): Xaa can be any naturally occurring amino acid
  misc_feature (149)..(149): Xaa can be any naturally occurring amino acid
  misc_feature (156)..(156): Xaa can be any naturally occurring amino acid
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKEXLLPSXEGDDLRCFKKMLIRHXYFLAAQDLKALQYFVGESMHDDCGVGVRYXQEGAVSXPILYFAHGLEGQLLALYAKIYACSIFGPYLCCQPTLNVWFSTCQIFSGLKLSDIVGFVPWAGPPIPGALGAGLLNWAQF

SEQ ID NO: 4568 - protein, 118 aa, Triticum aestivum
ALPQHCLQLCAAFFAFAVLANLARDFPAGAGVVYTVPRPRPRAMAVPFLVGASFAIDMCVGSLVVFLWHWLDGKKAALLIPAVASGLICGDGIWIFPSSLLALAKIKPPMCMKFTPGS

SEQ ID NO: 4569 - protein, 158 aa, Triticum aestivum
  misc_feature (90)..(90): Xaa can be any naturally occurring amino acid
  misc_feature (105)..(106): Xaa can be any naturally occurring amino acid
  misc_feature (122)..(122): Xaa can be any naturally occurring amino acid
  misc_feature (124)..(125): Xaa can be any naturally occurring amino acid
  misc_feature (130)..(130): Xaa can be any naturally occurring amino acid
  misc_feature (137)..(138): Xaa can be any naturally occurring amino acid
  misc_feature (154)..(154): Xaa can be any naturally occurring amino acid
MAAGRELVVSFGEMLIDFVPTVAGVSLAEAPAFLKAAGGAPANVAIAVSRLGGGAAFVGKLGDDEFGRMLAAILRDNGVDGGGVVFDAGXARTALAFVTLRADGXXIHFYRNPNAESPHCRXLXXRLIRXGCVFHYXXISLIADLAGNNLRAMXIAKR

SEQ ID NO: 4570 - protein, 129 aa, Triticum aestivum
  misc_feature (69)..(69): Xaa can be any naturally occurring amino acid
  misc_feature (86)..(86): Xaa can be any naturally occurring amino acid
MDSGSDSDGAPEELTAVQGVEKHEEISKVEKDSAVRATQEEKDRRKRWAQRKTSSKTRIKRSLMKIARXKDTEVDEETHAMPGTLXPKSVIEMLAAREKQAFSSDSEEENVNQNVQKKKKRLKTSNYWT

SEQ ID NO: 4571 - protein, 174 aa, Triticum aestivum
  misc_feature (139)..(139): Xaa can be any naturally occurring amino acid
MDVSGAGGKAKKGAAGRKAGGPTKKSVSRSSRAGLQFPVSRVGRYLKKGRYAQRVGTGAPVYLAAVLEYLAAEVLELAGNAARDNKKTRIIPRHVLLAIRNDEELGKLLAGVTIAHGRRLPNIHTVLLPKKVAEKAAKXSPKRAAKSPKKGMCRPSHIHFPSSSYVSNSSHTLQ

SEQ ID NO: 4572 - protein, 138 aa, Triticum aestivum
  misc_feature (58)..(58): Xaa can be any naturally occurring amino acid
  misc_feature (96)..(96): Xaa can be any naturally occurring amino acid
  misc_feature (101)..(101): Xaa can be any naturally occurring amino acid
  misc_feature (108)..(108): Xaa can be any naturally occurring amino acid
  misc_feature (110)..(110): Xaa can be any naturally occurring amino acid
  misc_feature (126)..(126): Xaa can be any naturally occurring amino acid
  misc_feature (131)..(131): Xaa can be any naturally occurring amino acid
  misc_feature (134)..(134): Xaa can be any naturally occurring amino acid
MAPTVMASSATSVAPFQGLKSTAGLPVSRRSNGASLGSVSNGGRIRCMQVWPIEGIKXFETLSYLPPLSTEALLKQVDYLIRFKWVLASSQQVGSXSVEHXRNSGYYXWXFWTMWKLPILGALTHXVLTKXEEXKKTL

SEQ ID NO: 4573 - protein, 140 aa, Triticum aestivum
  misc_feature (120)..(120): Xaa can be any naturally occurring amino acid
  misc_feature (128)..(128): Xaa can be any naturally occurring amino acid
  misc_feature (130)..(130): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPXFGCTDATXVXNEVEESRRST

SEQ ID NO: 4574 - protein, 182 aa, Triticum aestivum
  misc_feature (160)..(160): Xaa can be any naturally occurring amino acid
VPPPSKLYTYIVQPWRPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVXINGFTTSSVNANSPATGSRSEG

SEQ ID NO: 4575 - protein, 567 aa, Triticum aestivum
  misc_feature (116)..(116): Xaa can be any naturally occurring amino acid
  misc_feature (127)..(127): Xaa can be any naturally occurring amino acid
  misc_feature (313)..(313): Xaa can be any naturally occurring amino acid
  misc_feature (332)..(332): Xaa can be any naturally occurring amino acid
  misc_feature (378)..(378): Xaa can be any naturally occurring amino acid
  misc_feature (393)..(393): Xaa can be any naturally occurring amino acid
  misc_feature (398)..(398): Xaa can be any naturally occurring amino acid
  misc_feature (433)..(433): Xaa can be any naturally occurring amino acid
  misc_feature (502)..(502): Xaa can be any naturally occurring amino acid
IVPASAARSSWLLPPRGGPPPRSPPAACSPRPAASPAAVPSALRRADGARGLLPGTPSGVRHCGSSRRSPFRLLSKWATITAPYQRQIPVAAASGKTLPDCGTRRTGEVIARVAEXGDAEDVDRAAXAARKAFDEGPWPRMTAYERSRILLRFADLIEKHNDDIAALETWDNGKPYEQAAHIEVPMLVRLMRYYAGWTDKIHGLIVPADGPHHVQVLHEPIGVVGQIIPCDFPHLMYRAKILPPLACGDTILLKTAEQTPLSALYVSKLLHEAGLPEGVLNIVSGFGPTAGAALASHMDVDKIAFTGSTATGXVILELSARSNLKRVRLGRXGKTPFIVMDDVHIEPAPESSHISLCFIHGHSCGAGCRTFVYMSVYXERFLRKSKARALKRXVVGDXPFRKGVEQGPQIDDEQFKKILRYIKSGVDSGATLXTGGDKLGDKGYYIQPTIFSDVQDGMKIAQEEIFGPVQSIFKFNDLNEVIKRANASQYGLAAGVFTNNLXTPANTLTRALRAGTVWVNCFDIFDAAIPFGGYKMSGIGREKGIDSLKNYLQVKAVVTALKNPAWL

SEQ ID NO: 4576 - protein, 122 aa, Triticum aestivum
  misc_feature (17)..(19): Xaa can be any naturally occurring amino acid
  misc_feature (22)..(22): Xaa can be any naturally occurring amino acid
  misc_feature (26)..(27): Xaa can be any naturally occurring amino acid
  misc_feature (30)..(30): Xaa can be any naturally occurring amino acid
  misc_feature (32)..(32): Xaa can be any naturally occurring amino acid
  misc_feature (34)..(34): Xaa can be any naturally occurring amino acid
  misc_feature (37)..(37): Xaa can be any naturally occurring amino acid
  misc_feature (40)..(41): Xaa can be any naturally occurring amino acid
  misc_feature (44)..(45): Xaa can be any naturally occurring amino acid
  misc_feature (47)..(49): Xaa can be any naturally occurring amino acid
  misc_feature (55)..(55): Xaa can be any naturally occurring amino acid
  misc_feature (60)..(60): Xaa can be any naturally occurring amino acid
  misc_feature (68)..(68): Xaa can be any naturally occurring amino acid
  misc_feature (70)..(70): Xaa can be any naturally occurring amino acid
  misc_feature (77)..(78): Xaa can be any naturally occurring amino acid
  misc_feature (83)..(83): Xaa can be any naturally occurring amino acid
  misc_feature (85)..(85): Xaa can be any naturally occurring amino acid
  misc_feature (88)..(89): Xaa can be any naturally occurring amino acid
  misc_feature (94)..(94): Xaa can be any naturally occurring amino acid
  misc_feature (101)..(101): Xaa can be any naturally occurring amino acid
  misc_feature (116)..(116): Xaa can be any naturally occurring amino acid
  misc_feature (119)..(119): Xaa can be any naturally occurring amino acid
LVPNSARGRGFRVSAVXXXPRXPEGXXAEXYXSXLGXMPXXSPXXIXXXYYNCMXACHPXISRGNDPXVXNFCMFIXXVYTVXTXPVXXAVYDXINGFTAXTITPFMGDAPRDHVXVDXFTS

SEQ ID NO: 4577 - protein, 147 aa, Triticum aestivum
  misc_feature (64)..(64): Xaa can be any naturally occurring amino acid
  misc_feature (82)..(83): Xaa can be any naturally occurring amino acid
  misc_feature (108)..(108): Xaa can be any naturally occurring amino acid
LILVLSAQQNLEEAESVADIALDEAEQEDQMGILRLKALIQSSRGQFKSAVESFRILLAIIQSXKKETGKFDPYDKVKPCMXXEMEAWVKFWHPIYTKLEAWNDSNIXLGQSKPMIPYSKSAGCQKAGYWSPLHQEASQDILLSNQD

SEQ ID NO: 4578 - protein, 530 aa, Triticum aestivum
  misc_feature (310)..(310): Xaa can be any naturally occurring amino acid
  misc_feature (358)..(358): Xaa can be any naturally occurring amino acid
  misc_feature (390)..(390): Xaa can be any naturally occurring amino acid
MHSTNLLLEEPIRMVSILEPSKPNFFPAMTKIVGTLGPKSRSVEAISACLKAGMSVARFDFSWGDAAYHQETLENLKLAIKATKKLCAVMLDTVGPELQVVNKSEVTISLEENESVVLTPHKGQEASSKLLPINFAGLAKAVKPGATIFVGQYLFTGSETTSVWLEVSEVQGDDVVCVIKNSATLAGSLFTLHCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPXAVVTRVVDSMTDNLRPTRAEATDVANAVLDGSDAILLGAETLRGLYPXVETISTVGRICAEAEKVFNQDLYFKRTVKYVXGEPMTHLESIASSAVRAAIKVKASVIICFTSSGRAARLIAKYRPTMPVLSVVIPRLKTNQLKWSFTGAFEARQSLIVRGLFPMLADPRHPAESTSTTNESVLKVALDHGKASGVIKSHDRVVVCQKVGDSSVVKIIELDD

SEQ ID NO: 4579 - protein, 113 aa, Triticum aestivum
  misc_feature (38)..(38): Xaa can be any naturally occurring amino acid
  misc_feature (69)..(69): Xaa can be any naturally occurring amino acid
  misc_feature (81)..(81): Xaa can be any naturally occurring amino acid
  misc_feature (101)..(101): Xaa can be any naturally occurring amino acid
  misc_feature (105)..(105): Xaa can be any naturally occurring amino acid
AVASMLHAPSLLAVQPFGGQRNAASANRSPRAAAFRVXAAKLPAGVQVPKAQPKLSEPSWGSPKTAEVXWNSQGLHDGLIXTSSLELIFNKGFFENIRFQXGKAXLCICLLLA

SEQ ID NO: 4580 - protein, 158 aa, Triticum aestivum
  misc_feature (4)..(4): Xaa can be any naturally occurring amino acid
  misc_feature (12)..(12): Xaa can be any naturally occurring amino acid
SLSXVGIPIKVXAPWFFEAQAKWVAQVLSGRRTLPPEQEMMRSVEEYYRAREIAGVPKKYIHDVCLSETMPTYMDEFGSKYCDFPRVERWHHELVVSLFANMNDNLETFRDDYHDSDSIRKGVEEWHLSAQQTQAAPAAKKMSLGLSRTSTVVCAHPS

SEQ ID NO: 4581 - protein, 170 aa, Triticum aestivum
  misc_feature (60)..(60): Xaa can be any naturally occurring amino acid
  misc_feature (62)..(62): Xaa can be any naturally occurring amino acid
  misc_feature (96)..(97): Xaa can be any naturally occurring amino acid
  misc_feature (111)..(111): Xaa can be any naturally occurring amino acid
  misc_feature (132)..(132): Xaa can be any naturally occurring amino acid
  misc_feature (136)..(136): Xaa can be any naturally occurring amino acid
  misc_feature (148)..(148): Xaa can be any naturally occurring amino acid
  misc_feature (163)..(163): Xaa can be any naturally occurring amino acid
DISVVSLPRIAPMDRTCLLGCGITTGYGAAIETAKIEQGSTVGIFGAGCVGLSVVQGAVXSXASRIIVIDINPDKKGWAEKFGATDFLNPTELKNXXIVEKLIEMTDGGCXYTFDCTGNVGVMRAALEACHXGWGXSIIIGVAAAGQXISTPPFQLVTERVWXGCAFGGN

SEQ ID NO: 4582 - protein, 235 aa, Triticum aestivum
  misc_feature (213)..(213): Xaa can be any naturally occurring amino acid
MSAAVGGAEFHGFGGAAQLPRSRMLGRPVRVAPPGATPAGGGGPSAASIRAVSTPLKKDAKEVKRSKVEIIKEKSNFLRYPLNEELVSEAPNVNETAVQLIKFHGSYQQSDREVRGQKNYSFMLRTKNPSGKVPNQTYLAMDTLADEFGIGTLRLTTRQTFQLHGVLKKNLKHVISTVIKNMGSTLGACGDLNRNVLAPAAPYARKDILFAQXTAENIAALLAPQSGAYYDLWVD

SEQ ID NO: 4583 - protein, 267 aa, Triticum aestivum
  misc_feature (148)..(148): Xaa can be any naturally occurring amino acid
MDRPTTGGRRQEARPSEREREMEASSSRSRSGSLPSKRRSGGGGGGSGYGLTGQSLNDDTLRSIFSHVDDHFDLAHCSAVCKSWHTTAHVMRDLYYKRNPQARGSSSTISVKSYFEALAMNEHASTLVLRLQLEGLLSSGLVGRARIXLARRSAHDMRATLCRMKSGSVLTGMGDKVLRLWSAESCKYMNEYNVPPKGSPVDFDFDENKIGGLTSSQVCIWKRSGSAPTVMLPRRGKWKVYGKEYGEICVMKLSKKKNFPKVVFFGT

SEQ ID NO: 4584 - protein, 61 aa, Triticum aestivum
  misc_feature (9)..(9): Xaa can be any naturally occurring amino acid
VDAFCNDGXWVGVVSKVLGEKRCMVYFRPWKEENEFEHAQLRLHSDWMGGRWMRASPALEM

SEQ ID NO: 4585 - protein, 514 aa, Triticum aestivum
MANIDMAAVLADMERDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLAVLSCDPAAGTVRCRCENTAMLGERKNCNLPGIVVDLPTLTEKDKEDILGWGVPNDIDMIALSFVRKGSDLVTVRQLLGQHAKRIKLMSKVENQEGIVNFDDILRETDVFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNDAVFKEMIKAAPLPMSPLESLASSAVRTANKARATLIVVLTRGGTTAKLVAKYRPRVPILSVVVPVLTTDSFDWTVSSEGPARHSLIYRGLIPLLAEGSAKATDSESTEEILQAALKSAVKKQLCKAGDAVVVLHRIGMASVIKICTVK

SEQ ID NO: 4586 - protein, 515 aa, Triticum aestivum
  misc_feature (114)..(114): Xaa can be any naturally occurring amino acid
  misc_feature (121)..(121): Xaa can be any naturally occurring amino acid
  misc_feature (146)..(146): Xaa can be any naturally occurring amino acid
  misc_feature (148)..(148): Xaa can be any naturally occurring amino acid
  misc_feature (152)..(152): Xaa can be any naturally occurring amino acid
  misc_feature (189)..(189): Xaa can be any naturally occurring amino acid
  misc_feature (196)..(196): Xaa can be any naturally occurring amino acid
  misc_feature (201)..(201): Xaa can be any naturally occurring amino acid
  misc_feature (204)..(204): Xaa can be any naturally occurring amino acid
  misc_feature (215)..(215): Xaa can be any naturally occurring amino acid
  misc_feature (444)..(444): Xaa can be any naturally occurring amino acid
MANIDMAAVLADLERDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEIXVSTDYDXKGDTNTISMSYKKIPQDVKPGHVIXCXDGNXSLAVLSCDPAAGTVRCRCENTAMLGERKNCNLPGIVXDLPTLTXKDKEXILXWGVPNDIDMIXLSFVRKGSDLVTVRQLLGQHAKRIKLMSKVENQEGIVNFDDILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNDAVFKEMIKAAPLPMSPLESLASSAVRTANKARATLIVVLTRGGTTAKLVAKYRPRVPILSVVVPVLTTDSFDWTVSSXEGPARHSLIYRGLIPLLAEGSAKATDSESTEEILQAALKSAVKKQLCKAGDAVVVLHRIGMASVIKICTVK

SEQ ID NO: 4587 - protein, 79 aa, Triticum aestivum
PDILENFSKEYMYLACVAYVKKVKKGPFVEHSPMLDDISGVANWKKVNSGLLKMYKAEVLEKVPIMQHFLFGSLIKWED

SEQ ID NO: 4588 - protein, 170 aa, Triticum aestivum
  misc_feature (119)..(119): Xaa can be any naturally occurring amino acid
MSAGELRLELDELRRLESLAKHPRVQILLANEIRNVEAKLAKATEPSPEPLAAASAPAPAPAARPVLSYVTLGSFSWEQDNEKIRIYVSLEGVEQEKVETTFKPTSVDIKFNDVKGKNXCAIPKLNKEMFLRMGCGETTRLLLPFQGSKTGDCTQGRQLSKHGQGKSRLI

SEQ ID NO: 4589 - protein, 187 aa, Triticum aestivum
  misc_feature (81)..(81): Xaa can be any naturally occurring amino acid
CLTLCYIFFAAAIAINLIRDLTPHKFSRFIPLPMAMAIPFYIGSYFAIDMFLGSFILFVWEKVNKAKADAFGPAVASGLIXVGNGIWTLPQSILALAKVNPPFCMKFLTRRRQWSKWTKFLGLSHGPFYGRTRGQRQATATHQHPACNYSHFPGHLFCRKARTWVHARENYPYESSFRNDCSCSFTM

SEQ ID NO: 4590 - protein, 182 aa, Triticum aestivum
  misc_feature (57)..(57): Xaa can be any naturally occurring amino acid
  misc_feature (94)..(94): Xaa can be any naturally occurring amino acid
  misc_feature (119)..(119): Xaa can be any naturally occurring amino acid
  misc_feature (129)..(129): Xaa can be any naturally occurring amino acid
  misc_feature (135)..(135): Xaa can be any naturally occurring amino acid
LSKHDQMVSGIDWSKSSNKIVTVSHDRNSYVWTQEGSDWVPTLVILKLNRAALCVQXWSPKENKFAVGKPVPKSVCIGYYETRKLTGGISKGLXRKKHDPPVTSLAWHPTIIYLAPSSXTDGKCRVFSXFIKGVXTRGNDFNRKFNPHLSTPLGIGCKWHNGKIGYQDTQIITTPVNWTLIP

SEQ ID NO: 4591 - protein, 134 aa, Triticum aestivum
  misc_feature (121)..(121): Xaa can be any naturally occurring amino acid
MSGNGAKKVVDAAVKAGRTIIDWDGMAKLLVTDEARKEFAALRRAFDDVNHQLQTKFSQEPQPIDWEYYRKGIGSKVVDMYKEAFESIEIPEVRSTQLPPQYKPKFDAVIAEFKEAEKEHXKEPERIEKEFSEI

SEQ ID NO: 4592 - protein, 96 aa, Triticum aestivum
  misc_feature (87)..(87): Xaa can be any naturally occurring amino acid
MVCTKCENKLGKVIVPDKWKEGASNTYEGGGRKINENKLLSKKSRWTPYGNTKCIICKQQVHQDGKYCHTCAYSKGVCAMFGKQVHXTKLYKQSNV

SEQ ID NO: 4593 - protein, 103 aa, Triticum aestivum
  misc_feature (73)..(73): Xaa can be any naturally occurring amino acid
  misc_feature (82)..(82): Xaa can be any naturally occurring amino acid
  misc_feature (96)..(96): Xaa can be any naturally occurring amino acid
VGGLLLPILGALPDALLVLVSGLSGSKEEAQSQVLIGMGLLAGSTVFLLTLLWGTCVVVGKCDLGPNREAVDXQDTKGFSLXGTGITTDVQTSYAXRFMGLSV

SEQ ID NO: 4594 - protein, 232 aa, Triticum aestivum
  misc_feature (182)..(182): Xaa can be any naturally occurring amino acid
MAAAAAAAAGARRLLARRASSSPVSISALLRRGGAAAAAPHEPLLRPAALAGVASRLGFLRGMARRPGGDGYSPARSGGGDRAPTEMAPLFPGCDYEHWLIVMDKPGGEGATKHQMIDCYIQTLAKVLGSEEEAKKKIYNVSCERYFGFGCEIDEETSNKLEGIPGVLFVLPDSYVDPEHIXFAAELFVNGEIVQRSPERQRRVEPVPQRASDRPRYNDRTRYQRRRENQQR

SEQ ID NO: 4595 - protein, 353 aa, Triticum aestivum
EQGIQVIAPCATKVMPGELGFVAQLNEGRLLKKRPTEFRVDRALQPFDSAKFNFTKVGQEAVLFRFEKGGGDSSYFLENAPSTEGDHAPSVVAINVSPIEYGHVLLIPRVLDRLPQQIDPESFLLALHMAAEAASPYFRLGYNSLGAFATINHLHFQAYYLSVPFPVEKAPTKKIPLAKCALNSGVKVSKLTNFPVRGLVFERGNTLKDLADVVTNACIWLQENNVPFNVLISDSGRRIFVFPQCYAEKQALGEVSQDLLDTQVNPAVWEISGHIVLKRRTDFEEASEASAWRLLAEVSLSEERFEEVKACIFEATGLTESDEEEESSESPYASSSSVPQASSHMSEGCLVLQ

SEQ ID NO: 4596 - protein, 587 aa, Triticum aestivum
  misc_feature (538)..(538): Xaa can be any naturally occurring amino acid
  misc_feature (549)..(549): Xaa can be any naturally occurring amino acid
  misc_feature (563)..(563): Xaa can be any naturally occurring amino acid
  misc_feature (572)..(572): Xaa can be any naturally occurring amino acid
MQSLANTFRTRSFPFHSPQSIRRLLRLFNRAVPFLESKKHATTSRPQRIPIPSPPLPSPAAHRSGDRQQAMVSNGELSQPQAGEYGLAVMRRRPKTKIVCTLGPASRSVDMIEKLLRAGMCVARFNFSHGSHDYHQETLDNLHAAMDRTGILCAVMLDTKGPEIRTGFLKDGKPIQLRKGQEIVISTDYSIKGDDKMISMSYKKLAVDLKPGSVILCADGTITLTVLHCDKEQGLVRCCCENTAMLGERKNVNLPGVVVDLPTLTEKDREDILQWGVPNKIDMIALSFVRKGSDLVEVRKVLGEHAKSIMLMSKVENQEGVANFDDILAQSDAFMVARGDLGMEIPVEKIFYAQKVMIFKCNIQGKPVVTATQMLESMIKSPRPTRAEATDVANAVLDGTDCVMLSGETAAGAYPELAVQTMAKICLQAESCVDYSAVFKSIMSSAPIPMSPLESLASSAVRTANSAKATLILVLTRGGTTARLVAKYRPSMPILSVVVPELKTVEFDWICSDEGPARQSLIVRGVIPMLSAGTAKAXFDSQATEAALXLALEDAKEMGLCNXGDDSVAVHXRIGIAPVMKLLPTVS

SEQ ID NO: 4597 - protein, 366 aa, Triticum aestivum
  misc_feature (57)..(57): Xaa can be any naturally occurring amino acid
QLSAMEPIPLLTPYKMGQFDLAHRVVLAPLTRQRSYGNVPQPHAAVYYSQRATAGGXVIAEATGVSDTAQGYNDTPGIWTAEHVEAWKPIVAAVHQKGALFFCQIWHCGRVSTFELQPGGTAPLSSTEKGVGPQMSFDGRLEEFAPPRRLTVEEIPAIVDDFRKAARNAIDAGFDGVEIHGANGYIIEQFLKDSANDRIDEYGGSLENRCRFALEVVDAVVKEVGGHRVGIRLSPFTDYMDCHDSDPHSLALYLSTKLNDHGILYIHMIEPRMAIVDGRRVVPKRLLPYREVFKGTFIANGGYDHEEGGKVVTEGYTDLVAFGRLFLANPDLPKRFEVGAELNKYDRMTFYTSDPVVGYTDYPFLE

SEQ ID NO: 4598 - protein, 71 aa, Triticum aestivum
MASISRASSLVAMAIVVVLASVASAQGPAPAPTASDGTSVDQGIAYVLMFVALALTYLIHPLDAASAYRLL

SEQ ID NO: 4599 - protein, 122 aa, Triticum aestivum
  misc_feature (59)..(59): Xaa can be any naturally occurring amino acid
  misc_feature (67)..(67): Xaa can be any naturally occurring amino acid
  misc_feature (81)..(81): Xaa can be any naturally occurring amino acid
  misc_feature (90)..(90): Xaa can be any naturally occurring amino acid
LILFPVFRLQSNWVAGALSGRIELPSPEEMMLDVMAFYSDMEARGWPKRFTHNLGVGSXTFEYQDWXLAEQCGLEKMETSXRRVIYVAAXSEGVGSGRESYRDEWDDDQLVGQAHITSSTAT

SEQ ID NO: 4600 - protein, 215 aa, Triticum aestivum
  misc_feature (60)..(60): Xaa can be any naturally occurring amino acid
  misc_feature (156)..(156): Xaa can be any naturally occurring amino acid
MATAARAVAAAARPARPVLQPRRLPCPSARPARPRVGRAVRCMARRPDASYSPLRPGQGXTRAPTEMAPLFPGCDYEHWLIVMDKPGGEGATKHQMIDCYIQTLAKVVGSEEESKKRIYNVSCERYFGFGCEIDEETSNKLEGLPGVLFVLPDSYXVDAENKDYGAELFVNGEIVQRSPERQRRVEPVPQRAQDRPRYSDRTRYVKRRENQAYQR

SEQ ID NO: 4601 - protein, 246 aa, Triticum aestivum
  misc_feature (137)..(137): Xaa can be any naturally occurring amino acid
MAPLLSPPLLADLVAKAHSSSTAVRCSGSVRRWEVAGLAGAGRRDRHRRRRTWGRRGFRVSAEATDPRSPEGSAVEDYYAALGVMPDATPHQIKKAYYNCMKACHPDLSGNDPDVTNFCMFINEVYTVLTDPIQRAXYDEINGFTATATNPFLDDAPRDHVFVDEFSCIRCKNCANVCSKVFEIEEDYGRVLADVMLHRRIIVRDDNNDPTRTPLVSLFCCHCVVYSVSELCFTQRNRTAMMNVSM

SEQ ID NO: 4602 - protein, 245 aa, Triticum aestivum
MDSTLFIIGVIGNIISVLVFISPIPTFWRIVRSGSTEDFEAAPYVLTLLNTLLWLYYGLTKPDGLLVATVNGFGAVMETIYLVLFLVYAADKGKRVKTAKLVAALDIGFFGVVFAATTFAIGGLDMKIMVIGLICACLSVFMYGSPLAAVRRVIASRSVEYMPFFLSFFLFLNGGVWATYAILDKDVFLGVPNGTGCFLGGIQLVIYAVYMNSKVASHSYGSDEAASLLSSEASKHGQHDASTRV

SEQ ID NO: 4603 - protein, 115 aa, Triticum aestivum
MPCLNVSTNVNLEGVDTSAVLADASSTVATIIGKPENYVMVVLKGSVPMAFGGTQEPAAYGELVSIGGLNPDVNKKLSAGIASILESKLSIPKSRFYLKFHDSKRSDFGWNGSTF

SEQ ID NO: 4604 - protein, 98 aa, Triticum aestivum
FASRKKQRTLSLTFSEVYGGVTMNNTLCLAVFLALVYIRGLTWDFSSEVLVIFLVCIIMGLFTSFGTKFPLWTCFVAFLLYPLSLILVYILDYKFGWT

SEQ ID NO: 4605 - protein, 163 aa, Triticum aestivum
  misc_feature (53)..(53): Xaa can be any naturally occurring amino acid
  misc_feature (72)..(73): Xaa can be any naturally occurring amino acid
  misc_feature (82)..(82): Xaa can be any naturally occurring amino acid
  misc_feature (86)..(87): Xaa can be any naturally occurring amino acid
  misc_feature (90)..(90): Xaa can be any naturally occurring amino acid
  misc_feature (99)..(100): Xaa can be any naturally occurring amino acid
  misc_feature (102)..(102): Xaa can be any naturally occurring amino acid
  misc_feature (105)..(105): Xaa can be any naturally occurring amino acid
  misc_feature (115)..(115): Xaa can be any naturally occurring amino acid
  misc_feature (119)..(119): Xaa can be any naturally occurring amino acid
  misc_feature (122)..(122): Xaa can be any naturally occurring amino acid
  misc_feature (125)..(125): Xaa can be any naturally occurring amino acid
  misc_feature (127)..(127): Xaa can be any naturally occurring amino acid
MAPAVMASSATTVAPFQGLKSTAGLPVSRRSSASLGSVSNGGRIRCMQVWPIXEGIKNSETLSYLPPLSTEXXWKQVDYLDXSKWXXCSXSSKLVPLPXXQXSPXYYDGPYWDKXNLPXFGXTDXQXAQRVEESRRPDPIRTVQLRQMDASRLKQRGARIREG

SEQ ID NO: 4606 - protein, 218 aa, Triticum aestivum
  misc_feature (78)..(78): Xaa can be any naturally occurring amino acid
  misc_feature (121)..(121): Xaa can be any naturally occurring amino acid
  misc_feature (133)..(133): Xaa can be any naturally occurring amino acid
  misc_feature (162)..(162): Xaa can be any naturally occurring amino acid
  misc_feature (191)..(191): Xaa can be any naturally occurring amino acid
MAAAAGDELETVEVKLRAVGPSRPTTIRLPPLISVADLRRTVALDRRLPQDRLRLVLRGTTLPWGDDTHVNLRPGHAXDGPWLLVAVAPKPPAKHLRGDDDDDDDDDEEELKFKIPQTTTXWKKRIYIFLQSXCWRLPDILLMALFSVTMKAWIIITLWCLXGPFAHTCDGVPVHTPAPGFLIILRYLGKXQQGDVSGDSIFNEDAERIDRDLRAGQL

SEQ ID NO: 4607 - protein, 129 aa, Triticum aestivum
  misc_feature (88)..(88): Xaa can be any naturally occurring amino acid
  misc_feature (99)..(99): Xaa can be any naturally occurring amino acid
  misc_feature (104)..(104): Xaa can be any naturally occurring amino acid
  misc_feature (116)..(116): Xaa can be any naturally occurring amino acid
  misc_feature (122)..(122): Xaa can be any naturally occurring amino acid
PTVMASSATSVAPFQGLKSTAGLPVSRRSNGASLGSVSNGGRIRCMQVWPIEGIKKFETLSYLPPLSTEALLKQVDYLIRSKWVPCLXEFKQVGFIFRXEHNAXPGYYDGRYLDMXELPMFXGCTDPTQ

SEQ ID NO: 4608 - protein, 178 aa, Triticum aestivum
  misc_feature (66)..(66): Xaa can be any naturally occurring amino acid
  misc_feature (74)..(74): Xaa can be any naturally occurring amino acid
  misc_feature (150)..(150): Xaa can be any naturally occurring amino acid
MAPTVMASSATSVAPFQGLKSTAGLPVSRRSNGASLGSVSNGGRIRCMQVWPIEGIKKFETLSYLXPPLSTEAXLLKQVDYLIRSKWVPCLEFSKVGFIFREHNASPGYYDGRYWTMWKLPMFGCTDATQVINEVEEVKKEYPDAYVPHXSGFDNMRQVQCVSFIAFKPPGCEESGKA

SEQ ID NO: 4609 - protein, 152 aa, Triticum aestivum
  misc_feature (102)..(102): Xaa can be any naturally occurring amino acid
MRRRLSHPAPEETPRKDDHFGSARLYVGRLFTRTLSRDLPISFPANMGRIRELEWKRDYAFIEYSDPRDADDARYNLDGRDVDGCRIIVEFAKGVATWFWWXREREYVGRGPPPGTRPWFRTGVFRGTGRAGCTACGSCTQCCRRGRSGSIS

SEQ ID NO: 4610 - protein, 372 aa, Triticum aestivum
  misc_feature (55)..(55): Xaa can be any naturally occurring amino acid
  misc_feature (78)..(78): Xaa can be any naturally occurring amino acid
  misc_feature (85)..(85): Xaa can be any naturally occurring amino acid
  misc_feature (332)..(332): Xaa can be any naturally occurring amino acid
MAGGKEAHGWAARDVSGHLSPYHFSRRVQRDDDVTIKVLFCGLCHTDLHVIKNEXGNAKYPVVPGHEIVGVVTDVGSXGVTSFKXGDTVGVGYFVDSCRSCDSCSKGYESYCPQLVETSNGVSLDDDDGGATTKGGFSDALVVHQRYVVRVPASLPPAGAAPLLCAGVTVFSPMVQYGLNAPGKHLGVVGLGGLGHLAVRFGKAFGMKVTVISTSLGKRDEALGRLGADAFLVSRDPEQMRAAAGTLDGVIDTVSADHPVVPLLDLLKPMGQMVVVGLPTKPLQVPAFSLVAGGKRVAGSAGGGVGECQAMLDFAGEHGITADVEVVGMDYXQYRHPAPREERCQVPLRCRRREQQDWRLGITIPSVLSIDV

SEQ ID NO: 4611 - protein, 244 aa, Triticum aestivum
MGNGLSPCVNMPAAAEVPAAARLVYWGGRTRALPVYEDEEGDGEGNGGVSCTAADVTAELLPADHVVCPADSFFVGLPVPVASPGERLLPGRTYFVLPRRLLSSPSPGGNGKAAVLTAATLASLSAAPGGRKTVQLAGPGQCPFEYVKGGEDGAAALIRVLPQFIEKVITCDGGNGNGDAAGRRGSGKVAASATELCSTPELKRHYAQLVGAKGRPWSPGLETISERSKRRIFPSPARLLLSSQ

SEQ ID NO: 4612 - protein, 261 aa, Triticum aestivum
GRVGGRVGGADGRVRVSGTLSVGQGASVLNQVWQVGSTVSGDGIPAPHAMGGDNLAAKAKLDLVRQTSTSSDSGGSDLARERNIHGILNAVSWGLLLPMGAIFARYLKTFRSADPAWFYLHVTCQIIGYAVGVAGWAPGINLGNASNGVTYGLHRSIGIAVFALATLQVFALFLRPRKDHKCRVYWNAYHHAVGYAVIILGIMNIFKGMAILGVEQRWRTAYVAAVWVLGAVAVTLEAVTWSVVIRRREAEQHGKTFHGAA

SEQ ID NO: 4613 - protein, 93 aa, Triticum aestivum
CMITTGKVVQDCNVRVLRKGKEVYVGSLDSLRRVKEAVKEVGAGLECGIGVDDFDEWQEGDIVEAFNTVKKARTLEEASATVTAALKDAGVQL

SEQ ID NO: 4614 - protein, 212 aa, Triticum aestivum
  misc_feature (40)..(40): Xaa can be any naturally occurring amino acid
  misc_feature (138)..(138): Xaa can be any naturally occurring amino acid
  misc_feature (160)..(160): Xaa can be any naturally occurring amino acid
  misc_feature (184)..(184): Xaa can be any naturally occurring amino acid
MSKMADEKVISAPATGGGEDGLIAGDLSATEAACPSVGDXLLRAAPLGLCVAAMAVMLRDTQTNEYGHRLLLRRFGGFKYLVYANGLCAAYSLVSAFYTAVPRPATLSRSWIVFLLDQVFTYLILAAGRGRRQSYSYXLAYNGDKEVTWSEACGVFGGFXRQARTSVAITFGSVVCYILLSLIXSSYRLFSAYDAPMPSLGNKGVEIAAFPR

SEQ ID NO: 4615 - protein, 122 aa, Triticum aestivum
  misc_feature (3)..(3): Xaa can be any naturally occurring amino acid
  misc_feature (10)..(10): Xaa can be any naturally occurring amino acid
  misc_feature (12)..(12): Xaa can be any naturally occurring amino acid
  misc_feature (25)..(25): Xaa can be any naturally occurring amino acid
  misc_feature (29)..(29): Xaa can be any naturally occurring amino acid
  misc_feature (33)..(33): Xaa can be any naturally occurring amino acid
  misc_feature (55)..(55): Xaa can be any naturally occurring amino acid
  misc_feature (58)..(58): Xaa can be any naturally occurring amino acid
  misc_feature (63)..(63): Xaa can be any naturally occurring amino acid
  misc_feature (69)..(71): Xaa can be any naturally occurring amino acid
  misc_feature (73)..(73): Xaa can be any naturally occurring amino acid
  misc_feature (84)..(86): Xaa can be any naturally occurring amino acid
  misc_feature (91)..(91): Xaa can be any naturally occurring amino acid
  misc_feature (104)..(104): Xaa can be any naturally occurring amino acid
  misc_feature (109)..(110): Xaa can be any naturally occurring amino acid
  misc_feature (116)..(116): Xaa can be any naturally occurring amino acid
  misc_feature (118)..(118): Xaa can be any naturally occurring amino acid
MPXAGLSAGXNXVDVAIDLGNPLLXRTVXGFLXIGAVGAFRVAAEDPFDCLQSGXVSXRKLEXTLEKMXXXGXYWGAVAGMFVXXXYGLEXVRGKYDWKNALIXSIASXXLISAAXNXQGTN

SEQ ID NO: 4616 - protein, 125 aa, Triticum aestivum
  misc_feature (27)..(27): Xaa can be any naturally occurring amino acid
  misc_feature (53)..(53): Xaa can be any naturally occurring amino acid
  misc_feature (57)..(57): Xaa can be any naturally occurring amino acid
  misc_feature (60)..(60): Xaa can be any naturally occurring amino acid
  misc_feature (91)..(91): Xaa can be any naturally occurring amino acid
  misc_feature (108)..(108): Xaa can be any naturally occurring amino acid
GDMILLPNGAEVVIINGAMDGTAGWEXANTPAYAPVVYRPDHAPGDRFEEQKXTDIXRLXHSSAILLRDGRVLVGGSNPHIYYNFKQRAVXPTELSLEAFSPEYLDKXNDALRPKITNPRRPNRG

SEQ ID NO: 4617 - protein, 162 aa, Triticum aestivum
  misc_feature (86)..(86): Xaa can be any naturally occurring amino acid
  misc_feature (107)..(107): Xaa can be any naturally occurring amino acid
  misc_feature (128)..(128): Xaa can be any naturally occurring amino acid
  misc_feature (137)..(137): Xaa can be any naturally occurring amino acid
  misc_feature (157)..(157): Xaa can be any naturally occurring amino acid
DALSALRRSLRDPGGVLQSWDPTLVNPCTWFHVTCDRDNRVTRLDLGNLNLSGHLVPELGKLEHLQYLELYKNNIQGTIPSELGNXLKNLISFDLYKNNISGTIPPXLGKLKSLVFLRLNGNHLTGPXPRELAGISXLKVVDVQSNDLCGTIPTSGXFEHIL

SEQ ID NO: 4618 - protein, 446 aa, Triticum aestivum
MAATIQSVKARQIFDSRGNPTVEVDVCCSDGTFARAAVPSGASTGVYEALELRDGGSDYLGKGVSKAVDNVNLIIAPALIGKDPTAQTELDNFMVQQLDGTKNEWGWCKQKLGANAILAVSLAICKAGASIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGEQVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 4619 - protein, 101 aa, Triticum aestivum
  misc_feature (58)..(58): Xaa can be any naturally occurring amino acid
  misc_feature (75)..(75): Xaa can be any naturally occurring amino acid
  misc_feature (84)..(84): Xaa can be any naturally occurring amino acid
  misc_feature (90)..(90): Xaa can be any naturally occurring amino acid
AKSSTYKADGETCKITYGSGSIAGFFSDDDVLVGDLTVKNQKFIETTRESSITFIIGXFDGILGLRIPRDSVGKXPPIWQSMQXKELLAXDSLLLANRTRR

SEQ ID NO: 4620 - protein, 175 aa, Triticum aestivum
  misc_feature (170)..(170): Xaa can be any naturally occurring amino acid
LVPNSARAGTEMNFTTDEKYASICDDKNMYVDYKNITKVIEPGRIIYVDDGVLAFDVLKIVDEQTIHVRCRNNGKISSKKGVNLPNTDVDLPALSEKDQADLRFGVKNNVDMIFASFIRRGEDIKHIREILGEEGKHIQIIAKIENRQGLNNFAEILKETDRVMGAKGDXGIEIT

SEQ ID NO: 4621 - protein, 421 aa, Triticum aestivum
  misc_feature (115)..(115): Xaa can be any naturally occurring amino acid
MSAAVGGAEFHGFGGAAQLPRSRMLGRPVRVVPPGATPAGSGPSAASIRAVSTPLKKDGKEGNFFKVEIIKEKSNWVRYPLNEELVSEAPNVNETAVQLIKFHGSTRRPASTSRXREVRGQKNYSFMLRTKNPSGKVPNQTYLAMDTLADEFGIGTLRLTTRQTFQLHGVLKKNLKHVISTVIKNMGSTLGACGDLNRNVLAPAAPYVRKDILFAQETAENIAALLAPQSGAYYDLWVDGEKIMSAEEPPEVTKARNDNSHGTNFPDSPEPIYGTQYLPRKFKIAVTVAGDNSVDILTNDIGVVVVSDSAGEPVGFNLYVGGGMGRTHRIETTFPRLADPLGYVPKEDILYAIKAIVVTQRENGRRDDRRYSRMKYLIDSWGIDKFRAEVEKYYGKKFEDFHPLPEWQFNSYLGWQEQGGW

SEQ ID NO: 4622 - protein, 133 aa, Triticum aestivum
RPRHARRPRRGRDAGPGPAHPGGPVLPGLPPPGPPHGGLLGVQRALPRRLRQGPRHRLAAGGRRLLGLVILAALCSVVMVALVVHTVVYLVCKSYLHESIDKSNISDHLEVYLGDYVPLKASDVQMQHFGDEV

SEQ ID NO: 4623 - protein, 151 aa, Triticum aestivum
  misc_feature (86)..(86): Xaa can be any naturally occurring amino acid
MQPQPPPRAPTRAPLPRRTSPTLACPTRQALSFSPAKHRYSSTRGSTVPSGGNGFDFSGGVEEKGTAALPRFFISLSNKEKEEDFXAMKGCKLPQRPKKRPKLMQKCLLTVCPGAWLSDLSHERYEVREKKSSKKQRARGLKALCMESDSE

SEQ ID NO: 4624 - protein, 300 aa, Triticum aestivum
  misc_feature (110)..(110): Xaa can be any naturally occurring amino acid
  misc_feature (177)..(177): Xaa can be any naturally occurring amino acid
  misc_feature (188)..(188): Xaa can be any naturally occurring amino acid
  misc_feature (255)..(255): Xaa can be any naturally occurring amino acid
  misc_feature (293)..(293): Xaa can be any naturally occurring amino acid
MIIAGSVAGAAVFIALAAVAVLFIRKRRQRKVVNSSSKLLKYRYSGSGGTPTRSRGGDMESGSSQDMGNRFSYEELEEATDSFNENRELGDGGFGTVYKGYLGDGRVVAXVKRLYNNSYRRVEQFVNDAAILARLRHPNLVMFYGCTSKESRELLLVYEFVQNGTVADHLHGPRVGXERALPWPLRLXFAVESAAALTYLHAIEPPIVHRDVKTNNILLDTDFHVKVADFGLSRLFPLDATHVSTAPHGTPWYRXDPEYHQCYQLTDKIDVYSFGVVLVELISSKPAVDITRXRNDINLA

SEQ ID NO: 4625 - protein, 567 aa, Triticum aestivum
  misc_feature (219)..(219): Xaa can be any naturally occurring amino acid
  misc_feature (225)..(225): Xaa can be any naturally occurring amino acid
MLSRLAARRPRPGSARAAAYRSSAAASSSVLPDALDRSSDAYARNAAAVGGLLSDLRSRVSQVLGGGGAGAVKRNEGRGKLLPRDRIDRLLDPGASFLELSQLAGSDVYEEALPSGGIITGIGPVHGRLCMFVANDPTTKGGTYYPITVKKHLRAQEIASECKLPCIYLVDSGGANLPKQAEVFPDRDNFGRIFYNQAKMSADGIPQIAVVLGSCTAGXGAYIPXAMADESIIVKGNGTIFLAGPPLVKAATGEEISAEDLGGASVHCKVSGVSDHFAQDERHGLALGRNIVKNLHLAAKETSIHNSACDYQEPLYDVQELRSIAPADTKQSFDIRSIIARIVDGSEFDEFKKLYGTTLVTGFARICGQPVGIIGNNGILFTESALKGTHFIELCAQRNIPLIFLQNISGFMVGSKSEASGIAKAGAKMVMAVSCSKVPKITIIVGGSFGAGNYGMCGRAYSPNFLFMWPTARISVMGGIQAAGVLAQIEKNNRKRQGVEWTKDDEEAFKAKVVEAYDKEGSPYYSTARLWDDGIIDPADTRRVLSLCLSASAKPVPEDTKYGVFRM

SEQ ID NO: 4626 - protein, 158 aa, Triticum aestivum
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKEPKSPKKATKSPKKTTKA

SEQ ID NO: 4627 - protein, 187 aa, Triticum aestivum
  misc_feature (65)..(65): Xaa can be any naturally occurring amino acid
MPSAGLEAGWNKVEAAGALATSQSASGERATWRDIGREGSGRMPRAGLSAGSSKVDVAIDLGNPXLLNRTVDGFLKIGAVGACRVAAEDAFDCLQSGSVSKRKLEKTLEKMCKEGAYWGAVAGVYVGMEYGVERVRGEYDWKNALIGGIASGALISAASNNKGNKIAKDAITGGAIATAIEFINYLT

SEQ ID NO: 4628 - protein, 119 aa, Triticum aestivum
MHDFCFTIPYGFAVLAGGLLGYLRRGSTASLAGGAGVGGLLLLAGFVSLKAFEKRRNSYLALALETLCALALTFVMGQRYLETSKIMPAGVVAGLSALMSAFYLFKIATGGNHFSPKKE

SEQ ID NO: 4629 - protein, 206 aa, Triticum aestivum
  misc_feature (58)..(58): Xaa can be any naturally occurring amino acid
  misc_feature (90)..(90): Xaa can be any naturally occurring amino acid
  misc_feature (132)..(132): Xaa can be any naturally occurring amino acid
  misc_feature (145)..(145): Xaa can be any naturally occurring amino acid
  misc_feature (148)..(148): Xaa can be any naturally occurring amino acid
  misc_feature (152)..(154): Xaa can be any naturally occurring amino acid
MGPATQQRHRTRAGRPAARRPRAAADDDGGVRCEACGSGRHADELLLCDGCDRGLHIXCLRPILPRVPAGDWFCPSCAAATTTTAHSAKXAAVVQTKMPKQFPLIQTKIVDFFKIQRRPAFAAPEPPEGRKXKRKAASALVGVQXRRXGKLXXXTPNEDPRPGDSPQMGSRGLTYRPFSNEPLLPMGAPGFPNQIPPREGRGEDCI

SEQ ID NO: 4630 - protein, 153 aa, Triticum aestivum
MDASATGAVSKVKKYVVGRKLGGGPRKKAVARSVKAGLQFPVGRIVRFLKKGRYAQRVGMGAPVYLASVLEYLAAELLELAGNAAKDNKKSRIIPRHLLLAIRNDQELGKLLAGVTIAHGGVLPNINPVLLPKKTAEKEPKSPNKAAKSPKKA

SEQ ID NO: 4631 - protein, 341 aa, Triticum aestivum
MEQSQMARVKLGTQGLEVSKIGFGCMGLTGVYNDPVPEDAGVAVIRRAFDAGVTFFDTADAYGPHTNEVLLGKALRQVPRERVQVATKCGIAGFDAGGMLVKGTPEYVRTCCEASLERLAMDYVDLYFQHRIDQSVPIEETMGELKKLVEEGKVKYVGLSEASADTIRRAHAVHPITAVQMEWSLWTRDIEEDIIPLCRELGIGVVPYSPLGRGFFAGRAAVESLPSGSLLSKHPRYTGENLEKNKVLYTRLEILSTKYGCTPAQLALAWVLHQGDDVVPIPGTTKLKNLDDNIEAVKVKLSKEDLKEISAAVPAGEVAGSRIIGILEPYSWRVANTPPQK

SEQ ID NO: 4632 - protein, 236 aa, Triticum aestivum
  misc_feature (99)..(99): Xaa can be any naturally occurring amino acid
  misc_feature (113)..(113): Xaa can be any naturally occurring amino acid
  misc_feature (128)..(128): Xaa can be any naturally occurring amino acid
  misc_feature (143)..(143): Xaa can be any naturally occurring amino acid
  misc_feature (175)..(175): Xaa can be any naturally occurring amino acid
  misc_feature (182)..(182): Xaa can be any naturally occurring amino acid
  misc_feature (184)..(184): Xaa can be any naturally occurring amino acid
  misc_feature (188)..(188): Xaa can be any naturally occurring amino acid
  misc_feature (193)..(194): Xaa can be any naturally occurring amino acid
  misc_feature (196)..(196): Xaa can be any naturally occurring amino acid
MDGGGGMGPVGGGVGGMVGPVGVGGGGGGSDVELVSKTLQFEHKLFYFDLKENPRGRYLKISEKTSTTRSTIIVPIAGVAWVLDLFDYYIRTDERDVFXSKELRLDTKVFYFXDIGENKRGRYLKVSXEASVNRNRCTIIVPXAGSSGEEGWEAFRNVLLEINDEASRLYVLPKXGGKQHLXPXERLXGLGCXXGXGWVGGGGGGGGGGGGGGGGGGGGGGGGGGGGGGGGGGGGG

SEQ ID NO: 4633 - protein, 98 aa, Triticum aestivum
MASADEEIAVKEPLDLIRLSLDERIYVKLRSDRELRGKLHAYDQHLNMILGDVEEIVTTVEIDDETYEEIVRTTRRTIPFLFVRGDGVILVSPPLRTA

SEQ ID NO: 4634 - protein, 174 aa, Triticum aestivum
PLRSFNDPEHAAFLESIMKSECPTELAPADGMSKVNVNLIRKEEKCPEPVKRPAPFQGGGRILAAPSENSAPSGISLAAAASSTATTTAPKTITVDDSLPSTSLQIRFADGSRVVGRFNTSHTISDVRAFIYTTRPGETSDYTLQVGFPPKPLDDATKTIEEAGVANSVIIQRV

SEQ ID NO: 4635 - protein, 389 aa, Triticum aestivum
MGCLGEQRTCDRGSEYECHHSDGSRVNRTDGRYWFKGTAAETNCAVRHPPRGDLLDPPATLRCQHKPFPPMAQPSQVSRVTVTAKAVAPWDSCQKGMCAKGNLCTFSHGPQFAGNPALQPHLQLKNSNSWTKPSNSPQQSTTPAVHGELKVGAQNGRPAQKQNPTSRAYHSPGIYQNQNNNPYVLSGAAKSYQPQRSVQAESAENVMETGEFVREPSAGSSVVAGSAEDDAERSFKEGHASSYRRASGEQNSGIRRQAHGGYELERSSHRSSSDRLVSERRLMQRESMPVTAESSDLRHRLLKQRRLNDSRSTQVPDRRDRRYPEDERGSHHHRRGEERAAHDGLSRSRLQGRIKLPGEASLDRLGPHTHTPHTLSSDQPQSHTSTSFS

SEQ ID NO: 4636 - protein, 432 aa, Triticum aestivum
  misc_feature (403)..(403): Xaa can be any naturally occurring amino acid
  misc_feature (421)..(421): Xaa can be any naturally occurring amino acid
MTHGPTSLLPGRARTTARSPSSRRQSLHPTTAEAMDGEDAHHRPSSSSSSGGPFLSGLCAAALRRKPISARASAAASGEGLVRQLGVLELVLLGIGASIGAGIFVITGTGARDAGPGVTISFALAGAACVLNALCYAELASRFPAVVGGAYLYTYAAFNELTAFLVFTQLMLDYHIGAASIARSLASYFIQFLELIPSVKGNVPSWIGHGEEFFGGVVSVNILAPILLVILTVILCRGVKESSAVNTFMTTLKIIIVIVVVFAGVFEVDVSNWSPFMPNGFKAVVTGSTVVFFAYVGFDAVANSAEEAKNPQRDLPIGILGSLLACVILYVAVCLVITGMLPYTLLGEDAPLAEAFSAKGLKFVTVLISIGAVAGLTTTLLVGLYVQSRLYLGLGRDGLLPSXFTKVNSRFHAQLSFLIWXGCVAAFLAGPL

SEQ ID NO: 4637 - protein, 454 aa, Triticum aestivum
MNSLQSFLAVAPVKPAAAAARLPSSRRARVSPTPAPAPTASASNSREPSLASPPVMADEAKYIVGTYKRAQVVFVAGRGCKLYDIDGREYLDMAAGIAVNALGHGDPDVDAAAADQRGRLVHASNVGYTVPQVELAKRLVEASFADRAFFANSGTEANEAAIKFARKYQRVAHPNGDAPTEFMSFTNCFHGRTIGSLALTSKVQYREPFEPVMPGSTFVEYGNLEEAKKVIQSGKIAAVFVEPVQGEGGIHSATKEFLQGLRDACDEAGALLVFDEVQCGLGRTGYLWAHEVYGVVPDIMTLAKPLANGLPIGVALVTEKVAAAINYGDHGTTFGGGPFVCHAALATLDKIQKPGFLAEVTRKGEYFKQLLKAKLSGNPHVKEIRGAGLIVGIELDVPAGPLVDACLNAGVFLLTAGKGNVVRLVPALIVSEKELEQAAEAIRECLPALDASTS

SEQ ID NO: 4638 - protein, 396 aa, Triticum aestivum
  misc_feature (223)..(223): Xaa can be any naturally occurring amino acid
  misc_feature (234)..(234): Xaa can be any naturally occurring amino acid
  misc_feature (240)..(240): Xaa can be any naturally occurring amino acid
  misc_feature (344)..(344): Xaa can be any naturally occurring amino acid
  misc_feature (356)..(356): Xaa can be any naturally occurring amino acid
  misc_feature (362)..(362): Xaa can be any naturally occurring amino acid
SPSSKLTLTKGNKSWSSTAVAAALELVDPPGCRNSAPGNPFSVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVXGKLTNGELATXFSPEWXNKGELLSFLVEITADIFSIKDDQGEGYLVDKVLDKTGMKGTGKWTVQQAAELSVAAPTIEASLDSRFLSGLKDERVAASKIFQGDYSSGETVDKAQLIEDVRKXLYASKICSYAQXGMNIIXGKSTEKGWGSTPRTGKIWKVGDHPRQLLDPSRRL

SEQ ID NO: 4639 - protein, 327 aa, Triticum aestivum
RSGIFGSTHASGKTIVLKTAEQTPLSALYVSKLLHEAGLPEGVLNIVSGFGPTAGAALASHMDVDKIAFTGSTDTGKVILELSARSNLKPVTLELGGKSPFIVMDDADIDQAVELAHFALFFNQGQCCCAGSRTFVHERVYDEFVEKSKARALKRVVGDPFRKGVEQGPQIDDEQFKKILRYIKSGVDSGATLVTGGDKLGDKGYYIQPTIFSDVQDGMKIAQEEIFGPVQSIFKFNDLNEVIKRANASQYGLAAGVFTNNLDTANTLTRALRAGTVWVNCFDIFDAAIPFGGYKMSGIGREKGIDSLKNYLQVKAVVTALKNPAWL

SEQ ID NO: 4640 - protein, 506 aa, Triticum aestivum
  misc_feature (374)..(374): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFAEWNKGELLSFLVEITADIFSIKDDQGEGYLVDKVLDKTGMKGTGKWTVQQAAELSVAAPTIEASLDSRFLSGLKDERVAASKIFQGDYSSGETVDKAQLIEDVRKALYASKICSYAQGMNIIKAKSTEKGWGLNLGELARIWKGGCIIRRXFLDRIKKAYDRNGELANLLIDPEFAQEIMDRQAAWRRVVCLAINNGVSTPGMSASLAYFDSYRRDRLPANLVQAQRDYFGAHTYERVDMPGSFHTEWVQDCQLKDLRCCCCSVMSHESIRFRLFGILCCCQS

SEQ ID NO: 4641 - protein, 54 aa, Triticum aestivum
GTFAEHSPMLDDISAVPNWKKVNSGLLNSCRAEVLEKVPIMQHFLFGSLIKWED

SEQ ID NO: 4642 - protein, 356 aa, Triticum aestivum
  misc_feature (241)..(241): Xaa can be any naturally occurring amino acid
  misc_feature (269)..(269): Xaa can be any naturally occurring amino acid
  misc_feature (272)..(272): Xaa can be any naturally occurring amino acid
  misc_feature (276)..(276): Xaa can be any naturally occurring amino acid
MMEAAAEASASARRRTLVLVNLTSMLEKADEVLLPAVYREVGAALAVSPTALGSLTLCRALVQALSFPLAAYASARHDRARVVAVGAFLGAAATFLVAISRTYLQMAISRGLNGIGLALVIPAINSLVADYTDDHTRGAAFGWLQMTCNLGSIVGGSFGVLLAPVTFLGVPGWRLAFHIVGIISVALGLLMWLLAADPHSKSKSAASAREEARELLRDARAVVAVPTFQVIVAQGVAGLIXWSGLNFATMWLELMGFSHWETSIITGLXLLXHALXALFGGVVGDAVSRRFPEPARSRWPDQLGVGLRSGRLLLACQGPVTGAGNRRVFAWGLPFLEAPPKKPIFRKLCGQGEKGF

SEQ ID NO: 4643 - protein, 350 aa, Triticum aestivum
MGGVGWRRLGSKLRQRWGWESRLRARGFSSAPAVPPPPHMESVGFIGLGNMGSHMARNLLRAGYRVSVHDINEDAMKKFSDDGIPTKQSPLEVSESSDVVITMLPSSAHVLDVYSGRNGLLGNGGRLGPWLYIDSSTVDPHTSRKISMDMSRCSLNEKKGYAEKPMMLDAPVSGGVPAAEAGTLTFMVGGLEETYIAAKPLLLAMGKKLIYCGGAGNGSAAKLCNNMAMAISMLGVSEAFALGQNLGIKASTLTDIFNCSSARCWSSDTYNPVPGVMAGVPSSRNYDGGFTSKLMAKDLDLAMASASGVGFKCPMGSEALEIYRKLCDEGCEFKDFSCAFRHFYTGKDEK

SEQ ID NO: 4644 - protein, 127 aa, Triticum aestivum
  misc_feature (65)..(65): Xaa can be any naturally occurring amino acid
PRPNLARRKESFRGDGGGRRHLLRRCPRHPRRKNLTSNVRSILYSRTFLSIISGVVAGIWGFTGXLTGFVFYFLMMMVASIGLLAKSKFSVHTYFDSWSRILVEGVLAGLMSFVLFWTFAYDIVHIF

SEQ ID NO: 4645 - protein, 307 aa, Triticum aestivum
HASGDDEISRGWGPKKLEAAPAVRDHGAVLGALTRALASTEAAYLDMTDQSMGSHPELAVTGACLLVALVRDDDVYVMNLGDSRAIVAQRADDDHGCGLGAMRMDDIGVGLEIESRPVGYPMIGLEALQLSIDHSTSIEEEVQRIKREHPDDDQCIVNDRVKGRLKVTRAFGAGYLKQAKLNNGLLEMFRNEYIGDAPYISCIPSLCHHKLTSRDQFLVLSSDGLYQYLSNEEVVLHVENFMERFPEGDPAQSLIEELLSRAAKKAGMDFYELLDIPQGDRRKYHDDVTVMVVSLEGRIWKSSGTYV

SEQ ID NO: 4646 - protein, 347 aa, Triticum aestivum
  misc_feature (105)..(105): Xaa can be any naturally occurring amino acid
MGSGNLVMKKVVKPSSFDLDIQLDKSWTEDVTCPICLDFPHNAVLLRCTSYEKGCRPFVCDTDKSRSNCLERFKSAHGQPVNVKVSAVNIAPRDSIPFHLFKHKXHPACPLCRGDVIGWAVIGEARQHLNQKKRCCEESCCSYVGNFHELQKHTQQKHPNSRPSEIDPARRVDWENFQQSSDIIDVLSTIHAQVPNSIVLGDYVIEYGDDDAGDDYEVLHRVRGNWWTSCIFCKSVRVFERAGEEQGQGKGEVVEGGPGNRSGQGSFTIHVPPRAVDIRESRFDGIDDEYPVTGAMPSAAPRRMAQSLQGSQVCPPNHPSNEHIRKTPLTPILPLASFLINIHGSRM

SEQ ID NO: 4647 - protein, 513 aa, Triticum aestivum
  misc_feature (70)..(70): Xaa can be any naturally occurring amino acid
MAPFLNPSPELKHALLWSVPILIIAPTVIFLYMQAVGKKKNTIRLPPSPLRLLIIGHLHLMVHEPHRSLXEAGSQPGPVIHLQLGGIAAIVVSSPEAAKEVLKTHDVHCCSRPSSPGAKLITYGQQDIAFSPYNASWRERRKLFVSELVSSKRVQSFAYALEAQVGELIQSLSLRSPPTEAVNLNETLFTLIDGFIGRVAFGSMNGAKLMKYAKFQQVFSEAMIALSAFSAQDFFPASPMSRWVDKLVGLEARYQRIFLELDSYFEMGLSQHMDPGRVKPDKDDLVDVLISLWLGQGKVTKDHLKALLMDTFIGGTTTSSVTLLWAMSELIKNPTVMQKAQREVRSLVGGKQRLVQVDDLSKLNYLKMVVKETLRLHPPAPVLVPRETMDHVKVLGYDIPAKTRIFVNVWAMGRDPACWEKPEEFYPERFDGMDTDFYGLHYELLPFGAGRRICPAIPMGATIVEFTLASLLHSFDWELPDGMRKEDVSMEGTGRQVFCRKTPLCLVPSVNTG

SEQ ID NO: 4648 - protein, 153 aa, Triticum aestivum
  misc_feature (57)..(57): Xaa can be any naturally occurring amino acid
  misc_feature (78)..(78): Xaa can be any naturally occurring amino acid
  misc_feature (104)..(105): Xaa can be any naturally occurring amino acid
  misc_feature (119)..(119): Xaa can be any naturally occurring amino acid
  misc_feature (121)..(121): Xaa can be any naturally occurring amino acid
  misc_feature (126)..(126): Xaa can be any naturally occurring amino acid
  misc_feature (129)..(129): Xaa can be any naturally occurring amino acid
  misc_feature (132)..(132): Xaa can be any naturally occurring amino acid
  misc_feature (136)..(136): Xaa can be any naturally occurring amino acid
  misc_feature (138)..(138): Xaa can be any naturally occurring amino acid
  misc_feature (147)..(147): Xaa can be any naturally occurring amino acid
SLACLLSPSPPPPPVLRPTPRRFLGDGRRAAATGAARWIQRLSAARISTEALERGQXSRVIDASLTLIRERAKLKGEXLRAMGGVKVPATSLGVPFGENSSFLXXGCVCPPRIREAFCXEXNSNNXKKXRIXDSRXLXDVRDSPIKXIPNVGL

SEQ ID NO: 4649 - protein, 284 aa, Triticum aestivum
MAGGGELVVSFGEMLVDFVGKLGDDEFGRMLAAILRDNGVDDGAVVFDAGARTALAFVTLRADGEREFMFYRNPSADMLLTADELNVDVIKRATVFHYGSISLIAEPCRSAHLRAMEIAKEAGALLSYDPNPREALWSSREEARTKILSIWDQADIVKVSESEVEFLTGIDSVEDDVVMKLWRPTFKLLLVTLGGKGCKYYARDFRGVVPSYKIQQVDTTGAGDAFVGALLRKIVQDPSSLQNQEKLEEAIKFANACGAITTTKKGAIPSLPTEIEVLQLMENA

SEQ ID NO: 4650 - protein, 197 aa, Triticum aestivum
MEAIKQTFQRCKAQNRSALVTYVTAGYPNPEITADILLGLEKGGADIIEVGAPFTDPIADGPTIQKANTIALSHGVSISSTLEIIKTARSKGLKTPVLIMGYYNPLLSYGEERLLQECKAAGVNGFIVVDLPPEEAISFRKLCTQGGLSYVPLIAPATFDARMKILCQLADSFIYVVSRQGVTGATGSLSSNIPSLL

SEQ ID NO: 4651 - protein, 542 aa, Triticum aestivum
MIEQVVQKSRLVPVRNSRDISSPQSHPPPQPPATKSGGDRSAGDSAPLIPSGMDGQAPHPIAVAPESLPHPPPTLETEAEDDPVVVPDTSDAASSEPSKVGALSTSPLIKAEDDPVVVPDSVEPASSVASVVSAGGVVPLPPPSRPLEAEEDPLIVPDTSEALPLEAPNVGTGSVVPLLPSPPLEAEDDPLIVPVIDASSEASDVVASGVVLTDELRDKIVKQVEYYFSDENLPTDEFMLKFVMKNKEGLGNVPLGVIASFRKMKKLVQDHSTIEAALRTSSKLVVSSNGKRVRRLHPLPCNELKDVKKRTVVVENLPLDFSLESIQEKFGSVGKIMKITIHDPHAVGESAASKKPDFMLSNKVHAIVEYEAVEAAEKAVATLNDERNWRTGMRVILLAKRSVVGSGKNIQSSKENHGTCLRKNNEGQFSKEVQQSVSEKNGGADSGEVASDKENVNSDVNHEEVRQHQRANASGGRKGRYRSQGKGLSGQGHGSSPTIPGSDSANKPISGPRMPDGTRGFTMGRGRSLPLPKAEKAQKTEE

SEQ ID NO: 4652 - protein, 703 aa, Triticum aestivum
MDSAAAGMRDSALDLLAALLTGRAPPAAADGDQNRRLLALLATSLAVLVGCGVALLFRRSSSGAAPLAHKSAAAKPLAAKKDQEPDPDDGRQRVALFFGTQTGTAEGFAKALAEEAKARYDKAVFKVLDLDDYAAEDEEYEEKLKKENIAFFFLATYGDGEPTDNAARFYKWFSEGNERGEWLSNLKFGVFALGNRQYEHFNKVGKEVDQLLAEQGGKRIVPVGLGDDDQCIEDDFNAWKELLWPELDKLLRVEDNSSTAQSPYTAAIPQYRVVLTKPEDATHINKSFSLSNGHVVYDSQHPCRANVAVRRELHTPASDRSCIHLEFDIAGTSLTYETGDHVGVYAENSIETVEEAEKLLDYSPDTYFSIYADQEDGTPLFGGSLPPPFPSPCTVRVALARYADLLNSPKKSVLLALAAHASDPKEAERLRHLASPAGKKEYSQWIIASQRSLLEVISEFPSAKPPLGVFFAAIAPRLQPRYYSISSSPRMAPTRIHVTCSLVHGQTPTGRIHKGVCSTWMKNSTPLEESQECSWAPIFVRQSNFKLPADPTVPIIMVGPGTGLAPFRGFLQERLALKETGVELGRAILFFGCRNRQMDFIYEDELNNFAESGALSELVVAFSREGPTKEYVQHKMAEKAAELWSIVSQGGYVYVCGDAKGMARDVHRALHTIVQEQGSLDSSKAEGYVKNLQMEGRYLRDVW

SEQ ID NO: 4653 - protein, 390 aa, Triticum aestivum
  misc_feature (31)..(31): Xaa can be any naturally occurring amino acid
  misc_feature (42)..(42): Xaa can be any naturally occurring amino acid
PASDRSCIHLEFDIAGTSLTYETGDHVGVYXAENSIETVEEXAEKLLDYSPDTYFSIYADQEDGTPLFGGSLPPPFPSPCTVRVALARYADLLNSPKKSVLLALAAHASDPKEAERLRHLASPAGKKEYSQWIIASQRSLLEVISEFPSAKPPLGVFFAAIAPRLQPRYYSISSSPRMAPTRIHVTCSLVHGQTPTGRIHKGVCSTWMKNSTPSEESKECSWAPIFVRQSNFKLPADPTVPIIMVGPGTGLAPFRGFLQERLALKETGVELGRAILFFGCRNRQMDFIYEDELNNFAESGALSELVVAFSREGPTKEYVQHKMAEKAAELWSIVSQGGYVYVCGDAKGMARDVHRALHTIVQEQGSLDSSKTEGYVKNLQTEGRYLRDVW

SEQ ID NO: 4654 - protein, 317 aa, Triticum aestivum
TGPEFRVDPASGDMLERRVASRLPDAAVDDLLIPSYSYLVETLYDVECVERIVRHFLEGRGGVEEVDEEGSEAETPGREASRRAMLAVSRLMDAYLGEIAADPRLRTDKFCDLAWALPDGARVYDDGLYRAVDIYIKAHPALREEEKEKVSGVVDGRKLTLEACTHAAQNERLPLRTVVQVLFFDQLQLRRAIARTIVANEGGAAGQGEEDGDSDGGRTWRVATRGNQMLRLDMDSMRNRVQELERECTTMRKAIQKIDRRGGGAAGDKGAAAPAAEGRWGSMVTKRFGCKFPAQVCQSQPRSVVARPRRARIEQSP

SEQ ID NO: 4655 - protein, 243 aa, Triticum aestivum
  misc_feature (93)..(93): Xaa can be any naturally occurring amino acid
  misc_feature (133)..(133): Xaa can be any naturally occurring amino acid
TRPPTRPATTSKALRILDSCGSDVIELGVPYSDPLADGPVIQAAASRALKKGTTLGSVLAMLTEVIPELSCPIVLFTYYNPILKNGVRNFMGXIKQAGVHGLVVPDLPLEETTLLRSEATMHNIELVLLTTPXTTPTERMKEITKASEGFVYLVSAVGVTGARSNVNLRVEHLLKEIKQVTDKPVAVGFGISTPEHAKQIAGWGADGVIIGSAIVRQLGEAASPEEGLRRIEEYAKSIKAAIP

SEQ ID NO: 4656 - protein, 119 aa, Triticum aestivum
MAPSREACAIAMAVAAPFIAMASNISTDNVEKRRRTSSDMLQRTVSDVSLQLHHHGPAKEEEEAAAEAEMKLLHPVSEVEDAKCECCGMSEECTPEYIRGVRGRFSGRWICGLCAEAVT

SEQ ID NO: 4657 - protein, 139 aa, Triticum aestivum
KTTYPLINPERLAMMKKEAVLVNASRGPVIDEVALVEHLRANPMFRVGLDVFEDEPYMKPGLAEMKNAVVVPHIASASKWTREGMATLAALNVLGKIKGYPVWGNPNAVEPFLDEKAAPPPACPSIVNAKQLGLPSSKL

SEQ ID NO: 4658 - protein, 164 aa, Triticum aestivum
  misc_feature (23)..(23): Xaa can be any naturally occurring amino acid
IEGFKMNLIYFDLYQSTRLEKFXQFLKANGEQPLTWKRASSMEEVLKEADVISLHPVLDKTAYYLINPERLAMMEEVVLVNASRGPVIDEVALVEHLRANHMFHVGLDVFEDEPYMKPGLAEMKNVVVVPHIASTSKTREGMATLAALNVLVWYDFPALWSTNH

SEQ ID NO: 4659 - protein, 459 aa, Triticum aestivum
  misc_feature (35)..(35): Xaa can be any naturally occurring amino acid
  misc_feature (53)..(53): Xaa can be any naturally occurring amino acid
  misc_feature (88)..(88): Xaa can be any naturally occurring amino acid
  misc_feature (100)..(100): Xaa can be any naturally occurring amino acid
  misc_feature (127)..(127): Xaa can be any naturally occurring amino acid
MAKPISIEVWNPSGKYRVVSTKSMPGTRWIKLLTXNDCRLEICTEKKTILSVXDILALIGDHCHGVIGQASNPSLLFLSFMNFLVVGXVTVLKSVVKVSXKLWLRSYIVCYPFNNALLYVLFQVFNXVINLDDDLCGTNWLQLTEDWGEVLFSALKRAGGTAFSNMAVGYNNVDVDAANRNGIAIGNTPGVLTETTAELAASLSVAAARRIVEADQFMRAGLYDGWLPHLFVGNLLKGQTVGVIGAGRIGSAYARMMIEGFKMNLIYFDLYQSTRLEKFVTAYGQFLKANGEQPVTWKRASSMEEVLREADVISLHPVLDKTTYHLINPERLAMMKKEAVLVNASRGPVIDEVALVEHLRANPMFRVGLDVFEDEPYMKPGLAEMKNAVVVPHIASASKWTREGMATLAALNVLGKIKGYPVWGNPNAVEPFLDEKAAPPPACPSIVNAKQLGLPSSKL

SEQ ID NO: 4660 - protein, 431 aa, Triticum aestivum
MEMKLTIKRVPTVLSNYQEEGGGGCGRNCLGDCCLPASKLPLYAFKADPKKPAQDDELPTEFFLNSLLLAQWEDRVARGLFRYDVTACETKVIPGELGFVAQLNEGRHLKKRPTEFRVDRVLQPFDSAKFNFTKVGQEEVLFRFENGGGDSSYFLENAPSTEGDHAPSVVAINVSPIEYGHVLLIPRVLDRLPQQIDPESFLLALHMAAEAASPYFRLGYNSLGAFATINHLHFQAYYLSVPFPVEKAPTKKIPLAKCALNSGVKVSKLTNFPVRGLVFERGNTLKDLADVVTNACIWLQENNVPFNVLISDSGRRIFVFPQCYAEKQALGEVSQDLLDTQVNPAVWEISGHIVLKRRTDFKEASEASAWRLLAEVSLSEERFEEVKACIFEATGLTESDEEEESSESPYASSSSVPRASSHMSEGCLVLQ

SEQ ID NO: 4661 - protein, 442 aa, Triticum aestivum
MKRVNLALMDKVLDVDVKKKTVTVQAGIRVAELVDALREHGLTLQNFASIREQQVGGIIHVGAHGTGARLPPIDEQVISMKLVTPAKGTIELSTEKDPDLFYLARCGLGGLGVVAEVTLQCVERHQLVEHTFVSNADEIKKNHQKWLSENKHIKYLWIPYTDTVVVVQCNPPSRWKTPKLASKYGKDEALQYVRDLYRESLKKYRTEADSKDPAIDQLSFTELRDQLIALDPLDKDHVIRINKAEAEYWKKSEGYRMGWSDEILGFDCGGQQWVSETCFPTGTLAKPNMKDLYYMEELLQLIEKEDIPAPAPIEQRWTARSRSPMSPASSSEEDDIFSWVGIIMYLPTSDPRQRKDITEEFFNYRSLTQTSLWDDYSAYEHWAKIEVPKDKDELAQLQARLRKRFPVDAYNKARMELDPNKVLSSAKLEKFFPGMQTVQHAK

SEQ ID NO: 4662 - protein, 193 aa, Triticum aestivum
  misc_feature (132)..(132): Xaa can be any naturally occurring amino acid
  misc_feature (145)..(145): Xaa can be any naturally occurring amino acid
  misc_feature (154)..(154): Xaa can be any naturally occurring amino acid
  misc_feature (165)..(167): Xaa can be any naturally occurring amino acid
  misc_feature (170)..(172): Xaa can be any naturally occurring amino acid
  misc_feature (174)..(176): Xaa can be any naturally occurring amino acid
  misc_feature (184)..(184): Xaa can be any naturally occurring amino acid
  misc_feature (186)..(186): Xaa can be any naturally occurring amino acid
NKFVQKSRLVPVRNSRDIVDPRVRESPRGRRTRNAAVPSACFLLLLHLLLLVPTLSPSAVPILRHIMQKAALSSPFFAAKPRGDCQELQALDGAEARCAYLLSHTPCTPAGYVDYLRLFYCGFAGDGQPAAXYTEYLLCLVLLYXLLGDTASDXFCPSIEWLSDXXXLAXXXDXXXLVTLGNFXPXDLHALVS

SEQ ID NO: 4663 - protein, 172 aa, Triticum aestivum
QSLRKHTKAYLDCHLMVTNPSDYVEPFGKAGASGFTFHIEVARDNWQDLIQSIKSKGMRPGVSLRPGTPVEEVFPLVEAENPVELVLVMTVEPGFGGQKFMPEMMDKVRTLRKKYPSLDIEVDGGLGPSTIDVAASAGANCIVAGSSIFGAADPGAVISVLRKSVEGSQNKN

SEQ ID NO: 4664 - protein, 322 aa, Triticum aestivum
  misc_feature (28)..(28): Xaa can be any naturally occurring amino acid
VKQVEYYFSDENLPTDEFMLKFVMKNKXGLGNVPLGVPRVRPRVRKLVQDHSTIEAALRTSSKLVVSSNGKRVRRLHPLPCNELKDVKKRTVVVENLPLDFSLESIQEKFGSVGKIMKITIHDPHAVGESAASKKPDIMLSNKVHAIVEYEAVEAAEKAVATLNDERNWRTGMRVILLAKRSVVGSGKNIQSSKENHGTCLRKNNEGQFSKEVQQSVSEKNGGADSGEVASDKENVNSDVNHEEVRQHQRANASGGRKGRYRSQGKGLSGQGHGSSPTIPGSDSANKPISGPRMPDGTRGFTMGRGRSLPLPKAEKAQKTEE

SEQ ID NO: 4665 - protein, 147 aa, Triticum aestivum
  misc_feature (44)..(44): Xaa can be any naturally occurring amino acid
  misc_feature (57)..(57): Xaa can be any naturally occurring amino acid
  misc_feature (93)..(93): Xaa can be any naturally occurring amino acid
METGAKAPKKAGTAGRRAGGGPKKKAVSRSVKAGLQFPVGRIGXYLKHGRYAQRVGXGAPVYLAAVLEYLAAELLELAGNAARDNKKNRYHPXGHVLLAIRNDEELGKLLAGVTIAYGGVLPNINPVLLPKKAAAAAAKEPKKAADA

SEQ ID NO: 4666 - protein, 335 aa, Triticum aestivum
  misc_feature (156)..(156): Xaa can be any naturally occurring amino acid
  misc_feature (217)..(217): Xaa can be any naturally occurring amino acid
  misc_feature (248)..(248): Xaa can be any naturally occurring amino acid
  misc_feature (264)..(264): Xaa can be any naturally occurring amino acid
YNKFVQKSRLVPAPEFPGYRRPTRALCFPQRAAGHRPIPPTSPLLAPRAGGRRRRASPPADGPPPPARALAAPRGISARGFSSYEEARRGVNAPTSQSLLNYILLALVYGGIMIYKRQLLTVKWYYYLILSIVDVEAIYIVVKAYQYTSLTSVMLXLDCWAIPCVLFLTWIFLKTKYGLRKLVGVGICVAGVVLVVSSDVHASERKSKGPSPLKGDXLVIAGASLYAVSNVTEEYIVETKQQGLRLMXMLGVFGAIISGIQISXFLERQELSSTEWNASAVLPFIGFALAMFLFYSTVPIILKICGATMLNLSLLTSDMWAVLIRIFAYHEKVDW

SEQ ID NO: 4667 - protein, 230 aa, Triticum aestivum
MDSGDAWGRSSSTSSSAAAARRLQSRYDLYMGFDDADAGGDEVEARGAEAYNCPFCGEDFDFVGLCCHIDDEHAVEAKSGVCPICATRVGADLIGHLTMQHGSYFKMQRRRRVRKVSSGSHSLLSLLRKDLRDGSLQSFLGGSSYVSNPPAAAPDPFLQSLICSLPVAEPSKGFRSDSSDKTFLLNKFPDEKVVERAETSLSEKDQKERAQRSAFARGLVLSTIFDDDTM

SEQ ID NO: 4668 - protein, 149 aa, Triticum aestivum
  misc_feature (101)..(101): Xaa can be any naturally occurring amino acid
  misc_feature (115)..(115): Xaa can be any naturally occurring amino acid
  misc_feature (134)..(134): Xaa can be any naturally occurring amino acid
ANLASEAERMVRLGADWLHMDVMDGHFVPNLTIGAPVIESLRKHTKAYLDCHLMVTNPSDYVEAFGKAGASGFTFHIEVARDNWERVTQSIKAKGMRPGVXLKPGTPVEDVFPLXVGSRNPVDWVSVDDGQPGXGGQNSCREMMDKVRT

SEQ ID NO: 4669 - protein, 228 aa, Triticum aestivum
  misc_feature (114)..(114): Xaa can be any naturally occurring amino acid
  misc_feature (177)..(177): Xaa can be any naturally occurring amino acid
  misc_feature (190)..(190): Xaa can be any naturally occurring amino acid
  misc_feature (205)..(205): Xaa can be any naturally occurring amino acid
MAAAAKIAPSMLSSDFANLASEAERMVRLGADWLHMDVMDGHFVPNLTIGAPVIESLRKHTKAYLDCHLMVTNPSDYVEAFGKAGASGFTFHIEVARDNWKELTQSIKAKGMRXLPGVSLKPGTPVEDVFPLVEAETPVELVLVMTVEPGFGGQKFMPEMMDKVRTLRKKYPSLDIXVDGCLGSFHIEAXGSAAHWWAGPTASSXGELRVRRRRTPGEVISALRKKRG

SEQ ID NO: 4670 - protein, 366 aa, Triticum aestivum
  misc_feature (132)..(132): Xaa can be any naturally occurring amino acid
  misc_feature (167)..(167): Xaa can be any naturally occurring amino acid
  misc_feature (172)..(172): Xaa can be any naturally occurring amino acid
  misc_feature (174)..(174): Xaa can be any naturally occurring amino acid
  misc_feature (193)..(193): Xaa can be any naturally occurring amino acid
  misc_feature (197)..(197): Xaa can be any naturally occurring amino acid
MEPIPLLTPYKMGQFDLAHRVVLAPLTRQRSYGNVPQSHAAVYYSQRATAGGLLIAEATGVSDTAQGYNDTPGIWTAEHVEAWKPIVAAVHQKGALFFCQIWHCGRVSTFELQPGGTAPLASTREGGRPPEXSFHGPLEESPPPRALPVEEIPCPSSDDFQEGPPGXPIDAXFXTGVEIHGANGYIIEQFLKXSANXRADEYGGTLETRCRFALEVVDAVVKEVGGPRVGIRLSPFTDYMDCHDSDPHSLALYMSTKLNDHDILYIHMIEPRMAIVDGRRVVPKRLLPYREAFKGTFIANGGYDREEGGKVVTEGYTDLVAFGRLFLANPDLPKRFEVGAELNKYDRTTFYTSDPVVGYTDYPFLE

SEQ ID NO: 4671 - protein, 430 aa, Triticum aestivum
QVCTKKQAGTGPEFPGYRRPTRPVNFTTIYIGTSVQVPSAITTFPSTAQIVPEPLGVVLVISAWNYPFLLSIEPVIGAIAAGNAVVLKPSELAPATSSLFAKLLPEYVDSSCIKVVEGGVTETGALLQQKWDKIFYTGNGNVARVVLAAAAKHLTPVALELGGKCPVIVDSNVDLHVAAKRIAVGKWGCNNGQACIAPDYIITTKAFVTELVDSLKRVLERFYGEDPLQSADLSRIVSISHFERLTKLIEDKEVATKIQLGGQTDQEQLKIAPTVLVDVPLDTELMTGEIFGPMLPIITVDKIEESIAHINAGAKPLAAYLFTKDKKLQQDFVSNVSAGGMLVNDVALHLTNPHLPFGGVGDSGTGSYHGKFSFDCFTHRKAVLIRGFGGEANARYPPYTAEKQRILRGLIKGSFFALILALLGFPREKR

SEQ ID NO: 4672 - protein, 306 aa, Triticum aestivum
  misc_feature (254)..(254): Xaa can be any naturally occurring amino acid
  misc_feature (265)..(265): Xaa can be any naturally occurring amino acid
  misc_feature (271)..(271): Xaa can be any naturally occurring amino acid
MYGISSTHASAALPDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLPVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGXVTTIIGGGDSXAAVEKXAGLADKMSHISTGGGASLELLEGQPLPGVLALDEA

SEQ ID NO: 4673 - protein, 203 aa, Triticum aestivum
PRVRGRVGRPLAGFFGEERPTYRSLLSGVVGVTGVVMVVLMAVSFTLAARPLRRAPTRTRLPSPLGHLAGFNAFWYSHHLLVVVYLLLLVHGWFIFLVTKWYQRTTWMYIAVPFALHVGERTLRALRSKAYAAKILKVCLLPGNVLTITMSKPCGFRYRSGQYVFLQCPTISPFEWHPFSITSAPGDDYISVHIQTRGDWTQE

SEQ ID NO: 4674 - protein, 347 aa, Triticum aestivum
  misc_feature (256)..(256): Xaa can be any naturally occurring amino acid
MRGVDAAAVAQELPGHGQTVCVTGAAGYIASWLVKLLLERGYTVKGTVRNPDDPKNAHLKALDGAAERLMVCKADLLDYDAICAAVEGCHGVFHTASPVTDDPEQMVEPAVRGTEYVINAAADAGTVRRVVFTSSIGAVTMDPNRGPDVVVDESCWSDLEFCKKTKNWYCYGKAVAEQAAWEKAGARGVDLVVVNPVLVVGPLLQPTVNASAAHILKYLDGSAKKYANAVQAYVDVRDVATAHVRVFEAPEASGRXLCAERVLHREDVVHILAKLFPEYPVPTRCSDEVNPRKQPYKMSNQKLQDLGLQFTPVNDSLHAAVARLQAKGHLPAPRKDILPAELDGATA

SEQ ID NO: 4675 - protein, 350 aa, Triticum aestivum
MTVVAAAAAAAAQELPGHGQTVCVTGAAGYIASWLVKLLLERGYTVKGTVRNPDDPKNAHLKALDGAAERLVLCKADLLDYDAICAAVEGCHGVFHTASPVTDDPEQMVEPAVRGTEYVINAAADAGTVRRVVFTSSIGAVTMDPNRGPDVVVDESCWSDLEFCKKTKNWYCYGKAVAEQAAWEKAAARGVDLVVVNPVLVVGPLLQPTVNASAAHILKYLDGSAKKYANAVQAYVDVRDVAAAHVRVFEAPGASGRHLCAERVLHREDVVHILGKLFPEYPVPTRCSDEVNPRKQPYKMSNQKLQDLGLQFTPVNDSLYETVKSLQEKGHLPAPRKDIILPAELDGATA

SEQ ID NO: 4676 - protein, 212 aa, Triticum aestivum
  misc_feature (70)..(70): Xaa can be any naturally occurring amino acid
HLTCDFPRLLHASDEAYEPMKRYFGQTRVPDYWWFVRGVEGVTGVLMVVLMAVAYTLAHPRFRRSKLGAXNPLQEASADFNMFWYSHHLFVVVYVALVVHGVCLYINRTWYKQTTWMYLAVPVLLYAGERLLRALRSHGLTTVRIEKVAVYPGNVIAIHMSKPHGFRYRSGQYIYVNCGEVSPFEWHPFTITSAPGDDYLSMHIRCRGDWTS

SEQ ID NO: 4677 - protein, 233 aa, Triticum aestivum
MARFMRLQCHPSGPLAAQPALVPPAGSLFWFVCGGPRGKKTPSLCCCIKTFWAPTGVFVPGSFPRPGPFPPPAAPEISGLTPCKESKAFPKREKQSGKKLNSSLKKYAPDLGPAVAIQATIEKTKPRFEKYGKFGLLCGSDGLPHLIVSGDQRHWGEFITPGVLFLYIPGWIGWVGRSYLIAVSGEKKPPMREIIIDVELAARIIPRGFIWPVAAYREVINGDLLVDDADIGY

SEQ ID NO: 4678 - protein, 167 aa, Triticum aestivum
MSGVKKVTDVAAKAGKAIDWDGLAKMLVSDEARKEFANLRRTFEDVNHQLQTKFSQEPKPIDWEYYKKGIGSKVVDMYKEAYDSIEIPKYVDTVTPEYKPKFDALLIEMKEAEKTSLKESERIEKEIAELKEMKKKISTMTADEYFAKHPELKKKFDDEIRNDYWGY

SEQ ID NO: 4679 - protein, 501 aa, Triticum aestivum
MTSPAPAPPAAAAAQSPPPRIGLAGLATMGQNLALNIAEKGFPISVYNRTAAKVDSTLSRAAAEGALPVLGHRDPRDFVLSLARPRTVVLLVQAGPAVDATIDALSPYLDAGDAIVDGGNEWYQNTERRIEQAASRGILYLRLGVSGGEEGARNGPSLMPGGDFQAYSNIKDILEKAAAQTEDGPCVTFVGPGGAGNFVKMVHNGIEYGDMQLIAEAYDVLHRVGGLSNSEIADVFAEWNKGELESFLVEITADIFTVADPLEGSTSGALVDKILDKTGMKGTGKWTVQQAAELAVAAPTIAASLDGRYLSGLKDERVAAASVLEEEGMPVGLLEKINVDKKVLVDRVRQALYSSKVCSYAQGMNLLRAKSVEQGWNLNLAELSRIWKGGCIIRARFLDRIKKAYDRNPELANLIVDREFAREMVQRQGAWRWVVARAVEAGISTPGMSASLSYFDTYRCNRLPANLIQAQRDLFGAHTYERIDRPGSFHTEWTKLAREGK

SEQ ID NO: 4680 - protein, 235 aa, Triticum aestivum
  misc_feature (204)..(204): Xaa can be any naturally occurring amino acid
  misc_feature (223)..(223): Xaa can be any naturally occurring amino acid
VSDIPLSLPCLGKKKKKKRGLPINFAGLAKAVKPGATIFVGQYLFTGSETTSVWLEVSEVQGDDVVCVIKNSATLAGSLFTLHCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPAVVTXRVVDSMTDNLRPTRAEATXDVANAVLDGSDA

SEQ ID NO: 4681 - protein, 374 aa, Triticum aestivum
LPVLCHVEAGDILLVDGGMMSLAVKSKTADTVKCVVVDGGELKSRRHLNVRGKSATLPSITEKDWEDIKFGVENGVDFYAVSFVTVGEVIHELKAYLKSANADIHVIPKIESADSIPNLQSIIAASDGAMVARGDLGAELPIEEVPLLQEEIIRTCRSMQKPVIVATNMLESMIDHPTPTRAEVSDIAIAVREAADAIMLSGETAHGKYPLKAVKVMHTVALRTESSLYDPTKAPSLVARPKALLNDDFCKSQLSKMFGSHATMMANTLRTPIIVFTRVGSMAVLLSHYRPSSTIYAFTNEVRVKQRLALYQGVVPILMEFSDDAEETFSRAITSLLDAKYMNEGDYVTLVQSGSQSIWREESTHHIQVRKVQC

SEQ ID NO: 4682 - protein, 296 aa, Triticum aestivum
MDVASVLLPFVLALVAIPILLALHDWPRLPPGPCPWPVVGNLRQIKPVRCRCFQEWAERYGPIFSVWFGSSLTVVVSTPELAKEVLKDHDQQLANRTRNRSTQRFSRNGQDLVWADYGPHYIKVRKLCNLELFTQKRLEALRPIREDEVTAMVSSVHRAATGPGNEGKPLVVRSHLAMVSFNNITRLVFGKRFMNANGDINEEGQEFKSIVNNGIKIGASLSIAEYVWYLRWLFPLNEELYKTHNERRDQLTKKIIEEHAKALKESGSKHHFVDALLTLREQYDLSDDTVFGLLWV

SEQ ID NO: 4683 - protein, 90 aa, Triticum aestivum
IIEADLVLLAMGFLGPEEDIADKLGLEKDNRSNFKAQFGHFGTSVDGVFAAGDCRRGQSLVVWAITEGREAAAAVDKYLSRDEQNVAGLT

SEQ ID NO: 4684 - protein, 424 aa, Triticum aestivum
NELVHQNRWREALDRLLETNNFPEFTGRVCPAPCEGSCVLGIIENPVSIKSIECSIIDKGFEEGWMVPRPPLQRTGKKIAIVGSGPAGLAAADQLNKMGHFVTVFERSDRIGGLMMYGVPNMKTDKIGVVQRRVNLMAEEGVTFVVNANVGSDPLYSIERLHSENNAVILACGATKPRDLSIPGRELSGVHFAMEFLHANTKSLLDSNLEDGRYISAQGKKVVVIGGGDTGTDCIGTSVRHGCSSIVNLELLTKPPSKRASDNPWPQWPRVFRVDYGHQEASTKFGNDPRTYEVLTKRFIGDEDGKLKALEVVRVKWEKVDGKFQFKEIEGSQEIIEADLVLLAMGFLGPEENIADKLGLEKDNRSNFKAQFGHFGTSVDGVFAAGDCRRGQSLVVWAITEGREAAAAVDKYLSRDEQNVAGLT

SEQ ID NO: 4685 - protein, 130 aa, Triticum aestivum
NLRRTFEDVNHQLQTKFSQEPQPIDWEYYKKGIGSKVVDMYKEAYESIEIPKYVDTVTPQYKPKFDALLVEMKEAEKASLKESEKIEKEIAEMKEMKKKISTMTADEYFAKHPELKQKFDDEIRNDYWGY

SEQ ID NO: 4686 - protein, 219 aa, Triticum aestivum
  misc_feature (144)..(144): Xaa can be any naturally occurring amino acid
  misc_feature (174)..(174): Xaa can be any naturally occurring amino acid
  misc_feature (176)..(176): Xaa can be any naturally occurring amino acid
  misc_feature (180)..(180): Xaa can be any naturally occurring amino acid
SGSRFRPNPASNPMAASAGSKIRNAKLVLLGDVGAGKSSLVLRFVKGQFVEFQESTIGAAFFSQTLAVNDETVKFEIWDTAGQERYHSLAPMYYRGAAAAIVVYDISNQASFTRAKKWVQELQAQGNQNTVVALAGNKADLLEXREVQIEEAKTYAQENGLFFMETSAKTATNXEXDYFXEIAKRLLQGQAAQNPQAAGMVLSQRPNERVVSAASCCSS

SEQ ID NO: 4687 - protein, 219 aa, Triticum aestivum
  misc_feature (144)..(144): Xaa can be any naturally occurring amino acid
  misc_feature (174)..(174): Xaa can be any naturally occurring amino acid
  misc_feature (176)..(176): Xaa can be any naturally occurring amino acid
  misc_feature (180)..(180): Xaa can be any naturally occurring amino acid
SGSRFRPNPASNPMAASAGSKIRNAKLVLLGDVGAGKSSLVLRFVKGQFVEFQESTIGAAFFSQTLAVNDETVKFEIWDTAGQERYHSLAPMYYRGAAAAIVVYDISNQASFTRAKKWVQELQAQGNQNTVVALAGNKADLLEXREVQIEEAKTYAQENGLFFMETSAKTATNXEXDYFXEIAKRLLQGQAAQNPQRGGMVLSQRPNERVVSAASCCSS

SEQ ID NO: 4688 - protein, 245 aa, Triticum aestivum
THASAHGGEPTTNSPIRLLACGLIRLKVPRPHRPNPASNPMAASAGSKIRNAKLVLLGDVGAGKSSLVLRFVKGQFVEFQESTIGAAFFSQTLAVNDETVKFEIWDTAGQERYHSLAPMYYRGAAAAIVVYDISNQASFTRAKKWVQELQAQGNQNTVVALAGNKADLLEAREVQIEEAKTYAQENGLFFMETSAKTATNVNDIFYEIAKRLLQGQAAQNPQAAGMVLSQRPNERVVSAASCCSS

SEQ ID NO: 4689 - protein, 504 aa, Triticum aestivum
MDVASLLLPFVLALVAIPILLALLDWLRLPPGPCPWPVVGNLRQIKPVRCRCFQEWAERYGPIFSVWFGSSLTVVVSTPELAKEVLKEHDQQLANRTRNRSTQRFSRNGQDLVWADYGPHYIKVRKLCNLELFTQKRLEALRPIREDEVTAMVASVHRAAIGPGNDGKPLVLRSHLAMVSFNNITRLVFGKRFMNANGDINEEGHEFKSIVNNGIKIGASLSIAEYVWYLRWLFPLNEELYKTHNERRDHLTKKIIEEHAKALEESGSKNHFVDALLTLREQYDLSDDTVFGLLWDIITTGMDTTVISVEWAMAELVRYPRVQKKLQEELDSVMSEADFQKLPYLLAVVKESLRLHPATPLMLPHKASASVKVGGYNIPKGADVTVNVWAIARNPDVWRNPLEYRPERFLEESIDIKGGDFRVLPFGAGRRVCPGAQLGINLVASMIGHLLHHFEWSLPEGTMPEDVDMMESPGIVMFMSTPLQAVTKPRLDKEELYNRVPVEM

SEQ ID NO: 4690 - protein, 205 aa, Triticum aestivum
QVCTKKQAGTGPEFPGYRRPTRPGQQILDLLLAETQPKKICSQVGLCTFDGTRGVSAGIRRVVDDEPVKSNGLRTDPMCSACEMAVVWMQNQLAQNKTQDLILDYVNQLCNRLPSPMGESAVDCASLGSMPDIEFTIGGKKFALKPEEYILKVGEGAAAQCISGFTAMDIPPPRGPLWILGDVFMGPYHTVFDYGKLRVGFAKAA

SEQ ID NO: 4691 - protein, 260 aa, Triticum aestivum
  misc_feature (158)..(158): Xaa can be any naturally occurring amino acid
  misc_feature (196)..(196): Xaa can be any naturally occurring amino acid
  misc_feature (212)..(212): Xaa can be any naturally occurring amino acid
QVCTKKQAGTGPEFPGYRRPTRPAAIADSGTSLLTGPTAIITEINEKIGAAGVVSQECKTIVSQYGQQILDLLLAETQPKKICSQVGLCTFDGTRGVSAGIRRVVDDEPVKSNGLRTDPMCSACEMAVVWMQNQLAQNKTQDLILDYVNQLCNRLPSXPMGESAVDCASLGSMPDMEFTICGKKFALKTEEYILKXVGEGPAAQWISGSTAXDFPLPRGLSWILGNVSLGPYTRLRLRELVVWSPQGRLKRLFKSPPHGE

SEQ ID NO: 4692 - protein, 279 aa, Triticum aestivum
  misc_feature (10)..(10): Xaa can be any naturally occurring amino acid
EHTYVPVTQXGYWQFDMGDVLVGGKSTGFCAGGCAAIADSGTSLLAGPTAIITEINEKIGAAGVVSQECKTIVFYYGQQILDLLLAETQPKKICSQVGLCTFDGTRGVSAGIRSVVDDEPVKSNGLRTDPMCSACEMAVVWMQNQLAQNKTQDLILDYVNQLCNRLPSPMGESAVDCASLGSMPDIEFTIGGKKFALKPEEYILKVGEGAAAQCISGFTAMDIPPPRGPLWILGDVFMGPYHTVFDYGKLRVGFAKAGLKGWSSERPTRGGEHLRRERA

SEQ ID NO: 4693 - protein, 510 aa, Triticum aestivum
  misc_feature (273)..(273): Xaa can be any naturally occurring amino acid
MGTRGLAVLLLAAVLLQALLPASEAEGLVRIALKKHAIDRNSRVAKSLSDREEGPLLGGGAANTLRSEEEGDIVSLKNYMNAQYFGEIGVGTPPQKFTVIFDTGSSNLWVPSAKCYFSIACYLHARYKAGASSTYKKNGKPAAIQYGTGSIAGYFSEDSVTVGDLVVKDQEFIEATKEPGVTFLVAKFDGILGLGFKEISVGKAVPVWYNMVEQGLISDPVFSFWLNRHADDEGEGGEIIFGGMDPKHYVGEHTYVPVTQKGYWQFDMGDVLXVGGKSTGFCAGGCAAIADSGTSLLAGPTAIITEINEKIGAAGVVSQECKTIVSQYGQQILDLLLAETQPKKICSQVGLCTFDGTRGVSAGIRRVVDDEPVKSNGLRTDPMCSACEMAVVWMQNQLAQNKTQDLILDYVNQLCNRLPSPMGESAVDCASLGSMPDIEFTIGGKKFALKPEEYILKVGEGAAAQCISGFTAMDIPPPRGPLWILGDVFMGPLPHVFDYGKLRVGFAKPA

SEQ ID NO: 4694 - protein, 84 aa, Triticum aestivum
  misc_feature (15)..(15): Xaa can be any naturally occurring amino acid
  misc_feature (17)..(17): Xaa can be any naturally occurring amino acid
  misc_feature (32)..(32): Xaa can be any naturally occurring amino acid
  misc_feature (53)..(53): Xaa can be any naturally occurring amino acid
  misc_feature (73)..(73): Xaa can be any naturally occurring amino acid
VDCASLGSMPDIEFXIXGKKFALKPEEYILKXGEGAAAQCISGFTAMDIPPPXGPLWILGDVFMGPYHTVFDXGKLRVGFAKAA

SEQ ID NO: 4695 - protein, 509 aa, Triticum aestivum
  misc_feature (142)..(142): Xaa can be any naturally occurring amino acid
MGTRGLAVLLLAAVLLQGLLPASEAEGLVRIALKKRAIDRNSRVAKSLSDREEVHLLGGASNTLPSEEEGDIVSLKNYMNAQYFGEIGVGTPPQKFTVIFDTGSSNLWVPSAKCYFSIACYLHARYKAGASSTYKKNGKPAXAIQYGTGSIAGYFSEDSVTVGDLVVKDQEFIEATKEPGVTFLVAKFDGILGLGFKEISVGKAVPVWYNMVEQGLISDPVFSFWLNRHADDEGEGGEIIFGGMDPKHYVGEHTYVPVTQKGYWQFDMGDVLVGGKSTGFCAGGCAAIADSGTSLLAGPTAIITEINEKIGAAGVVSQECKTIVSQYGQQILDLLLAETQPKKICSQVGLCTFDGTRGVSAGIRSVVDDEPVKSNGLRTDPMCSACEMAVVWMQNQLAQNKTQDLILDYVNQLCNRLPSPMGESAVDCASLGSMPDIEFTIGGKKFALKPEEYILKVGEGAAAQCISGFTAMDIPPPRGPLWILGDVFMGPYHTVFDYGKLRVGFAKAA

SEQ ID NO: 4696 - protein, 197 aa, Triticum aestivum
MSASRFIKCVTVGDGAVGKTCLLISYTSNTFPTDYVPTVFDNFSANVVVDGSTVNLGLWDTAGQEDYNRLRPLSYRGADVFLLAFSLISKASYENVTKKWIPELRHYAPGVPIILVGTKLDLRDDEQFFVDHPGAVPISTAQGEELKKVIGATAYIECSSKTQQNIKAVFDAAIKVVLQPPKQKRKKRKSQKGCSIL

SEQ ID NO: 4697 - protein, 167 aa, Triticum aestivum
MALTRRFIFLFPAAVLAELASASASPFLSDSLFQGSTGSTGRSLLQTKNDCPMSFETQNYTVLTNKCKGPQYPPTECCDAFKEFACPFAAYINNQSTNCADTMFSYIGFRGYPKGLFADECLKGKEGVSCEGIPAVDTGVPSGGRQVQGVSRPLVVLLCGLGALLFP

SEQ ID NO: 4698 - protein, 224 aa, Triticum aestivum
MATVAVPKPSKDKPKPALGQSPAAATTPARAPPPTHADLFARSSEDQAKKSTYMGFEKWWLPPAPEVKKPRSLYNAASLAYLGDCIYELYARRHFFFPPLSINEYNKRVMDVVKCESQDLLLNKLLGEDFLTEEERDILRWGRNIVSSKTRTRKRAGIAVYNRASSLETLIGYLYLTNFKRLEQMMFQLGFTSGASSQNIADELLSSFQKTTSTSVQSQQPAKR

SEQ ID NO: 4699 - protein, 92 aa, Triticum aestivum
  misc_feature (46)..(46): Xaa can be any naturally occurring amino acid
MQRLSLLPESFKSCPREFVWSRYLTKGSVLEVYSGIPMQAVKQGFXQDLGASSLQSAHDLLRAETLRLEVRTGAAQVEGGIHGLVSYEKKSF

SEQ ID NO: 4700 - protein, 497 aa, Triticum aestivum
MASLADDGFSAARLFSQGVSYTYDDVIFLPGFIDFPADAVDLSTRLSRRVPLSIPCVASPMDTVSEAAMAAAMASLGGVAVVHSNTEPRAQASIVRAAKSRRLPFVSSVPIFSPASAPTLNDFAGHDYALVTEQGDSLSKLLGVAVAADAASPEAPAPVSEYMRPAPRSASASFDFEQAAAFLADEGLDYAPLVSEEGEVIDLITSKDVERIRSYPKLGKPSLGADGKFVVAASIGTREDDKLRLEQLIQAGANAIVIDSSQGNSTYQLDMIKYAKKTFPEVDLIGGNVVTIGQAQNLIAAGVDGLRVGMGSGSICTTQEVCAVGRGQATAVYKVASYAKDHNVPVIADGGISYSGHIVKALSLGASTVMMGSFLAGSHEAPGAYEYKDGHRVKKYRGMGSLEAMTKGSDARYLGDTLKLKVAQGVVGAVADKGSVLRFIPYTMQAVKQGFQDLGASSLQSAHDLLRAETLRLEVRTGAAQVEGGIHGLVSYEKKSF

SEQ ID NO: 4701 - protein, 144 aa, Triticum aestivum
MEVLGKSVIAEPSNVIFLSTILNTEGEIPSHKCDMRCQNEHIFGNMYRCKLTGMTHTCDKNCNQRILYDNHNSLCRVSGQLFALSPLELQAVRGIRRKHEADSSHEGCSFKRRRGAQLHPSPFERSYSAVSPIPSQAGDGMDLS

SEQ ID NO: 4702 - protein, 280 aa, Triticum aestivum
  misc_feature (242)..(242): Xaa can be any naturally occurring amino acid
TRPALGAPGPIAFPATGRVGGRVGGADGRVRVSGTLSVGQGASVLNQVWQVGSTVSGDGIPAPHAMGGDNLAAKAKLDLVRQTSTSSDSGGSDLARERNIHGILNAVSWGLLLPMGAIFARYLKTFRSADPAWFYLHVTCQIIGYAVGVAGWATGINLGNASNGVTYGLHRSIGIAAFALATLQVFALFLRPRKDHKCRVYWNAYHHAVGYAVIILGIFNVFKGHDYPWSSHWTDTVETAYXAAVWVLGAVAVTLEAVTWSVVIRRREAEQHGKTFHGAA

SEQ ID NO: 4703 - protein, 177 aa, Triticum aestivum
  misc_feature (12)..(12): Xaa can be any naturally occurring amino acid
  misc_feature (64)..(64): Xaa can be any naturally occurring amino acid
  misc_feature (96)..(96): Xaa can be any naturally occurring amino acid
  misc_feature (162)..(162): Xaa can be any naturally occurring amino acid
MGPPVMASLATXRGRFQGCKSSAALPVSARSNGASLGGVSNGGRIRCMQVWPIEGIKKFETLSXYLPPLSTEALLKQVDYLIRSKWVPCLEFSKVXGFIFREHNTSPGYYDGRYWTMWKLPMFGCTDATQVINEVEEVKKEYPDAYVRIIGFDNMRQVQCVXLIAFTPPPSEESGKA

SEQ ID NO: 4704 - protein, 188 aa, Triticum aestivum
  misc_feature (30)..(30): Xaa can be any naturally occurring amino acid
IVAHAPPRGGLVGTPGGSFQGVKSTAGLPXSRRYKGGSLGSVSNGGRIRCMQVWPIEGIKKFETLFYLPPLSTEALLKQVDYLIRSKWVPCLEFSKVGFIFREHNAFPGYYDGRYWTMWKLPMFGCTDATQVINEVEEVKKEYPDAYVRIIGFDNMPQVQWVSFIAFKPPGCAPPPPGLNRSLTTGHI

SEQ ID NO: 4705 - protein, 170 aa, Triticum aestivum
  misc_feature (69)..(69): Xaa can be any naturally occurring amino acid
  misc_feature (78)..(78): Xaa can be any naturally occurring amino acid
  misc_feature (90)..(90): Xaa can be any naturally occurring amino acid
  misc_feature (101)..(101): Xaa can be any naturally occurring amino acid
  misc_feature (122)..(122): Xaa can be any naturally occurring amino acid
  misc_feature (128)..(128): Xaa can be any naturally occurring amino acid
MAPTVMASSATSVAPFQGLKSTAGLPVSRRSNGASLGSVSNGGRIRCMQVWPIEGIKKFETLSYLPPLXTEALLKQVXYLIRSKWVPCLXEFKQVGFIFRXEHNAPPGYYDGRYWDMWKLPXFGCTDXTQVINEVEESRRIPDAYSASSVRHIASACVAHASTTGSRSEG

SEQ ID NO: 4706 - protein, 173 aa, Triticum aestivum
  misc_feature (72)..(72): Xaa can be any naturally occurring amino acid
MPGMASSKGLLVFALLLAAAAILVASTDEHTEAKKEENGAGVYNFFHFGGGRAGHGGGGGGYGGGGGGDGGXRGGGYPGGGGGYGGGGGYPGHGGEGGGGYGGGGGYPGGGGGYRGGGGYPGHGGKGGGGYSGGGCHWGCCGHGLLHHHGCRCCARADEVPEPMYRAPAEVRN

SEQ ID NO: 4707 - protein, 450 aa, Triticum aestivum
DVGIRVTHASATRPVLASLAAIVGSQSIISATFSIVKQCLSLGCFPRVKVVHTSRWIYGQIYIPEINWILMVLCLAVTVGFRDINIIGNAYGLACITVMFVTTWLMALVIIFVWKKNILLALSFLIFFGLIEGAYLSASFIKVPQGGWTPIALAFVFMFIMYVWHYGTRRKYLFDLQNKVSMKWILTLGPSLGIVRVPGIGLIYTELVTGVPAIFSHFVTNLPAFHQILVFVCVKSVPVPYVPVDERYLIGRIGPRQYRMYRCIVRYGYKDVQKDDENFENHLVMSIAKFIQMEAEEAASSGSYESSNEGRMAVIHTTDATGTGLIMRDSNEGTSLTRSSKSETLQSLQSIYEQESGGLSRRRVRFQIAEEEQINAQVRDELSDLLEAKEAGVAYIIGHSYVKARKNSNFLKSFAIDYAYSFLRKNCRGPSVTLHIPHISLIEVGMIYYV

SEQ ID NO: 4708 - protein, 173 aa, Triticum aestivum
MSSSNGNGGKKPAPSGGRGGIRTLADINRGPSGFPGAGGSGSDSDEPQEYYTGGEKSGMLVQDPTRRNNVDSIFEQARVMGAQQVPLPSFEGQSSSSTSFAGTGRLLSVDAQTAPAAPQPPQDVLHNIHFWNNGFTVDDGPLRGYDDPANADFIESIRSPVPQELSCVSCYYC

SEQ ID NO: 4709 - protein, 160 aa, Triticum aestivum
  misc_feature (78)..(78): Xaa can be any naturally occurring amino acid
MLVYQDKLSGDELLSDSFPYRELENGVLWEVDGHWVVQGAVDVDIGANPSAEGGGDDEGVDDQAVKVVDIVDTFRLQXYISHMKRYIKNLSAKLEGDDLDAFKKNVESATKYLLSKLKDLQFFVGESMHDDGGVVFAYYKEGAADPTFLYFAHGLKEVKC

SEQ ID NO: 4710 - protein, 174 aa, Triticum aestivum
  misc_feature (45)..(45): Xaa can be any naturally occurring amino acid
MARGGPVLVGRGQLSGDGVWSGSSLGGGVGPGGVWEVGGLWVVSXALKSNMGAHPLWGGWCYDEGVDDQPVRLVNIVTTFGVQEPPVFDQNQFISHMKRYIKNLLPKLEGDDLDAFKKNVESATKYLLSKLKDLQFFVGESMHDDGGVVFAYYKEGAADPTFLYFAHGLKDPKC

SEQ ID NO: 4711 - protein, 240 aa, Triticum aestivum
  misc_feature (2)..(2): Xaa can be any naturally occurring amino acid
  misc_feature (16)..(16): Xaa can be any naturally occurring amino acid
  misc_feature (103)..(103): Xaa can be any naturally occurring amino acid
  misc_feature (127)..(127): Xaa can be any naturally occurring amino acid
  misc_feature (143)..(143): Xaa can be any naturally occurring amino acid
PXALIGNSTFADVLVXLARNADTKQLTGFIVRKGAPGLRATKIQTKIGLRMVQNGDILLNKVFVPEEDRLTGINSFQDISKVLAMSRIMVAWQPIGISDGRLXDMCHRYLKERKQFGAPLAAFQLNXQEKLVRMLGNIQAMLXLVGWRLCKLYESGKMTPGHASLGKAWTSSKSREAVSLGRELLGGNGILADFLVAKAFCDLEPIYSYEGTYDINSLVTGREITGIASFKPAAVAKSRL

SEQ ID NO: 4712 - protein, 437 aa, Triticum aestivum
MGSLRGGSGGEGRNEDGGKVGLPALEVALAFPQATPASLFPPAVSDYYQLDDLLTGEEKALRKKVRAISEKEIAPIMTEYWEKAEFPFHAIPKLATLGLAGSTTKGYGCPGLSLTASAVSIAEVARVDASCSTFILVHSSLAMSTIALCGSEAQKQKYLPSLAQFKTVGCWALTEPDYGSDASSLKTSAIKVPGGWQLDGQKRWIGNSTFADVLVILARNADTKQLNGFIVKKGAPGLRATKIQNKIGLRMVQNGDILLNKVFVPEEDRLTGINSFQDISKVLAMSRIMVAWQPIGISMGVYDMCHRYLKERKQFGAPLAAFQLNQEKLVRMLGNIQAMLLVGWRLCKLYESGKMTPGHASLGKAWTSSKSREVVSLGRELLGGNGILADFLVAKAFCDLEPIYSYEGTYDINSLVTGREITGIASFKPAAVAKSRL

SEQ ID NO: 4713 - protein, 335 aa, Triticum aestivum
  misc_feature (268)..(268): Xaa can be any naturally occurring amino acid
NKFVQKSRLVPVRNSRDIVDPRVRAEVARVDASCSTFILVHSSLAMSTIALCGSEAQKQKYLPSLAQFKTVGCWALTEPDYGSDASSLKTSATKVPGGWQLDGQKRWIGNSTFADVLVILARNADTKQLNGFIVKKGAPGLRATKIQNKIGLRMVQNGDILLNKVFVPEEDRLTGINSFQDISKVLAMSRIMVAWQPIGISMGVYDMCHRYLKERKQFGAPLAAFQLNQEKLVRMLGNIQAMLLVGWRLCKLYESGKMTPGHASLGKXSREVVSLGRELLGGNGILADFLVAKAFCDLEPIYSYEGTYDINRLVTGREITGIASFKPAAVAKSRL

SEQ ID NO: 4714 - protein, 168 aa, Triticum aestivum
MLVYQDKLSGNKLLSDSFPYRELENGVLWEVDGHGVVQGAVDVDIGANPSAEGGGDNKGVDNQAVKVVDIVDTFRLQEQPALDKKQFISHMKRYIKNLSAKLEGDDLNAFKKNVDSATKYLLSKLKDLQFFVGKSMHDDGGVLSAYYKEGVADPTFLYLAHGLKEVNC

SEQ ID NO: 4715 - protein, 199 aa, Triticum aestivum
  misc_feature (82)..(82): Xaa can be any naturally occurring amino acid
  misc_feature (93)..(93): Xaa can be any naturally occurring amino acid
  misc_feature (100)..(101): Xaa can be any naturally occurring amino acid
  misc_feature (111)..(111): Xaa can be any naturally occurring amino acid
  misc_feature (121)..(121): Xaa can be any naturally occurring amino acid
YVSKAEQTPDTLDAVIVAKLRAAAGLANLETKKYKLAARKFLETGPELGSNYSEVIAPQDVAVYGALCALASFDRSELKSKXIDNINFRNFPXLMPEVRXXVNDFKQSLWXCLEHLRTKAXLLLDTTPLAPGTRTMISPQIIQYTFRSRGFNTMAMPQEPHAGKWLVTENKAVPKKDRCKDLQEPLGPTDNSGPNIATK

SEQ ID NO: 4716 - protein, 182 aa, Triticum aestivum
YTYIVQSLVPTVMASLATSVAPFQGLKSTAGLPVSRRSNGASLGSVRNGGRIRCMQVWPIEGIKRFETLSYLPPFSTEALLKQVDYLIRSKWVPCLEFSKVGFIFREHNASPGYYNGRYWTLWKLPMFGCTDASQVINEVEEVKKEYPDAYVRIIGFDNMRQVQCVSFIAFKPPGCEESGKA

SEQ ID NO: 4717 - protein, 189 aa, Triticum aestivum
  misc_feature (26)..(26): Xaa can be any naturally occurring amino acid
  misc_feature (53)..(53): Xaa can be any naturally occurring amino acid
WASSAPSVSPFPGVKSTAGLPSSRRXNGASLGSVSNGGRIRCMQVWPIEGIKXFESLSYLPPLSTEALLNQVDYLIRSKWVPCLEFSKVGFIFREHNASPGYYDGRYWTMWKLPMFGCTDSTQVINEVEEVKKEYPDAYVRIIGFDNMRQVQCVSFIAFEPPGCEESPPPPPAHLRQAIYEVPLQVCQV

SEQ ID NO: 4718 - protein, 176 aa, Triticum aestivum
  misc_feature (9)..(9): Xaa can be any naturally occurring amino acid
  misc_feature (79)..(79): Xaa can be any naturally occurring amino acid
  misc_feature (87)..(87): Xaa can be any naturally occurring amino acid
  misc_feature (108)..(108): Xaa can be any naturally occurring amino acid
QPGRPLMAXSATSLAPFQGLKSPAGFPVKRRSKGGSLGRVRNGGRIRCMQVWPIEGIKKFETLFYLPPLSTEALLKQVXYLIRSKWXPCLEFSKVGFIFREHNGSPGXYDGRYWTMWKLPMFGCTDATQVINEVEEVKEEYPDGYVRIIGFDNMPQVQWVSFIAFKPPGCEESGKA

SEQ ID NO: 4719 - protein, 175 aa, Triticum aestivum
MAPTVMASSATSVVPFQGLKSTVGLPVSRRSNGASLGSVSNGGRIRCMHVWPIEGIKKFETLSYLPPISTEALLKQVDYLIRSKWVPCLEYSKVGFIFREHNASPGYYDGRYWTMWKLPMFGCTDATQVINEVEEVNKEYPDAYVRIIGFDNMRQVQCVSFIAFKPPGCEESGKA

SEQ ID NO: 4720 - protein, 195 aa, Triticum aestivum
  misc_feature (69)..(69): Xaa can be any naturally occurring amino acid
  misc_feature (82)..(82): Xaa can be any naturally occurring amino acid
  misc_feature (88)..(88): Xaa can be any naturally occurring amino acid
  misc_feature (107)..(107): Xaa can be any naturally occurring amino acid
  misc_feature (118)..(118): Xaa can be any naturally occurring amino acid
MAPTVMASSATSVAPFQGLKSTAGLPVSRRSNGASLGSVSNGGRIRCMQVWPIEGIKKFETLSYLPPLXSTEALLKQVDYLXIRSKWXVPCLEFSKVGFIFREHNAXPLGYYDGRYWXTMWKAAYVRVATDATQVINEVGKGQERSTLTRYVRIIGFDNMRQGAVPSSFNRLQGNRAAKESRQRTKTSSLTTGHI

SEQ ID NO: 4721 - protein, 74 aa, Triticum aestivum
  misc_feature (48)..(48): Xaa can be any naturally occurring amino acid
MIEVVLNDRLGKKVRVKCNEDDTIGDLKKLVAAQTGTRAEKIRIQKWXYTIYKDHITLGDYEIPRRHGPPVYYN

SEQ ID NO: 4722 - protein, 74 aa, Triticum aestivum
  misc_feature (48)..(48): Xaa can be any naturally occurring amino acid
MIEVVLNDRLGKKVRVKCNEDDTIGDLKKLVAAQTGTRAEKIRIQKWXYTIYKDHITLGDYEDSRRHGLRVYYN

SEQ ID NO: 4723 - protein, 289 aa, Triticum aestivum
  misc_feature (19)..(19): Xaa can be any naturally occurring amino acid
  misc_feature (76)..(76): Xaa can be any naturally occurring amino acid
  misc_feature (84)..(84): Xaa can be any naturally occurring amino acid
RRHLLWGLPKETSLRNLFXRVAHDATRTLSRAELHALFIGINFDEGAFDKNDPVDKILDHFDTSGHDTVEEDEFVXPGMKIWLXEAKQKVEASGAYSNKFVNDYHARTREDHDQLVDRSDEAVESVENPGWCIAKAVGYLILGATICAAFADPLVDAVHNFSNATHIPSFFVSFIGLPLATNSSEAVSAIIFASRKKQRTCSLTFSEVYGGVTMNNTLCLGVFLALIYFRELTWDFSSEVLVILLVCVIMGLFTSFRTSFPLWTCLVAYLLYPLTLAVVYVLDFVFGWS

SEQ ID NO: 4724 - protein, 472 aa, Triticum aestivum
MAGAAAAAAAVASGISIRPVAAPKISRAPRSRSVVRAAVSIGEKAYTVQKSEEIFNAAKELMPGGVNSPVRAFKSVGGQPIVFDSVKGSHMWDVDGNEYIDYVGSWGPAIIGHADDEVNAALIETLKKGTSFGAPCALENVLAQMVISAVPSIEMVRFVNSGTEACMGALRLVRAFTGREKILKFEGCYHGHADSFLVKAGSGVATLGLPDSPGVPKGATVGTLTAPYNDAEAVKKLFEDNKGEIAAVFLEPVVGNAGFIPPQPAFLNALREVTKQDGALLVFDEVMTGFRLAYGGAQEYFGITPDVTTLGKIIGGGLPVGAYGGRKDIMEMVAPAGPMYQAGTLSGNPLAMTAGIHTLKRLMEPGTYEYLDKVTGELVQGILDAGAKTGHEMCGGHIRGMFGFFFAGGPVHNFDDAKKSNTAKFGRFHRGMLEEGVYLAPSQFEAGFTSLAHTTLDIEKTVEAAEKVLRRI

SEQ ID NO: 4725 - protein, 226 aa, Triticum aestivum
TSLYKKAGWYRSGIPGISSTHASGNLEINSQSFNIVDVKPTNMEDLTEVITCAEFHPTHCNTLAYSSSKGSIRLIDLRQSALCDNHSKIFEEHEAPGARSFFTEIIASISDVKFSRDGRYLLSRDYMTLKLWDLNMDSGPVSTFQVHEHLRPRLCDLYENDSIFDKFECCLSGDGLHVATGSYGNLFRVFGSTPGSMEVTTLEASRNPMRRQIANPTRTTRGTLNL

SEQ ID NO: 4726 - protein, 150 aa, Triticum aestivum
  misc_feature (69)..(69): Xaa can be any naturally occurring amino acid
  misc_feature (86)..(86): Xaa can be any naturally occurring amino acid
  misc_feature (88)..(88): Xaa can be any naturally occurring amino acid
  misc_feature (94)..(94): Xaa can be any naturally occurring amino acid
  misc_feature (112)..(112): Xaa can be any naturally occurring amino acid
  misc_feature (118)..(118): Xaa can be any naturally occurring amino acid
  misc_feature (126)..(126): Xaa can be any naturally occurring amino acid
MAPTVMASSATSVAPFQGLKSTAGLPVSRRSNGASLGSVSNGGRIRCMQVWPIEGIKKFETLSYLPPLXSTEALLKQVDYLIRSKXGXPCLEVXQRVGFIFREHNASPGVLXDGRYWXIWELPMFXVPTQGDSGGKRKKRSPGRSSAINP

SEQ ID NO: 4727 - protein, 139 aa, Triticum aestivum
  misc_feature (57)..(57): Xaa can be any naturally occurring amino acid
  misc_feature (70)..(70): Xaa can be any naturally occurring amino acid
  misc_feature (72)..(72): Xaa can be any naturally occurring amino acid
  misc_feature (90)..(90): Xaa can be any naturally occurring amino acid
  misc_feature (92)..(92): Xaa can be any naturally occurring amino acid
  misc_feature (96)..(96): Xaa can be any naturally occurring amino acid
  misc_feature (103)..(103): Xaa can be any naturally occurring amino acid
  misc_feature (107)..(107): Xaa can be any naturally occurring amino acid
  misc_feature (109)..(109): Xaa can be any naturally occurring amino acid
  misc_feature (116)..(116): Xaa can be any naturally occurring amino acid
MAPTVMASSATSVAPFQGLKSTAGLPVSRRSNGASLGSVSNGGRIRCMQVWPIEGIXKFETLSYLPPLSXEXLLKQVDYLIRSKWVPCLXFXKVGXQPSVEQXASPXVXRMARYWXMLGSPNVSGWRNAQHKGSTGDGG

SEQ ID NO: 4728 - protein, 200 aa, Triticum aestivum
GCEKPGAGTADFLIDLEDKRSIKVLGSNTLVGLAIVTFAGVCYSLFAPAFNLATNDQWHTLRDGLPHLVVYTAYFYFCLSSLVVGVALNVWCLYRPMAGVPRSTLRAYAGDREGRGLALLAGLVSGLGNAFTFMAGQAAGYAAADSVQALPLVSTLWGVVLFGEYRRSSRRTYTLLGSMLFMFVVAMTVLMASSAHRKPL

SEQ ID NO: 4729 - protein, 178 aa, Triticum aestivum
  misc_feature (14)..(14): Xaa can be any naturally occurring amino acid
  misc_feature (16)..(16): Xaa can be any naturally occurring amino acid
  misc_feature (29)..(29): Xaa can be any naturally occurring amino acid
  misc_feature (95)..(95): Xaa can be any naturally occurring amino acid
RDGVPHLVVYTAYXYXCLSSLVVGVALNXWCLYRPMAGVPRSTLRAYVGDGEGRGLALLAGLVSGLGNAFTFMAGQAAGYAAADSVQALPLVSTXWGVVLFGEYRRSSRRTYTLLGSMLFMFVVAMAVLMASPASAGSRSDTPLLLLMLMHQCMATGTLRSKDREATIASSSTRTDVV

SEQ ID NO: 4730 - protein, 288 aa, Triticum aestivum
  misc_feature (265)..(265): Xaa can be any naturally occurring amino acid
ESPVPTIPPPPSPHRRRRPRPKPNPSRLPAGRRQAMDRKRINDALDRHLRAATERSSPSTSRGAKPKPPPAAAPKPKEQLDSDSSEGGSAGGSSEADDTFWINWFCAMRGNEFFAEVDDDYIQDDFNLCGLSAQVPYYDHALDLILDLEPVQGDVFADDQNELIVASAEMLYGLIHARYILTTKGLAAMLEKFKNCDFGRCPRVSCSGQPCLPMGQSDIPRSSTVKIYCPKCEDLYYPRSKHQANTDGAYFGTTFPHISMMNHSXMKAQKPAQQYLPRIFGFKVHKKT

SEQ ID NO: 4731 - protein, 175 aa, Triticum aestivum
  misc_feature (132)..(132): Xaa can be any naturally occurring amino acid
  misc_feature (134)..(134): Xaa can be any naturally occurring amino acid
MAPTVMASSGTSVAPFQGLNSTDGLPVSRRSNGASLGTVSNGGRIRCMQVWPIEGIKKFETLSYLRPIRTEALLKQVEYLIRSKWVPCLEFSKVGFIFREHNASPGYYDGRYWTMWKLPMFGCTDATQVINXCXEVKNEYPDAYVRIIGFDNMRQVQCVSFIAFKPPGCKESGKA

SEQ ID NO: 4732 - protein, 546 aa, Triticum aestivum
  misc_feature (61)..(61): Xaa can be any naturally occurring amino acid
MDAPSLPNGDGRDADGGARPRPTNPMVTPLLSDLYQFSMDYPYWKADKHLDRGRPALYFTXRPCVRANFKFQEEIINFLRAALPTCEDGFFEYLSSIDCSDVEVYAIPEGSAVFPKVPLMIIEGPVAVVQLLETPFLSLVNYASLVTTNAARHRLVAGKPKNLLEFGLRRAQGPDGGISASRYSYMGGFDATSNVAAGRLFGIPIRGTHSHAFVSSFLGLDEIIDKALSSSDGSNKCEDFVSLVQNWLVKIQDASSLRGSFGETNQSELAAFTSYALAFPNSFLALVDTYDVMRSGVPNFCAVALALNDMGYKAVGIRLDSGDLAYLSIETRKFFCAIEKEFGVVGFGKTNITASNDLNEETIDALNKQGHEVDSFGIGTYLVTCYAQAALGCVFKLVEINKQPRIKLSEDVTKVSIPCKKRCYRLYGKEGYPLVDIMTGQDEPSPKVGERILCRHPFIESKRAHVVPQHVEELLKCYWPGNSSVQREELPSLNENRSRCMRQLERMRPDHLRKLNPTPYKVSVSAQLYDFIHFLWLNEAPVGELQ

SEQ ID NO: 4733 - protein, 207 aa, Triticum aestivum
  misc_feature (104)..(104): Xaa can be any naturally occurring amino acid
  misc_feature (108)..(108): Xaa can be any naturally occurring amino acid
  misc_feature (137)..(137): Xaa can be any naturally occurring amino acid
  misc_feature (149)..(149): Xaa can be any naturally occurring amino acid
  misc_feature (156)..(156): Xaa can be any naturally occurring amino acid
  misc_feature (160)..(160): Xaa can be any naturally occurring amino acid
  misc_feature (169)..(169): Xaa can be any naturally occurring amino acid
  misc_feature (174)..(174): Xaa can be any naturally occurring amino acid
  misc_feature (188)..(188): Xaa can be any naturally occurring amino acid
MGTKRSVGTLGEKDLSGKKVLLRADLNVPLDDGQRIADDNRIRASVPTIKFLMGKGAKVVLASHLGRPKGVTPKYSLKPLVPRLSELLGVDVVMANDCIGEEVXEKLXAAALPDGGVLLPRKCGDSYKGRKEKNDPXSAQETTSVADLXMLNDPFXTAHXRHMLQTEGXTNYFXPAVPGSLMQEGLDXLLTVSNPTTICGFKCQLIG

SEQ ID NO: 4734 - protein, 403 aa, Triticum aestivum
  misc_feature (156)..(156): Xaa can be any naturally occurring amino acid
  misc_feature (170)..(170): Xaa can be any naturally occurring amino acid
  misc_feature (186)..(186): Xaa can be any naturally occurring amino acid
MPTKRSVGTLGDKDLSGKKVLLRADLNVPLDDGQRIADDNRIRASVPTIKFLMGKDARVVLASHLGRPKGVTPKYSLKPLVPRLSELLGVDVAMANDCIGEEVEKLAAALPDGGVLLLENVRFYKEEEKNDPEFAKKLASVADLYVNDAFGTAHRXAHASTEGVTKYLRXPAVAGFLMQKELDYLXGAVANPKKPFAAIVGGSKVSTKIGVIESLLSKVDILILGGGMIYTFYKAQGHAVGKSLVEEDKLELANSLTEMAKSKGVSLLLPTDIVVADNFAADAESKIVPASAIPDAWMGLDIGPDSIKKFSETLDTTKTVIWNGPMGVFEFEKFAAGTDAIAKKLADITAKGVTTIIGGGDSVAAVEKAGLASKMSHISTGGGASLELLEGKTLPGVLALDDA

SEQ ID NO: 4735 - protein, 334 aa, Triticum aestivum
  misc_feature (19)..(19): Xaa can be any naturally occurring amino acid
  misc_feature (248)..(248): Xaa can be any naturally occurring amino acid
DPRVRAGIIPSLNISAGCXGCFFARLWAAAEARLGLPRRPFTRQENTVIQTCVVAAYGIAFSGGFGSYMFAMSSRIAGQATEANDAMNVKDPSLGWMIGFLFLVCFVGLFALVPLRKVMIIDYGLSYPSGTATATLINGFHTPQGAKEAKEQVKTLGRYSLVSFLWGFFKWFYTAGDDCGFESFPSLGLEAYERKFYFSFSPIYVGVGMICPYIINVSILLGGILSWGLMWALIEKKKGSWYPGHARXVRLHGLQGYKVFISIAMILGDGFLHFVKVRLRMTKASWQQPEEEQLPVFGSVRPGEVLDEITASTEYSSGPIPRAWAGWYFPWHGS

SEQ ID NO: 4736 - protein, 98 aa, Triticum aestivum
  misc_feature (4)..(5): Xaa can be any naturally occurring amino acid
  misc_feature (13)..(13): Xaa can be any naturally occurring amino acid
  misc_feature (23)..(23): Xaa can be any naturally occurring amino acid
  misc_feature (26)..(26): Xaa can be any naturally occurring amino acid
  misc_feature (44)..(44): Xaa can be any naturally occurring amino acid
  misc_feature (50)..(50): Xaa can be any naturally occurring amino acid
  misc_feature (53)..(53): Xaa can be any naturally occurring amino acid
  misc_feature (55)..(56): Xaa can be any naturally occurring amino acid
  misc_feature (60)..(63): Xaa can be any naturally occurring amino acid
  misc_feature (65)..(69): Xaa can be any naturally occurring amino acid
MSAXXLTNVAVLXNPTSFVNPFXFEXSYECLVALEDDLEWKLIXVGSAEXENXDXXLDSXXXXPXXXXXPYRCSGGPDFQRSARRTIGTACIHNFPQV

SEQ ID NO: 4737 - protein, 159 aa, Triticum aestivum
  misc_feature (54)..(54): Xaa can be any naturally occurring amino acid
  misc_feature (73)..(73): Xaa can be any naturally occurring amino acid
  misc_feature (83)..(83): Xaa can be any naturally occurring amino acid
  misc_feature (96)..(96): Xaa can be any naturally occurring amino acid
  misc_feature (109)..(109): Xaa can be any naturally occurring amino acid
  misc_feature (136)..(136): Xaa can be any naturally occurring amino acid
MAPTVMASSATSVAPFQGLKSTAGLPVSRRSNGASLGSVSNGGRIRCMQCWPIXEGIKNSETLSYLPPLSTEXLLKQVDYLIXRSKWVPCLQFSKXGSSSREHNASPGXYYDGRYWAMWNCLFPEHRPTQVINEVXGVQEGYLTLCRINRHNSACVNTP

SEQ ID NO: 4738 - protein, 169 aa, Triticum aestivum
  misc_feature (22)..(22): Xaa can be any naturally occurring amino acid
MLVYQDKLSGDELLSDSFPYRXELENGVLWEVDGHWVVQGAVDVDIGANPSAEGGGDDEGVDDQAVKVVDIVDTFRLQEQPAFDKKQFISHMKRYIKNLSAKLEGDDLDAFKKNVESATKYLLSKLKDLQFFVGESMHDDGGVVFAYYKEGAADPTFLYFAHGLKEVKC

SEQ ID NO: 4739 - protein, 401 aa, Triticum aestivum
  misc_feature (45)..(45): Xaa can be any naturally occurring amino acid
  misc_feature (49)..(49): Xaa can be any naturally occurring amino acid
  misc_feature (204)..(204): Xaa can be any naturally occurring amino acid
  misc_feature (212)..(212): Xaa can be any naturally occurring amino acid
PPTGQRLRLILGSLRRRHVRCPELLRHPPSTDAISTPVVNPSAHXTQSXRQLTDFREGRHASFEYGRYGNPPTEASGKMMSGLEKAESTVFVASGMYASVAMLSTLVPAGGHIVTTTDLYRKTRIYMETELPKRGITMTVIRPADMDALQDALDNNNVSLFCTTSQTNPFLRCIDIAFESNMCKNKGAFLRLDGPFPAPIAMHXSTFASPIXAHSASLWCARRCAVCGGGFCGRDELVSRLRLRHRGASRQGPHLSPCSCLRGMKTLLLRVQCQNSTALRMAQFLEEHPKIARVYYPGLPSHPEHHIAKSQMTGFGGVVSFEVDGDFDSTRKFIDSVKIPYHAPSFGGCESIIDQPAIMSYWDSKEQRDIYGIKDNLIRFSIGVEDFEDLKNDIVQALNKI

SEQ ID NO: 4740 - protein, 346 aa, Triticum aestivum
  misc_feature (231)..(231): Xaa can be any naturally occurring amino acid
MAVERDIFGISGPTYLNPVNWNCENNRRSVAACLVQAVYVLERDRQLNRKSVDAAAPPWWEFFHFEMIRKLVDDVDLSIFGAIFEFNPPSSKEASAQDAPRFIIAFRGTITEKETISRDLSLDLQLVQNGLHKTSRFAIAMQAVQNVASAFPGSPIWLAGHSLGAGTAILTGRNMVKKGALLDSFLFNPPFVAAPIEGIRDERVKHGFRIARSVITAGLTIALKAKTRGEXQRSVAEESFNILSSWTPYLFVNPGDHVCSEYIGYFQHRRNMEDLGAGFIEKLATQNSIGDLFYKALGWESEPLHLLPSADLIVNVSPSPDFKYAHGISQWWQPDLNLQCNKYRYS

SEQ ID NO: 4741 - protein, 153 aa, Triticum aestivum
  misc_feature (120)..(120): Xaa can be any naturally occurring amino acid
  misc_feature (133)..(133): Xaa can be any naturally occurring amino acid
  misc_feature (138)..(138): Xaa can be any naturally occurring amino acid
  misc_feature (148)..(148): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWELPXMFGCTDATKVINXWRSQXEYLTRIRIIXFENPQ

SEQ ID NO: 4742 - protein, 169 aa, Triticum aestivum
  misc_feature (9)..(9): Xaa can be any naturally occurring amino acid
  misc_feature (32)..(32): Xaa can be any naturally occurring amino acid
  misc_feature (124)..(124): Xaa can be any naturally occurring amino acid
MLLYQEKVXGRKLLWDWFPYRELENGVLWEVXDGHWVVQGAVDVDIGANPSAEGGGDDEGVDDQAVKVVDIVDTFRFQEQPAFDKKQFIFHMKRYIKNLFAKLEGDALNVFKKNVEFPPKFFLXKLKALQFFVGESMHYYGGVVFAYSKEGAADPTFLYFAHGLKKVKC

SEQ ID NO: 4743 - protein, 356 aa, Triticum aestivum
  misc_feature (211)..(211): Xaa can be any naturally occurring amino acid
MEKGTPAIGWAARDDSGLLSPYSFSRRVPKDDDVTIKVLFCGICHTDLHIAKNEWGNALYPIVPGHEIVGIVTDVGPGVKSFKAGDTVGVGYFLDSCRSCDTCSKGYENYCPTLVLTSNGVDYDGATTQGGFSDVLVVNQDYVLRVPESLSLAGAAPLLCAGVTVYSPMMQYGLNAPGKHLGVVGLGGLGHMAVKFGKAFGMTVTVISSSXRKREEALERLGADAFLVSRDAEQMKAAAGTMDGIIDTVSAGHPLVPLLELLKPMGQMVVVGAPSEPLALPAYAIIGGGKRVAGNGVGSVSSCQAMLDFAGKHGITADVEVVKMDYVNTAVERLEKNDVRYRFVIDVAGSQLDAAA

SEQ ID NO: 4744 - protein, 287 aa, Triticum aestivum
  misc_feature (180)..(180): Xaa can be any naturally occurring amino acid
  misc_feature (196)..(196): Xaa can be any naturally occurring amino acid
  misc_feature (259)..(260): Xaa can be any naturally occurring amino acid
  misc_feature (263)..(263): Xaa can be any naturally occurring amino acid
MAKDIEAAPQGGEFSTKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIXGTFVLVYTVFSATDPXRNARDSHIPVLAPLPIGFAVFMVHLATIPITGTGINPARSLGAAVIYNKDKAWDDQWIFWVGXXIGXRIAAGYHQYVLEASAAQLGVYRNK

SEQ ID NO: 4745 - protein, 338 aa, Triticum aestivum
  misc_feature (211)..(211): Xaa can be any naturally occurring amino acid
  misc_feature (262)..(262): Xaa can be any naturally occurring amino acid
MAKDIEAAPPGGEYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGFSKGTGLAAEIIGTFVLVYTVFSATDPKRSARDSHVPVLAPLXPIGFAVFMVHLATIPITGTGINPARSLGAAVIYNNEKAWDDHWIFWVGAIXSGAAIAALYHQYVLRAAPPIRSSAPSAALIRRRRSPMAALNWIYQEDKAPVCAAVVLDSAGLARFSLSSPRRVCFF

SEQ ID NO: 4746 - protein, 193 aa, Triticum aestivum
TRALSGFPGVVGSVYTDHIPIGPPKDNVAEYYNRRLTERNNKASYSVAVQAVVDADGAFTDASYPLTDWMLVPYAHQNLTWAQHAFNERIAAARAAAQGAFQRLKGRWRCLQRRTEPKLPDLHNMIGACCVLHNFCERSGEELDADFQSELSQQDDADVVAAANPVLSAAADKERDRIAHDLLHGGHPSVTFL

SEQ ID NO: 4747 - protein, 241 aa, Triticum aestivum
  misc_feature (35)..(35): Xaa can be any naturally occurring amino acid
  misc_feature (42)..(42): Xaa can be any naturally occurring amino acid
  misc_feature (54)..(54): Xaa can be any naturally occurring amino acid
PPFPCPKAFPLPLGIPPPARFQALSGIPGVIGSLXTDHIPIXPPKDDVAEYYNXRLQERNNKASYSVAVQAVVDADGPFTDVCIGLPGSLHSRCETGMLGDDQCRLVGGASYPLTDWMLVPYAHQNLTWAQHAFNERIAAARAAAQGAFQRLKGRWRCLQRRTEPKLPDLHNMIGACCVLHNFCERSGEEFDADIQSELSQQDDADVVAAANPVLSAAADKERDRIAHDLLHGGHPSVTFL

SEQ ID NO: 4748 - protein, 270 aa, Triticum aestivum
  misc_feature (42)..(42): Xaa can be any naturally occurring amino acid
  misc_feature (71)..(71): Xaa can be any naturally occurring amino acid
VLGFSPCHKMVFQVGPPLPRADPRGPVRWPLESPAARVQSPXGFPGVVGSVYTDHIPIGPPKDNVAECYNXRRLTERNNKASYSVAVQAVVDADGAFTDVCIGLPGSLSDAAVLERSALHARCETGMLGDDQCRLVGGASYPLTDWMLVPYAHQNLTWAQHAFNERIAAARAAAQGAFQRLKGRWRCLQRRTEPKLPDLHNMIGACCVLHNFCERSGEELDADIQSELSQQDDADVVAAANPVLSAAADKERDRIAHDLLHGGHPSVTFL

SEQ ID NO: 4749 - protein, 291 aa, Triticum aestivum
MEVGFLGLGIMGKAMAANLLRHGFRVTVWNRTLSKCDELVAMGAAVGDTPASVVAKCKYTIAMLSDPSAALSVVFDKDGVLEQIGEGKGYVDMSTVDAATSCKISEAVKQKGGAFVEAPVSGSKKPAEDGQLVILAAGDKALYDDMVPAFDVLGKKSFFLGEMGNGAKMKLVVNMIMGSMMNAFSEGLCLADKSGLSPQTLLDVLDLGAIANPMFKMKGPSMLQGSYNPAFPLKHQQKDMRLALSLGDENAVSMPVAAASNEAFKKARSLGLGDLDFSAVHEVLKGTGGSG

SEQ ID NO: 4750 - protein, 102 aa, Triticum aestivum
WLKIKDWTNVVVAYEPVWAIGTGKVATPAQAQEVHANLRDWLKTNVSPEVAASTRIIYGGSVTGASCKELAGQPDVDGFLVGGASLKPEFIDIINAATVKSA

SEQ ID NO: 4751 - protein, 447 aa, Triticum aestivum
  misc_feature (162)..(162): Xaa can be any naturally occurring amino acid
MAATIQSVKARQIFDSRGNPTVEVDVCCSDGTFARAAVPSGASTGVYEALELRDGGSDYLGKGVSKAVDNVNSIIAPALIGKDPTAQTELDNYMVQQLDGTKNEWGWCKQKLGANAILAVSLAVCKAGASVKKIPLYQHIANLAGNKQLVLPVPAFNVINGXGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 4752 - protein, 291 aa, Triticum aestivum
MEVGFLGLGIMGKAMAANLLRHGFRVTVWNRTLSKCDELVAMGAAVGDTPASVVAKCKYTIAMLSDPSAALSVVFDKDGVLEQIGEGKGYVDMSTVDAATSCKISEAVKQKGGAFVEAPVSGSKKPAEDGQLVILAAGDKALYDDMVPAFDVLGKKSFFLGEMGNGAKMKLVVNMIMGSMMNAFSEGLCLADKSGLSPQTLLDVLDLGAIANPMFKMKGPSMLQGSYNPAFPLKHQQKDMRLALSLGDENAVSMPVAAAANEAFKKARSLGLGDLDFSAVHEVLKGTGGSG

SEQ ID NO: 4753 - protein, 184 aa, Triticum aestivum
QVCTKKQAGTAPEFPGYRRPTRPSGSAAALRSLLSRKLRRSTLLLWFVFYANSFAYYGLVLLTAQLSNANKSCASGLKYVKSETDASLDIRPVATSLAEIPGLIASALLVEWFGRKATMWCLLFTCCGFLGPLVFYQSELWTTGLLFGARACAMGSYTVVCLYAPEVRIFFSWHAVNVFLRVTA

SEQ ID NO: 4754 - protein, 430 aa, Triticum aestivum
  misc_feature (142)..(142): Xaa can be any naturally occurring amino acid
MALLKAARVADVPTLDVVVPDHLTAAARVLGTRRCSFRPRVSTFRLVINRPVITRARATADAESVATMKRQQRGAGRRFAVIGHRGKGMNALASPDRRLQEVKENSVRSFNEAARFAVDYVEFDVQSVCKDVEKRTMNINLXVTKDVCPIIFHDNFIITEEHGKISEKRVTDLQLEDFLQYGPQNKQGKNGKPLLRKMKDGRVLNWSVQSDDPLCTLQEAFEKVNPRLGFNVELKFDDNLVYQDEELTHILQAILKVVFECAKDRPIIFSSFQLDAAQLMRKLQSTYPVYFLTNGGTEVYADVRRNSLEEAVKLCLASGMQGIVSEARAVFRFPTAIPKIKEADLSLLTYGTLNNVPEAVYMQHLMGVNGVIVDLVPEITGAVSDFIAVPETDVEINDLSGQVAKDAASTPNFTQREISFLLRLMPELVQ

SEQ ID NO: 4755 - protein, 172 aa, Triticum aestivum
MIVYQDRLSGNELLSDSFLYRELENGVLWEVDGQWVVQGAVDVDIGANPCNEGGDHEGGDQEAVDEEAVKVIDIVDTFRLQELPAFERKEFCTYMKRYIKNLSAKLEDEEQECFKNNIESATKFLLSKLADFQFFVGESMHDDGSLVFAYYKDGAADPTFLYFAHGLKKINC

SEQ ID NO: 4756 - protein, 137 aa, Triticum aestivum
  misc_feature (26)..(26): Xaa can be any naturally occurring amino acid
  misc_feature (28)..(28): Xaa can be any naturally occurring amino acid
NGEFWEVDGQWVVQSAVDVDPGANPXNXGGDHEGGDQASVEEEAVKELPAFERREFCTYMKRYIKNLSAKLEDEEQECFKNNIESATKFLLSKLADFQFFVGESMHDDGSLVFAYYKDGAADPTFLYFAHGLKKINC

SEQ ID NO: 4757 - protein, 279 aa, Triticum aestivum
  misc_feature (167)..(167): Xaa can be any naturally occurring amino acid
MEATAPSVGAGANGSLAAAARAQVGPPTNPMATALLTDQYQFSMAYAYWKAGKHADHAVFDLYFRKNPFGGEFTVFAGLEECIKFIANFKFTEDEISFLQSVMPMCEDAFFDYLRGIDCSDVEVYSTPEGSVVFPKVPLMRVEGPVAVVQLLETPFVNLINYASLVXTTNAARHRHVAGKSKVLMEFGLRRAQGPDGAISASKYCFMGGFDATSNVLAGHLFGIPLRGTHSHAYVSSYMSLDEIPDRTLRNKDGSKICMDFVSLVKDWLCKIQAARSIT

SEQ ID NO: 4758 - protein, 258 aa, Triticum aestivum
  misc_feature (51)..(51): Xaa can be any naturally occurring amino acid
  misc_feature (57)..(57): Xaa can be any naturally occurring amino acid
  misc_feature (73)..(73): Xaa can be any naturally occurring amino acid
  misc_feature (100)..(100): Xaa can be any naturally occurring amino acid
  misc_feature (107)..(107): Xaa can be any naturally occurring amino acid
  misc_feature (130)..(130): Xaa can be any naturally occurring amino acid
  misc_feature (143)..(143): Xaa can be any naturally occurring amino acid
  misc_feature (221)..(221): Xaa can be any naturally occurring amino acid
MGRKFFVGGNWKCNGTVEQVESIVNTLNAGQIASTDVVEVVVSPPYVFLPXSRAKLXPKRFKVAAQNCWVKKXGAFNGEVSAEMLVKPPAFPGSILGHSXKRAGAFXWGETNEFVGEEVEYALAQGFEAXAFCGKTPDQREGXSTMPVVAEQTKAIADKIKDWPKVVVAYEPVWAIGTGKVASPAQAQEVHANLRDWLKTNVSPEVAESTRIIYGGSVTGXSCKELAAQPDVDGFLVGGASLKPEFIDIINAATVKSA

SEQ ID NO: 4759 - protein, 289 aa, Triticum aestivum
  misc_feature (193)..(193): Xaa can be any naturally occurring amino acid
  misc_feature (212)..(212): Xaa can be any naturally occurring amino acid
  misc_feature (234)..(234): Xaa can be any naturally occurring amino acid
  misc_feature (280)..(280): Xaa can be any naturally occurring amino acid
MAKDIEAAPQGGEFSTKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATXPKRNARDSHIPVLAPLPIXGFAVFMVHLATIPITGTRHQPXARSLGAAVIYNKDKAWDDQWIFWVGPLIGAAIAAAYHQYVLKASAXAKLGSYRSN

SEQ ID NO: 4760 - protein, 313 aa, Triticum aestivum
  misc_feature (148)..(148): Xaa can be any naturally occurring amino acid
FRGEICGGTACPPCWWARRNLNVAGRGFEHWVRGRTQSGAFDPVFALFPTAGWGRANPSPTGFEIPAGDFPHGRPGALGPGPCCGGLPVASGRGPIPGGERVFGRGPPASGTPPRMLQSGTPTLVNPCTCFHVTGDRDNRVTRVDLGXWNLSGHLVPELGKLEHLQYLELYKNNIEGTIPSELGDLKNLISLDLYKNNVSGTIPPTLGKLKSLVFLRLNGNRLTGPIPRELAGISSLKVVDVSGNNLCGTIPTTGPFEHIPLSNFERNPRLEGPELQGLAVYAPPSSTATGRWKMLGSNGRTRFTGDRGDIDG

SEQ ID NO: 4761 - protein, 512 aa, Triticum aestivum
MDVASLLPFAIALVAIPISLALLDRLRLGRLPPGPRPWPVVGNLRQIKPVRCRCFQEWAARYGPIISVWFGSSLTVVVSTSELAKEVLKEHDQQLADRPRNRSTQRFSRNGQDLIWADYGPHYIKVRKLCNLELFTQKRLEALRPIREDEVTAMVESVHRAAAGPGNEGKPLVVRNHLAMVSFNNITRLAFGKRFMNADGDIDEEGQEFKLIVNNGIKIGASLSVAEYIWYLRWLCPLNEELYNTHNERRDRLTKKIIEEHAQALRESGAKQHFVDALFTLREKYDLSDDTVFGLLWDMITAGMDTTVISVEWAMAELVRNPRVQKKLQEELDSVVGRDRVMSETDFQNLPYLMAVVKESLRLHPPTPLMLPHKASASVKVGGYSIPKGANVMVNVWAVARDPKVWSSPLEFRPERFLEESIDIKGSDFRVLPFGAGRRVCPGAQLGINLVASMIGHMLHHFEWSLPEGARPEDISMMESPGLVTFMGTLLQAVATPRLENEELYKRVPVEI

SEQ ID NO: 4762 - protein, 361 aa, Triticum aestivum
  misc_feature (294)..(295): Xaa can be any naturally occurring amino acid
  misc_feature (332)..(332): Xaa can be any naturally occurring amino acid
RARARHHHAPPGLCTLPTFSYNAHRGLVLGLTFLAYAFYHASRKPPSIVKRALSKSWPPFHDPALLGETDVAFLAFYSLGMFGAGHLGDRLDLRLFLAAGMVGSGAAVAFFGAGYFLSLHSLVFYVFAQAIAGLLQSTGWPSVVAIVGNWFGGRRRGLIMGIWNAHTSVGNMSGSIIAAAVLRYGWGWSFVVPGGLMALGGVLVFFFLAPYPEDVGFASWPPKQASGASTDEEDSSTSTGGGAGEEDRRDAVGILKAFSIPGVLTFANCLFFAKLVAYTFLYWLPFYLTQTAMXXQYMSVTGAGYLSVLFDVGGIIVGNPRWFMSDQLESRXTTGAMLMYLAIHSFKPSWFWRTSKVTILA

SEQ ID NO: 4763 - protein, 355 aa, Triticum aestivum
SPTYPSSPSESPPIPSRRRRKEHGEMSSGMGKVVCVTGGSGYIASWLVKLLLHRGYTVRATVRDTADPKKTLHLQALDGAKDRLHLFKASLLEEGSFDAAIAGSDCVFHTASPFYHNVKDPKAELLDPAVNGTLNVLRSCKKASIKRVIITSSMAAVAYNGKPRTPDVVVDETWFSSAEVCEKNEQWYVLSKTLAEEAAWKFANDNGFEIVTINPAMVIGPLLQPTLNTSAEAILKFINGSSSTYPNFSFGWVNVKDVALAHILAYEVPSANGRYCMVERVAHHSEIVKIIHEMYPNFPVPDKCADDAPFVPIYQVSKDKIRSLGMELIPLETSLKETIESLREKGFVTSESSHL

SEQ ID NO: 4764 - protein, 153 aa, Triticum aestivum
MDASAAGAVPKAKKYVVGRKLGGGPRKQAVARSVKAGLQFPVGRIGRFLKKGRYAQRVGMGAPVYLASVLEYLAAELLELAGNAAKDNKKARIIPRHLVLAIRNDQELGRLLAGVTIAHGGVLPNINPVLLPKKTAEKAPKSPKKAAKSPKKA

SEQ ID NO: 4765 - protein, 155 aa, Triticum aestivum
  misc_feature (4)..(4): Xaa can be any naturally occurring amino acid
PPWXASGTGAVPKAKKYVVGRKLGGGPRKKAVARSVKAGLQFHVGRIGRFLKKGRYAQRVGMGAPVYLASVLEYLATELLELAGNAAKDNKKARIIPRHLLLAIRNDQELGKLLACITIAHGGVLPNINPLLLPKKTAEKEPKSPKKAAKSPKKA

SEQ ID NO: 4766 - protein, 181 aa, Triticum aestivum
  misc_feature (111)..(111): Xaa can be any naturally occurring amino acid
  misc_feature (136)..(136): Xaa can be any naturally occurring amino acid
KNALPPSQISHRAKSLRTSSYQISPPWTPRPPAPSPRRRSTWWGCKLGGGLRKKAVARSVKAGLQFPVGRIGRFLKKGRYAQRVGMGAPVYLASVLEYLAAELLELAGNAXAKDNKKSRIIPRHLLLAIRNDQELXGKLLAGVTIAHGGVLPNINPLLLPKKTAEKEPKSPKKAPKSPKKA

SEQ ID NO: 4767 - protein, 152 aa, Triticum aestivum
MASKGLLVFALLLAAAILVASTEQTQAKKEEKKAGVEGYGGCGGYPGGGGGGYPGHGGGGGGGYRGHGGGGGGGYPGHGGGGGGGYPGHGGGGGGGYPGHGGGGGGGYPGHGGGGGGSGCRWGCCDHGYHGCRWCARADEVPEPMYRAEVRN

SEQ ID NO: 4768 - protein, 303 aa, Triticum aestivum
MRPPARGGRGGRGFGGRSDGGGRGGRGFGGRSDGGGRGGRGGRTPRGRGRGGGGRGGPGMKGGSKVVVVPHKHDGVFIAKAKEDALCTKNMVAGESVYGEKRVSVQNEDGTKVEYRVWNPFRSKLAAAVLGGVDNIWIAPGARVLYLGAASGTTVSHVSDIVGPTGLVYAVEFSHRSGRDLVNMAKKRTNVIPIIEDARHPAKYRMLVGMVDVIFSDVAQPDQARILALNASYFLKNGGHFVISIKANCIDSTQAPEAVFAAEVEKLKLEQFKPSEQVTLEPFERDHACVVGGYRMPKKPKAT

SEQ ID NO: 4769 - protein, 403 aa, Triticum aestivum
IRHEEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGATSFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 4770 - protein, 477 aa, Triticum aestivum
MQRLASSRRLLRAALAPGRAHSSLSAAAVAAAPENGAGAPKMPPFAYTPPPYDGPRVAEIAQKRAQFLSPSLFHFYDRPLNIVDGKMQYLFDEDGRRYLDAFGGIATVCCGHCHPDVIEAIVNQAKKIQHSTVLYLNHAIADFAEALASKMPGDLKVVFFTNSGTEANELALMIARLYTGSHDIISLRNGYHGNAAATMGATAQSNWKFNVVQTGVHHALNPDPYRGAFGSDGEKYARDIQETIDYGTTGRVAGFISEAIQGVGGIVELAPGYLPAAYDMVRKAGGLCIADEVQAGVARTGSHFWGFEGQGVIPDIVTMAKGIGNGIPIGAVVTTPEIAKVLTRRSYFNTFGGNPVSTAAGHAVLKVLEKEKLQENAFVVGSYLKEKLNALKEKHDIIGDVRGKGLLLGVELVTDRQKKTPAKAEIAQVMNHMKDMGVLVGKGGFFGNVFRVTPPLCFSKEDSDYMIEVMDIALSKL

SEQ ID NO: 4771 - protein, 528 aa, Triticum aestivum
  misc_feature (215)..(215): Xaa can be any naturally occurring amino acid
  misc_feature (381)..(381): Xaa can be any naturally occurring amino acid
  misc_feature (443)..(443): Xaa can be any naturally occurring amino acid
  misc_feature (472)..(472): Xaa can be any naturally occurring amino acid
  misc_feature (479)..(479): Xaa can be any naturally occurring amino acid
  misc_feature (522)..(522): Xaa can be any naturally occurring amino acid
MSAIKPPPPDRPPQAARLPSPSSSSSAAAAAKQGATGSRGLLMGRYELGRVLGKGTFAKVYHARHVQTGESVAIKVLDREKAVRSGLVSHIKREIAVLRRVRHPNIVHLFEVMATKTKIYFVMELLVRGGELFSRVSKGRLKEDIARRYFQHLISAVGFCHTRGVFHRDLKPENLLVDEAGNLKVSDFGLSAVAEPFQPEGLLHTFCGTPAYVAXPEVLARRGYEGAKADIWSCGVILFVLMAGYLPFHDQNLMAMYRKVYKGEFRCPRWFSKDLTSLIMRFLDTNPSTRITLPEVMESRWFKKGFRPVKFYIEDDQLYNVIDAENDMLDLGLPDPLPQPLPPPPPSPSPQQVDGDDSGSESDASVVSCPATSSFEERHRXPGPLPRPASLNAFDIISFSRGFNLSGLFEEKGDEVRFISGEPMPDIITKLEEIANGKSFAVXRKKDWRVSLEGTREGGKGPLTICAEIFEXRPSLVVXEVKKKAGDKEEYDDFCNKELKPGMQHLVHQMAPVPITPTISEXAERPSR

SEQ ID NO: 4772 - protein, 253 aa, Triticum aestivum
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAGKIKDWTNVVVAYEPVWAIGTGKVATPAQAQEVHANLRDWLKTNVSPEVAESTRIIYGGSVTGASCKELAGQPDVDGFLVGGASLKPEFIDIINAATVKSA

SEQ ID NO: 4773 - protein, 446 aa, Triticum aestivum
MAATIQSVKARQIFDSRGNPTVEVDVCCSDGTFARAAVPSGASTGVYEALELRDGGSDYLGKGVSKAVDNVNSIIAPALIGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGATSFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 4774 - protein, 204 aa, Triticum aestivum
MHPTRWELSHMVDLQAAALVISVVAAEVASLADPEPKMSGVKKVTDVAAKAGKAIDWDGLAKMLVSDEARKEFANLRRTFEDVNHQLQTKFSQEPKPIDWEYYKKGIGSKVVDMYKEAYDSIEIPKYVDTVTPEYKPKFDALLIEMKEAEKTSLKESERIEKEIAELKELKKKISTMTADEYFAKHPELKKKFDDEIRNDYWGY

SEQ ID NO: 4775 - protein, 167 aa, Triticum aestivum
  misc_feature (135)..(135): Xaa can be any naturally occurring amino acid
  misc_feature (148)..(148): Xaa can be any naturally occurring amino acid
LVPNSARAPFHSIPLNQSADCSVYLTEPSHSWRARSTPPPRPEIPQPPPTPSPPLPGRKTDPATDNKPWCPTGSCRKPQAGEYGLAVMRRRPKTKIVCTLGPASRSVDMIEKLLRAGMCVARFNFSHGSHDYHQXETLDNLHAAMGAXGILCAVMLDTKGPEIRTGF

SEQ ID NO: 4776 - protein, 120 aa, Triticum aestivum
TTFKPMSVDIQFHDVKGKNYRCAIPKLNKEIVPEKCKIVVKPTKIVITLWKASTGNWLDLHYKEDKFKPSMDKEKDPMSGIMDLMKGMYEEGDEDMKRTIAKAWSDARSGKTADPMKGLP

SEQ ID NO: 4777 - protein, 66 aa, Triticum aestivum
GNWLDLHYKEDKFKPSMDKEKDPMSGIMDLMKGMYEEGDEDMKRTIAKAWSDARSGKTADPMKGLP

SEQ ID NO: 4778 - protein, 229 aa, Triticum aestivum
  misc_feature (47)..(47): Xaa can be any naturally occurring amino acid
MSADELRLDLEELRRLEGLAKRPRVVSLLSNEIRSVDAKLASRAAPXQTQAPRAVAVAAAAPAGLSYVTLGSFSWDQDNEKIRVYVFLENVDQEKVETTFKPMSVDIKFHDVKGKNYRCAIPKLNKEIVPEKCKIVVKPTKIVITLWKASSGNWLDLHYKEDKFKPSMDKEKDPMSGIMDLMKGMYEEGDEDMKRTIAKAWSDPRSGKTGDPMRGTALSWVVVLGPKTC

SEQ ID NO: 4779 - protein, 489 aa, Triticum aestivum
  misc_feature (434)..(434): Xaa can be any naturally occurring amino acid
SAPGTACADTLEFVDVSANLLIGARPACMRSNSSARTVLDAGNCFRDAKLQRPSTYCSPGALAALLPPPQGSGAEQGGGKGGGVGMVLGIVGGVVAGALLIALVMVVVLRRARRQHPGVMALPKSPLIRAAKKGDSAKATAKMSQKIATPADKRHASQAAMVNTLEVPAYRVYTTEELQEATDNFASSNLIKKSALAQHYNGQLQDGTRVLVKCLRLKPKYSPQSLSHYMEIISKFRHRHLVSIIGHCIVNDQENPTIASSVYLISECVTNGSLRSHLTEWRKREMLKWPQRVTAAIGIARGIQFLHNLTAPDIVQNDLNIENILLDKTLTSKISGFSLPMMSTSKNGKLFSENPFAVQEENDHGSAQPAEHGDRDDIYQFGQILLEVITGKPTASRSELEPLRAQLSGALAEDPDMLKDMADPTIRGTFAVEXSLSKVTEVALNCTAGDPSDRPSVDDVLWNLQYSMQVQDGWASSESLSLSVKSQAW

SEQ ID NO: 4780 - protein, 485 aa, Triticum aestivum
MDALAGLSALAAVALLLLYSVHRWRSPRCNGRLPPGSMGLPLVGETFQFFSPDASLDIPRFIRHRLTRYGPIFKTSVVGHPMVVSADQELNHMVFQQEGELFQSWYPDSFVEILGRDNVGEQKGTMFKYLKNIVLRYFGPESLKESILGDVERAVCSSLCTWSTLPAVELKEAVSTMVFELSASKLLGLEPSRSKVLRKSFFDFVRGLISFPLYLPGTAYYACMQGRMSVMEVLQQVLEERTRSAEAAGGREARCHGDFLDYVVQEITKEKPVLTEGMALDLLFVLLFASFHTTSLAITLAVKLLTEHPRVLEELTVEHETILNEREAGGESDGDRVTWKEYKSMTFTSQVINETVRLANIAPGIFRKTLKDVQFRGYTIPAGWGVMVCPLAVHLNPDIYPDPLTFNPSRFKDKLEANRGLRHFMAFGGGLRSCVGADFSKLQMAIFLHFLVTKYRWIQLGGGKIVRCPGLEFPDGYLIQIRQRD

SEQ ID NO: 4781 - protein, 477 aa, Triticum aestivum
  misc_feature (47)..(47): Xaa can be any naturally occurring amino acid
  misc_feature (104)..(104): Xaa can be any naturally occurring amino acid
  misc_feature (135)..(135): Xaa can be any naturally occurring amino acid
  misc_feature (179)..(179): Xaa can be any naturally occurring amino acid
MAPSLRTTVLLLLPLFLLAASQAGHKRRRTGIRVLSAEKRIDLTGAXIVKVFLTLKVQNAATGADASHVLIAFTPAEADHLAIVKATRAEGKRKKKTYIPLPVXPADAATAAPNGARLYSISLPSTPLKPAETTXEVFYVLTHSLEPFPAEITQSESQLVYYRDSAAVILSPYHVQEQXTYVKTPSSRVESFTRADPTSRSGPDVKYGAYSNQLPYAYSPIILHYENNHAFAVVEELVRKVEISHWGNVQVTEHYKLKHGGAKHKGVFSRLEYQARQSISGASSFKNLLARLPPRVHSVYYRDEIGNISSSHLRSDSYKSELEIEPRYPLFGGWHCTFTIGYGMPLQDFLFESADGRRFANLTFGCPLLNTVVDNLTIKVVLPEGSKSPQAVVPFETEQHLETSYSYLDVVGRTTVVIKKKNVVGEHNVPFQVYYEFSPIFMLAEPLMLVTAVLLLFAACIVYLHTDLSIAKSQASS

SEQ ID NO: 4782 - protein, 377 aa, Triticum aestivum
MDTSGGGGGAAGGAAQIQGMATHGGRYVLYNVYGNLFEVASKYAPPIRPIGRGAYGIVCAAVSSDTGEEVAIKKIGNAFDNHIDAKRTLREIKLLRHMDHENILAIKDLIRPPRRDDFKDVYIVTELMDTDLHQIIRSNQSLTDDHCQYFLYQLLRGLKYVHSANVLHRDLKPSNLFLNANCDLKIADFGLARTTSETDLMTEYVVTRWYRAPELLLNCSQYTAAIDVWSVGCILGEIITRQPLFPGRDYIQQLKLITELIGSPDDSSLGFLRSDNARRYMKQLPQYPRQDFRLRFRNMSDGAVDLLERMLVFDPSRRITVDEALHHPYLASLHDINEEPTCPAPFSFDFEQPSFTEEHMKELIWRETLAFNPDPPY

SEQ ID NO: 4783 - protein, 166 aa, Triticum aestivum
  misc_feature (28)..(28): Xaa can be any naturally occurring amino acid
  misc_feature (98)..(98): Xaa can be any naturally occurring amino acid
ATSVAPFQGLKSTAALPVSRRSNGASLXSVSNGGRIRCMQVWPIEGIKKFETLSYLPPLSTEPLLKQVDYLIRSKWVPCLEFSKVGFIFREHNASPGXYDGRYWTMWKLPMFGCTDATQVINEVEEVKKEYPDAYVRIIGFDNMRQVQCVSFIAFKPPGCEESGKA

SEQ ID NO: 4784 - protein, 181 aa, Triticum aestivum
  misc_feature (14)..(14): Xaa can be any naturally occurring amino acid
  misc_feature (29)..(29): Xaa can be any naturally occurring amino acid
  misc_feature (94)..(94): Xaa can be any naturally occurring amino acid
YSPWPPTVMASSAXTSVAPFQGLKSTAGXLPSAAAPTAASLGSVSNGGRIRCMQVWPIEGIKKFETLSYLPPLSTEALLKQVDYLIRSKWVPCXLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 4785 - protein, 180 aa, Triticum aestivum
  misc_feature (142)..(142): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINKWRSQEGVPDXYVRIIGFTTSPSECVSSCLKQRAARSARLNTHTAHIMH

SEQ ID NO: 4786 - protein, 216 aa, Triticum aestivum
  misc_feature (114)..(114): Xaa can be any naturally occurring amino acid
  misc_feature (141)..(141): Xaa can be any naturally occurring amino acid
  misc_feature (146)..(146): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPMFGCTDATQVINEVEESRRSXPDAYXRIIGFDNMRQVQCVSSMPQATGCKIRKAKQSSQGQLSAFNFATRHSLGSSNCFYCPRIVSHVMYTCLSNH

SEQ ID NO: 4787 - protein, 176 aa, Triticum aestivum
  misc_feature (25)..(25): Xaa can be any naturally occurring amino acid
MAPTVMASSATSVAPFQGLKSTAGXLPSAAAPTAASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 4788 - protein, 111 aa, Triticum aestivum
  misc_feature (21)..(21): Xaa can be any naturally occurring amino acid
IDPREQKKNNNFGPKKKGHRXRGGPKKNKLSLEGKRVYKTKSFLNRRGEQFYGPNLLKKGFPMFQIEVETEEGGVTVNPEFFVDFGTEPEGPSLGQEKKNPGGDCTFEKWI

SEQ ID NO: 4789 - protein, 316 aa, Triticum aestivum
  misc_feature (201)..(201): Xaa can be any naturally occurring amino acid
MKEAAGGGGDGAGGFVRADQIDLKSLDEQLDRHLARAWTMDKPKRGAGDGQERRQQPREDWEADPARLVVRGVIARGTFGTVHRGVYDGLDVAVKLLDWGEDGHRSEQEITSLRAGVSQEVSVWHKLDHPNVTKFIDAIMGAGDLNIQTEDGNIGMPSNVCCVIVEYLAGGALKTFLIKNRRRKLAFKVVVQIALDLARGXLNGNAYNRKCDVYSYGICLWEVYCCDMPYADLSFSEVTSAVVRQNLRPEIPRCCPSAFANVMKRCWDANPDKRPEMAEVVTMLEAIDTSKGGGMIPVDQARGIGCLSCLRPRRGP

SEQ ID NO: 4790 - protein, 566 aa, Triticum aestivum
MIEQVCTKKQAGTGPEFPDNSAILSAPPSSFFLAQKERRGEFGISIPFFLPKRKSRRGGVRGREMAMASLARRRAAEAVLLRRPHAAAWASACRGYAASGEESDVVVIGGGPGGYVAAIKAAQLGLKTTCIEKRGALGGTCLNVGCIPSKALLHSSHMYHEAKSSFAHHGVKFSNLEVDLPAMMAQKDKAVSGLTKGIEGLFKKNKVEYVKGFGKLVSPSEVSVDLVDGGSTIVKGKNIIVATGSDVKSLPGVTIDEKKIVSSTGALALTEIPKKLVVIGAGYIGLEMGSVWNRLGSEVTVVEFAPDIVPSMDGEIRKQFQRMLEKQKFKFMLKTKVVGVDTSGSGVKLTVEPAAGGEQTVIEADVVLVSAGRVPYTAGIGLDAIGVETDKGGRVLVDNRFMTNVKGVYAIGDAIPGPMLAHKAEEDGVACVEFIAGKEGHVDYDTVPGVVYTHPEVASVGKTEEQVKASGVAYQVGKFPLLANSRAKAIDDAEGMVKVISEKETDRILGVHIMSPGAGEIIHEAVLALQYGASSEDIARTCHAHPTVSEALKEACMNTYDKAIHM

SEQ ID NO: 4791 - protein, 71 aa, Triticum aestivum
  misc_feature (37)..(37): Xaa can be any naturally occurring amino acid
  misc_feature (46)..(46): Xaa can be any naturally occurring amino acid
AQQLARWQAARVAHATLKGPSVLKEIFIGLTLGLGCXGGMWKMHHXWNEQRKTRSFYDMLEKGQISVVVEE

SEQ ID NO: 4792 - protein, 64 aa, Triticum aestivum
  misc_feature (3)..(3): Xaa can be any naturally occurring amino acid
  misc_feature (36)..(36): Xaa can be any naturally occurring amino acid
  misc_feature (41)..(41): Xaa can be any naturally occurring amino acid
MGXGRVAHATLKGPSVVKEIFIGLTLGLVAGGMWKXMHHWXNEQRKTRFFYDMLEKGQISSLRK

SEQ ID NO: 4793 - protein, 99 aa, Triticum aestivum
  misc_feature (37)..(37): Xaa can be any naturally occurring amino acid
  misc_feature (42)..(42): Xaa can be any naturally occurring amino acid
  misc_feature (56)..(56): Xaa can be any naturally occurring amino acid
MAGGRVAHATLKGPSVVKEIFIGTHPWGWLLGGMWKXMHHWXNEQRKTRSFYDMLXEKGQFSVVGPRSIPELNQEFYTPNPLSFWVCHNFLNPPGDMTE

SEQ ID NO: 4794 - protein, 91 aa, Triticum aestivum
SLLSLVIASSVPQARILALNASYFLKNGGHFVISIKANCIDSTQAAEAVFASEVEKLKADQFKPSEQVTLEPFERDHACVVGGYRMPKKQK

SEQ ID NO: 4795 - protein, 301 aa, Triticum aestivum
GEGVTELAPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPAKYEQAKKFGCTDFVNPKDHTKPVQEVLVEMTNGGVDRAVECTGHVDAMVSAFECVHDGWGVAVLVGVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 4796 - protein, 378 aa, Triticum aestivum
  misc_feature (257)..(257): Xaa can be any naturally occurring amino acid
  misc_feature (281)..(281): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDFNPAKYEQAKKFGCTDFVNPKDHTKPVQEVXSDTNGVRACITPLDGSWAAKYCAXECVHDGWGVAVLVGVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 4797 - protein, 380 aa, Triticum aestivum
  misc_feature (193)..(193): Xaa can be any naturally occurring amino acid
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCRSEESNLCDLLRINVDRGVMIGDGQSRFTIDGKPIFHFVGTSTFSEYTVIHVGCLAKIDPEAPLDKVCLLSCGISTGLGATLNVAKPXKKGMTVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFLNERTLRGTFFGNYKPRTGLPGVVDMYMRKELELDKFITHSVPFSQINTAFDLMLKGEGLRCVIRMEE

SEQ ID NO: 4798 - protein, 379 aa, Triticum aestivum
  misc_feature (211)..(211): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAXKGARMPGASRIIGVDLNPAKYEQAKKFGRTDFVNPKDHSKPVQEVLVEMTNGGVDRAVECTGHIDAMIAAFECVHDGWGVAVLVGVPHKEAVFKTYPMNFLNERTLKGTFFGNYKPRTDLPEVVEMYMRKELELEKFITHSVPFSQINTAFDLMLKGEGLRCIMRMDQ

SEQ ID NO: 4799 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGESRFTINGKPIFHFVGTSTFSEYTVIHVGCLAKINPEAPLDKGCVLSCGTSTGLGATLNVAKPKKGSTVAIFGLGAVGLAAMEGAKMSGASRIIGVDLNPAKYEQAKKFGCTDFVNPKDHTKPVQEVLVEMTNGGVDRAVECTGHIDAMIAAFECVHDGWGVAVLVGVPHKEAVFKTSPMNLLNERTLKGTFFGNYKPRTDLPEVVEMYMRKELDVEKFITHSVPFSQINTAFDLMLKGEGLRCVMRMDE

SEQ ID NO: 4800 - protein, 129 aa, Triticum aestivum
PDLVHSKSEKERDFAAGQSALVIEAYRTLSKPLPRALYLLQLEGIHVDEEKTINDPELLMEMMEIREAVSEAGDSETLKKIQSQMKRKLETWSKAFQEAFDKRDFDGAVEATQRMRYYERAMEETVKKL

SEQ ID NO: 4801 - protein, 260 aa, Triticum aestivum
MWRRAGPILGLCGIAGRRVRRPPQPPAPTATCSTSAFASSSFHHNLGTFRDSIGVPPSRSLSNQAGGDGGIGGECWSCGAKGAFLSCGSCRSVQPVDPAVDYFRIFGLDRGYDVKDTNLEGKYKDWQKKLHPDLVHSKSEKERDFAAGQSALVIEAYRTLSKPLPRALYLLQLEGIHVDEEKTINDPELLMEMMEIREAVSEAGDSQTLKKIQSQMKSKLETWAKSFQEAFNKRDFDGAVEATQRMRYYERAMEETVKKL

SEQ ID NO: 4802 - protein, 358 aa, Triticum aestivum
  misc_feature (200)..(200): Xaa can be any naturally occurring amino acid
AHVTCDFPRLISCPSDKFMALLGPNFGFMQPTYPALLASAPGVTGILMIIIMTFSFTLAMHTFRRSVVKLPSPLHHLAGFNAFWYAHHLLLLVYVLLVVHSYFIFLTRIWYKKTTWMFLIVPVLFYACERIIRKVRDNNYHVNILKAAIYPRNVLSLHMKKPPGFKYKSGMYLFVKCPDVSPFEWHPFSITSAPGDDYLXSVHIRTLGDWTSELRSLFGKCFEAQVTSKKATLSRLETTVVADSATEDTRFPKVFIDGPYGAPAQNYKKYDILLLIGLGIGATPFISILKDLLNNIKSNDEVESIHGSEIGSFKNSGPGRAYFYWVTREQGSFDWFKGVMNEVADNDHSDVIEMHNYL

SEQ ID NO: 4803 - protein, 126 aa, Triticum aestivum
MSATCAADLGPLLGAAAANATDYLCNRFADTTSAVDSTYLLFSAYLVFAMQLGFAMLCAGSVRAKNTMNIMLTNVLDAAAGALFYYLFGFAFAFGTPSNGFIGKHFFGLKDMPQTGFDYSFFLFQW

SEQ ID NO: 4804 - protein, 369 aa, Triticum aestivum
  misc_feature (99)..(99): Xaa can be any naturally occurring amino acid
  misc_feature (264)..(264): Xaa can be any naturally occurring amino acid
MVSATKLEGGYCFHSKNSPLDQPEGVKIHLYRLGIEQREHDALKSFAYAGQGSPSLLDTLILSQWENFAQKGHMGYDVTACELKVIEGQRDFVIQMNDXMEYISPQKNDKFGHPFGCLKPNSAKSYEELLLCIAEGEDTEPEVVPSTTPPNNGVLLIANAYPVEYGHIFLVPNSTNQLSSFWDKRMFGLITKIASEVNSTAFRVFFDDGTSIVPKHMFFQACYFANPLPVESASTVALYDGATRSGICVSEIVDYPLKALVFTXTNVNALVDVVSEACLALHEKNTVHSLMMSNNGRNVFLFPQVKNLVTGCYLSAWECCGYFVYQTKVDFDRASETGISNRMASFSFQDGEFEDLKKLCCAIADDLVT

SEQ ID NO: 4805 - protein, 330 aa, Triticum aestivum
MIPSKALHVLVKAAQVYLDTIILSQWENFAQKGQLGYDVTTCELKVIEGQRDFVIQMNDKWNSFSLMKYDKFGHPFGCLKPNSARSYEELLLCIAEGENNEPEVVPSITPPNNGVLLIANAYPVEYGHIFLVPNATNQLSSFWDKRMFGLITKIASEVNSAAFRVFFDDGTSIVPKHMFFQACYFANPLPVESSSTVALYDGATRSGICVSEIVDYPLKALVFTSTNVNALVDVVSEACLALHENNTVHSLMMSNNGRNVFLFPQVKNLVTGCCLSAWECCGYFVHHTKVDFDRASETGISNRMASFSFQDGDFEDLKKLCCAIADGLVT

SEQ ID NO: 4806 - protein, 62 aa, Triticum aestivum
TEASDLSIEAKKNEIELVLLTTPSTKAERMNEITSASEGFVYLVSINGLTGTRPDVNPRVKD

SEQ ID NO: 4807 - protein, 130 aa, Triticum aestivum
MARSVPYVSAAKLVSMARGNRVAVIDVRDEERSYQAHIAGSHHFASGSFAARLPELVQATSGKDTLVFHCALSQVRGPSCARMFSDYLSESKEDSGIKNIMVLERGFNGWEISGQPVCHCKDAPCKGTCS

SEQ ID NO: 4808 - protein, 371 aa, Triticum aestivum
  misc_feature (64)..(64): Xaa can be any naturally occurring amino acid
  misc_feature (84)..(84): Xaa can be any naturally occurring amino acid
  misc_feature (108)..(108): Xaa can be any naturally occurring amino acid
  misc_feature (122)..(122): Xaa can be any naturally occurring amino acid
  misc_feature (132)..(132): Xaa can be any naturally occurring amino acid
  misc_feature (142)..(142): Xaa can be any naturally occurring amino acid
  misc_feature (150)..(150): Xaa can be any naturally occurring amino acid
MAPTAAEQSQQHTRKAVGLAARDVSGHLAPLAITRRSTGDDDVVIKILYCGICHSDLHSPLNDXLRSDGTTNPPLSPGKKAAGXVPGLAKNWPQFRAGTGWVRVIVNXCQSCGSCTRGFEKXCPGIIPTYNXVDFDGTITYXGYSGMVVXHDAFVVRSPDTIPLDKGAPLLCAGITVYSPMKYHGLNVPGMHLGVLGLGGLGHVAVKFGKPFGMKVTVISSSPGKKQEALERLGADAFVISKDADEMKATMSTMDGIINTVSANIPMAPLLGLLKPNGKMIMVGLPEKSMEIPPFALVAVNKTLAGSCIGGMRDTQEMLDLAAKHDVTADIEVIGAEYVNTAMERLAKADVRYRFVIDIGNTLDKAAAASE

SEQ ID NO: 4809 - protein, 77 aa, Triticum aestivum
  misc_feature (16)..(16): Xaa can be any naturally occurring amino acid
GPPSTPEAKPKFKALXTERQEPEKTSLKEPERIKKEIAELKEMKKKTSPMPAAEYFAKPPEPKKKFDDETRNDYWGY

SEQ ID NO: 4810 - protein, 371 aa, Triticum aestivum
MAPTATAAEQSQQHTKKAVGLAALDASGHLSPLAITRRSTGDDDVVIKILYCGICHSDLHSIKNDWKNAKYPMIPGHEIAGEVTEVGKNVTKFKAGDRVGVGCMVNSCQSCESCDKGFENHCPGMIFTYNSVDRDGTRTHGGYSSMVVVHERFVVRFPDAMPLDKGAPLLCAGITVYSPMKYHGLNAPGMHLGVLGLGGLGHVAVKFGKAFGMKVTVISSSPGKKQEALERLGADAFVVSKDADEMKATMSTMDGIINTVSANVPMAPLFGLLKPNGKMIMVGLPEKPIEVPPFALVARNKTLAGSCIGGMRDTQEMLDLAAKHGVTADIEVIGAEYVNTAMERLAKADVRYRFVIDIANTLDKAAAATTE

SEQ ID NO: 4811 - protein, 149 aa, Triticum aestivum
  misc_feature (144)..(144): Xaa can be any naturally occurring amino acid
MGSEADMTGPLLAGGSGVAPAAEAEVVPPWREQLTVRGIVVSAILGVLFCLITHKLNLTVGIIPSLNVAAGLLGYFLVRTWTAALERFGIVSKPFTKQENTVIQTCVVACYGLAFSGGFGSYMLAMDQKTYELIGTDYPGNRAXDVKNP

SEQ ID NO: 4812 - protein, 186 aa, Triticum aestivum
  misc_feature (130)..(130): Xaa can be any naturally occurring amino acid
  misc_feature (145)..(145): Xaa can be any naturally occurring amino acid
  misc_feature (154)..(154): Xaa can be any naturally occurring amino acid
  misc_feature (160)..(160): Xaa can be any naturally occurring amino acid
RTRGRTRGSTFQKFKSFLNKGNDPSCLREFLLPILSQNSPSGNIGLQMLDRHWGAGWNLLALLLATKSDKRISCVDALRHPFLCGPKWRISPTVNVVRWGLGSTAVRLAEDYIYGHHQRRRLAYFIELMXEVLNPNSSTENWLRXLPGAWCLLXCTGRHXGYTLSAYPSPNQVLTFAEPKLGIPFY

SEQ ID NO: 4813 - protein, 293 aa, Triticum aestivum
  misc_feature (171)..(171): Xaa can be any naturally occurring amino acid
  misc_feature (188)..(188): Xaa can be any naturally occurring amino acid
  misc_feature (196)..(196): Xaa can be any naturally occurring amino acid
  misc_feature (216)..(216): Xaa can be any naturally occurring amino acid
  misc_feature (226)..(226): Xaa can be any naturally occurring amino acid
  misc_feature (236)..(236): Xaa can be any naturally occurring amino acid
  misc_feature (247)..(247): Xaa can be any naturally occurring amino acid
  misc_feature (263)..(263): Xaa can be any naturally occurring amino acid
  misc_feature (274)..(274): Xaa can be any naturally occurring amino acid
  misc_feature (276)..(276): Xaa can be any naturally occurring amino acid
  misc_feature (278)..(279): Xaa can be any naturally occurring amino acid
MWGATDAQDAPRRASLPTHAAAGEGSSRSPAAEDPVLLGVSDGYMSLKGVIQVERAGHTDAQSKLVFYVNPLTPTGGREGGREASEQGEGESRVVCFASYTPNLPQRPPLPLPGDSSLSQPMDQLVNFIIRPPRADYSPDDDLLEQEFMLKGRWFQRKDLEVVNSQGKKVXKCSHYIPAVIPEGTALXCVIYCHGXNSGCRADASEAAIILLPSNXTVFTLDFSGXGLSEGEHVTXGWNEKKDLKAXVVNYLRTDGNIFCIAXGGPLMGGGTSXMXGXXDPSMWKGSWKFLPC

SEQ ID NO: 4814 - protein, 258 aa, Triticum aestivum
  misc_feature (250)..(250): Xaa can be any naturally occurring amino acid
MSGNPAATVPAGSLAEAPAPVPVPAVAGERGLSVSQAMSKVMEKGKTAFIPYITAGDPDLATTAAALRLLDALGADVVELGMPFSDASADGAVIKASVARALADGATDDAIMAMLKEVTPELSCPVVIFSYFSPIAQRGTESFADDVKEAGVKGLIVPDLPYAETSAFRDEAIKNELELVLLTTPSTPPERMKEITEASGGFVYLVSVDGVTGARATVNPRVESLLKEIKHVTDQAVAVGFEISTPDHVXQMAEWGAE

SEQ ID NO: 4815 - protein, 333 aa, Triticum aestivum
  misc_feature (96)..(96): Xaa can be any naturally occurring amino acid
MFAQFEPSSMEQSQMARVKLGTQGLEVSKIGFGCMGLTGVYNDPVPEDAGVAVIRRAFDAGVTFFDTADAYGPHTNEVLLGKHSIGGILIFSCLHXALRQVPRERVQVATKCGIAGFDAGGLCVKGTPEYVRASCEASLVRLGVDYIDLYFQHRIDQSVPIEETMGELKKLVEEGKVKYVGLSEASADTIRRAHAVHPITAVQMEWSLWTRDIEEDIIPLCRELGIGVVPYSPLGRGFFAGRAAVESLPSGRLLSKHPRYTGENLEKNKVLYTRLEILSTKYGCTPAQLALAWVLHQGDDVVPIPEQGLAPSLHLNLSSMTNISNNESTGRLL

SEQ ID NO: 4816 - protein, 136 aa, Triticum aestivum
MEPAAAPASPALPHGGHAPAVGGTARGVRRRQYAVLALTFAAYAAFHASRKPPSIVKAVLSAGWAPFTGPEGTHRLGELDVAFLAAYAAAMFAAGHLADRADLRVLLGAAMLASGAESEALGAAYFLGVHRIPFFL

SEQ ID NO: 4817 - protein, 380 aa, Triticum aestivum
  misc_feature (173)..(173): Xaa can be any naturally occurring amino acid
  misc_feature (209)..(209): Xaa can be any naturally occurring amino acid
GTVAIFLLKNRREPEAYLLWTFKKSAEQAEDIAEKTGLGFPHTSHCLATGYIMISCLGDKEGNAAGNGFLLLDSEFNVKGRWEKPGHSPLFGYDFWYQPRHKTMISSSWGAPAAFRTGFDPPHVQDGLYGRHLHVYDWPGGELKQTLDLGSTGLLPLEVRFLHDPSKDTGYVXGCALTSNMVRFFKTADGSWSHEVAISIEPLKVRNWXLPEMPGLITDFVISLDDRYLYLVNWLHGDIRQYNIEDPAKPVLAGQVFVGGLLQKGSDVVYVTDDDKEEQYAVPQVKGNRLRGGPQMIQLSLDGKRVYVTNSLFSRWDEQFYGPDLLKKGSHMLQIDVDTEEGGLAVNPNFFVDFGTEPEGPSLAHEMRYPGGDCTSDIWI

SEQ ID NO: 4818 - protein, 105 aa, Triticum aestivum
  misc_feature (3)..(3): Xaa can be any naturally occurring amino acid
  misc_feature (17)..(17): Xaa can be any naturally occurring amino acid
  misc_feature (46)..(46): Xaa can be any naturally occurring amino acid
  misc_feature (56)..(56): Xaa can be any naturally occurring amino acid
MGXKKIREYDSKRLLKXHLKRLGGIDLHILSAQVTQLTDFAELVNXHPWLSTTKLXVVKPDMLFGKRGEVAFVGTQPGPQQGKTGFGNPTGPKEAPIYTICPVGP

SEQ ID NO: 4819 - protein, 305 aa, Triticum aestivum
MRPPARGGRGGRGFGGRSDGGGRGGRGFGGRSDGGGRGGRGGRGGRTPRGRGGRGGGGRGGAGMKGGSKVVVVPHKHDGVFIAKAKEDALCTKNMVAGESVYGEKRVSVQNEDGTKVEYRVWNPFRSKLAAAVLGGVDNIWIAPGTRVLYLGAASGTTVSHVSDIVGPNGLVYAVEFSHRSGRDLVNMAKKRTNVIPIIEDARHPAKYRMLVGMVDVIFSDVAQPDQARILALNASYFLKNGGHFVISIKANCIDSTQAAEAVFASEVEKLKADQFKPSEQVTLEPFERDHACVVGGYRMPKKQK

SEQ ID NO: 4820 - protein, 82 aa, Triticum aestivum
VAEVDWDDMRQAVPAFLTLALMPLTYSIAYGLVGGIASYMLLHSWDWACQATKRLGCRKKIGGGAERPNCGGEEQRNDMESA

SEQ ID NO: 4821 - protein, 254 aa, Triticum aestivum
  misc_feature (7)..(7): Xaa can be any naturally occurring amino acid
  misc_feature (10)..(10): Xaa can be any naturally occurring amino acid
  misc_feature (18)..(18): Xaa can be any naturally occurring amino acid
  misc_feature (34)..(35): Xaa can be any naturally occurring amino acid
  misc_feature (38)..(38): Xaa can be any naturally occurring amino acid
  misc_feature (54)..(54): Xaa can be any naturally occurring amino acid
  misc_feature (58)..(58): Xaa can be any naturally occurring amino acid
  misc_feature (62)..(62): Xaa can be any naturally occurring amino acid
VIAYLLXPVXGFCNAYGXGLTDMNMGYNYGKVAXXVFXAWAGKDNGVVAGLVTXGLVXQLVXVSADLMHDFKTAHLTLTSPRSMLVGQAAGTLMGCVVAPLTFFLFYEAFDVGNPDGYWKAPYALIYRNMAILGVEGFSALPQHCLQLCAAFFAFAVLANLARDFLPRRLGRFVPLPMAMAVPFLVGASFAIDMCVGSLVVFLWHWLDGSSGRPGRSAVASGLICGDGIWIFPSSLLALAKIKPPMCMKFTPGS

SEQ ID NO: 4822 - protein, 175 aa, Triticum aestivum
MAPAVMASSATTVAPFQGLKSTAGLPVSCRSGSTGLSSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 4823 - protein, 237 aa, Triticum aestivum
MEEKRKMAGLLRHIAAALLFLVTAASTAGASTYYASDPNLGSARVIFQLNHGDIEFGFFPRVAPKTVEHIFKLVQLGCYNTNHFFRVDKGFVAQVADVMGGRKAPMNKEQEQQAEKSIVGEFSTVKHVRGILSMGRYSDPDSASSSFSILLGDAPHLDGQYAVFGRVTKGDDTLRKLERLPTHKEGIFVMPIERIEILSTYYYDIDVESCEPEKSILKRRLSESASEVERWRRKCFA

SEQ ID NO: 4824 - protein, 223 aa, Triticum aestivum
  misc_feature (110)..(110): Xaa can be any naturally occurring amino acid
  misc_feature (119)..(120): Xaa can be any naturally occurring amino acid
MTSPAPAPPAAAAAQSPPPRIGLAGLATMGQNLALNIAEKGFPISVYNRTAAKVDSTLSRAAAEGALPVLGHRDPRDFDLSLARPRTVVLLVQAGPAVDATIDALSPYLXDAGDAIVDXXATSGNQNTERPVEQAASRGILYLGMGVSGGEEGARNGPSLMPGGDFQAYSNIKDILEKAAAQTEDGPCVTFVGPGGAGNFVKMVHNGIEYGDMQLIAEAYDVL

SEQ ID NO: 4825 - protein, 198 aa, Triticum aestivum
  misc_feature (115)..(115): Xaa can be any naturally occurring amino acid
MLPYATAGEAEAALGRALTWAEAAWLRYSASVPDRYLHWPNIAITLVVYTLAPLPLALFDLAAPAAAAPYKLQPKVQHPPATFFRCYMDAVRVSLLIIGPYQLISYPAAKKSVKXVQYSTVQQLQAEPRWIKIMDIRTGLPLPSMGEIAAQLTVYFLVEDYLNYWLHRLLHTKWGYEKIHHVHHEFTAPMAYAAWYGH

SEQ ID NO: 4826 - protein, 383 aa, Triticum aestivum
  misc_feature (324)..(324): Xaa can be any naturally occurring amino acid
  misc_feature (328)..(328): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFAEWNKGELLSFLVEITADIFSIKDDQGEGYLVDKVLDKTGMKGTGKWTVQQAAELSVAAPTIEASLDSRFLSGLKDERVAASKIFQGDYSSGETVDKAQLIXDVKXALYASKICSYAQGMNIIKGQDTEKDGASTRQLARIWKVGDHPRNFLDRIKKATTT

SEQ ID NO: 4827 - protein, 272 aa, Triticum aestivum
  misc_feature (132)..(132): Xaa can be any naturally occurring amino acid
  misc_feature (141)..(141): Xaa can be any naturally occurring amino acid
  misc_feature (195)..(195): Xaa can be any naturally occurring amino acid
  misc_feature (251)..(251): Xaa can be any naturally occurring amino acid
KTSPPPSRRPARGRAAARERERERESLVGGHAQYRWRRPPPRSAPASATRAPPPSSARRRAGFSSSRKLFQVKASRVDSFSKSDIIVSPSILSANFAKLGEQVKAVEVARCDWIHVDVLDGRFVPNFTIGPXIVDALPPVXTDLPLDVPLMIVGPEQRMPDVIRAGADIVTVHCEPAATILLHRTVDQINSLGAXGWSCLETPATPLRAIEYVLESVDLLSIMSVTPGMGVQSSIESQVVNIADLRKLCEXKGVPSWIEVDGGLSPCTPTGH

SEQ ID NO: 4828 - protein, 196 aa, Triticum aestivum
MASPSSSLCSSLGYPRAASLGARRRAGFSSSRKLFQVKASRVDSFSKSDIIVSPSILSANFAKLGEQVKAVEVAGCDWIHVDVMDGRLVPNITMGPLMVDALRPGTDLPWDVHLMMGEPEQRIPDFIKAGADIVSVHCEQTATIHLHRTVDQIKSLGAKAGVVLNPGTPLSAIEYVLESVDLVLIMSVNPGFWGGR

SEQ ID NO: 4829 - protein, 164 aa, Triticum aestivum
  misc_feature (66)..(66): Xaa can be any naturally occurring amino acid
  misc_feature (80)..(80): Xaa can be any naturally occurring amino acid
  misc_feature (95)..(95): Xaa can be any naturally occurring amino acid
  misc_feature (106)..(106): Xaa can be any naturally occurring amino acid
  misc_feature (109)..(109): Xaa can be any naturally occurring amino acid
  misc_feature (121)..(121): Xaa can be any naturally occurring amino acid
  misc_feature (130)..(130): Xaa can be any naturally occurring amino acid
  misc_feature (136)..(136): Xaa can be any naturally occurring amino acid
  misc_feature (151)..(151): Xaa can be any naturally occurring amino acid
  misc_feature (153)..(153): Xaa can be any naturally occurring amino acid
  misc_feature (163)..(163): Xaa can be any naturally occurring amino acid
LEFFFFFFFSQYTRSKTLEIQTNEVLEILRAENKLSYFAATTLVTQEKLQQASNKTKQMRLNDVWXIRPPFGGRGRKLTXNLEAHVNGSRYSTSXRADERLGYQCXGNXKHAFLPSKQEKXMITLLQFHXLHNHIXVGNKEDEGCHFKLKXMXVVQTFGGNKXP

SEQ ID NO: 4830 - protein, 147 aa, Triticum aestivum
RVVWTISSLIAASTRHYLLRSIIKEHPTLRSLVLADADGQGTLCMGAEQLAEFRESRLSASACSNRTQVPACSMKLKYAPYLELPGGLGLQGATLVVIKPSGDGAGGCHVGRKETEAFVSGAFDGPFRFAAKALMKRRTYLLEMNGF

SEQ ID NO: 4831 - protein, 153 aa, Triticum aestivum
  misc_feature (15)..(15): Xaa can be any naturally occurring amino acid
RFLGGDQRGHPRRRXLKGKKVFVRADLNVPLDDAQKITDDTRIRASIPTIKYLLEKGAKVILASHLGRPKGVTPKFSLKPLVARLSELLENVRFYKEEEKNDPEFAKKLASVADLYVNDAFGTAHRAHASTEGVTKFLRPSVAGFLMQKELDY

SEQ ID NO: 4832 - protein, 247 aa, Triticum aestivum
  misc_feature (195)..(195): Xaa can be any naturally occurring amino acid
  misc_feature (204)..(204): Xaa can be any naturally occurring amino acid
  misc_feature (210)..(210): Xaa can be any naturally occurring amino acid
LDRTSLYKKAGWYRSGIPGISSTHASVVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGXTTIIGGGDXVAAVEXAGLATDEHIRPGLTSWSSRMQLSQCTALPGVLALNKT

SEQ ID NO: 4833 - protein, 147 aa, Triticum aestivum
LEPAKSKGVKLLLPTEVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGSASLELREGKPLQNAPPPHEA

SEQ ID NO: 4834 - protein, 111 aa, Triticum aestivum
SYQARSGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 4835 - protein, 401 aa, Triticum aestivum
MATKRSVGTLGEADLKGKKVFVRADLNVPLDDAQKITDDTRIRASIPTIKYLLEKGAKVILASHLGRPKGVTPKFSLKPLVPRLSELLGLEVVMAPDCIGEEVEKLAAALPDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLPVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 4836 - protein, 128 aa, Triticum aestivum
  misc_feature (72)..(73): Xaa can be any naturally occurring amino acid
  misc_feature (77)..(77): Xaa can be any naturally occurring amino acid
  misc_feature (97)..(97): Xaa can be any naturally occurring amino acid
  misc_feature (106)..(106): Xaa can be any naturally occurring amino acid
MAALAASMATSTAFAAKPRLVRPPARLSVSCSASSGDNNTPSLSASIKTFSAALALSSVLLSSAATSPPPAXXDIAXLTPCKEPKALPKRKKEQEKXLNSSLSKYXPDSAAEIAIQDTIQKTNRRVEN

SEQ ID NO: 4837 - protein, 292 aa, Triticum aestivum
  misc_feature (74)..(74): Xaa can be any naturally occurring amino acid
  misc_feature (84)..(87): Xaa can be any naturally occurring amino acid
  misc_feature (90)..(90): Xaa can be any naturally occurring amino acid
  misc_feature (100)..(100): Xaa can be any naturally occurring amino acid
  misc_feature (152)..(152): Xaa can be any naturally occurring amino acid
  misc_feature (168)..(168): Xaa can be any naturally occurring amino acid
  misc_feature (183)..(183): Xaa can be any naturally occurring amino acid
  misc_feature (195)..(195): Xaa can be any naturally occurring amino acid
  misc_feature (210)..(210): Xaa can be any naturally occurring amino acid
  misc_feature (253)..(253): Xaa can be any naturally occurring amino acid
MHPTRWELSHMVQRQAAGVVISVVAAEVRDPDASVGGELVFGGVDKKHYKGKHTYVPVTRKGYWQFDMGDLLIXGESGRFCAGXXXXIVXSGTSLLAGPXTIVAQVNHAIGAEGILSTECKEVVREYGEMILELLVAQTRPQKVCSQMGLCXFDGSHSVQDQIESVVXKTEKRGSDLLCTAWXMTVVWIQNQFRXNPTQELILGYANPVXEGLPRPHGEFTRAIAPEPQRCLHLGFTISNQKLPPLTPDQYRXLNRGPSGTGQFASKRFWGLTSVPPPRGPAGNLGAISLGA

SEQ ID NO: 4838 - protein, 100 aa, Triticum aestivum
  misc_feature (58)..(58): Xaa can be any naturally occurring amino acid
  misc_feature (79)..(79): Xaa can be any naturally occurring amino acid
MAGGVADAGVPTLAKANGSGAGCCPVKGPVYATPREVMEMGPREGLLYMTCVYNGTGXINKPDYLATGGVYPNVATYSXVIHRVPGTHNCDELDHYGWDR

SEQ ID NO: 4839 - protein, 331 aa, Triticum aestivum
RLLGYEFPETIIVFMQKLQQASNKTKQMRLNDVWIRPPFGGRGRKLTGTLEAHVNGFRYSTSRADERVDIMYGNIKHAFFQPAEKEMITLLHFHLHNHIMVGNKKTKDVQFYVEVMDVVQTVGGSRRSALDPDEIEEEQRERDRKIRINMEFQNYINKVNDHWSQPQFKGLDLEFDIPLRELGFHGVPYKASAFIIPTSTCSDAWVETPFLVVTLGEIEIVNLERVGFGTKNFDMAIVFKDFKKDVLRIDSIPSTSLDAIKEWLDTTDLKYYESRLNLNWRPILKTIIDDPQKFVDDGGWEFLNMEASDSEAEETEESDQGYEPSDAEPES

SEQ ID NO: 4840 - protein, 156 aa, Triticum aestivum
  misc_feature (127)..(127): Xaa can be any naturally occurring amino acid
SPPAAAAPAETVKFEIWDTAGQERYHSLAPMYYRGAAAAIVVYDITNPASFTRAKKWVQELQAQGNPNTIVALAGNKADMLDARQVPAEEAKAYAQENGLFFMETSAKTAINVNDIFYEIAKRLLQXGNRLQAHRLGMVLNQRPNERTVSSSSCCS

SEQ ID NO: 4841 - protein, 243 aa, Triticum aestivum
  misc_feature (74)..(74): Xaa can be any naturally occurring amino acid
  misc_feature (102)..(102): Xaa can be any naturally occurring amino acid
  misc_feature (133)..(133): Xaa can be any naturally occurring amino acid
  misc_feature (173)..(173): Xaa can be any naturally occurring amino acid
  misc_feature (190)..(190): Xaa can be any naturally occurring amino acid
NIMFSPFYKVLMADFFMADQLTSQIPLLRHMEFAACYFMAGSFRANPYETCTTSQQYKHLAYVISFLPYYWRAXAVLRRYIEEHDINQSPTPGFRVGMVAVXVRFKYNVTPTPFWMSMVLISSSGATVYQLYXWDFVKDWGFFTPKSRNLWLRDDLIRKNKSPYYLSMMLNLXVLRLAWAQSVMKIPYSXNETRLLDFSLASLEIIRRGHWNFYRLENEHLNNVGKFRAVKTVPLPFRELETD

SEQ ID NO: 4842 - protein, 147 aa, Triticum aestivum
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPKKSPAAAEKEAKSPKKKTTTKSPKKKTAATKE

SEQ ID NO: 4843 - protein, 484 aa, Triticum aestivum
  misc_feature (224)..(224): Xaa can be any naturally occurring amino acid
  misc_feature (330)..(330): Xaa can be any naturally occurring amino acid
  misc_feature (419)..(419): Xaa can be any naturally occurring amino acid
MASTAAPPAALVARRAASASAAAAPLRRAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIAVKKAEDVIGPEVEKLVADLENGAVLLLENVRFYKEEEKNDPEFAKKLASLADLFVNDAFGXTAHRAHASTEGVTKFLKPSVAGFLLQKELDYLDGAVSNPKRPFAAIVGGSKGVVPRLGLSNPLLEKCDILLLGGGMIFTFYKAQGLSVGSSLVEEDKLELATSLLXRAKAKGVSLLLPSDVIIADKFAPDANSQTVPASAIPDGWMGLDIGPDSVKTFNDALDTTQTIIWNGPMGVFEFDKFAVGTESIAKKLAXELSKKGVTTIIGGGDSVAAVEKVGVADVMSHISTGGGASLELLEGKELPGVVALDEGVMTRSVTV

SEQ ID NO: 4844 - protein, 361 aa, Triticum aestivum
  misc_feature (33)..(33): Xaa can be any naturally occurring amino acid
  misc_feature (221)..(221): Xaa can be any naturally occurring amino acid
  misc_feature (260)..(260): Xaa can be any naturally occurring amino acid
HNITSLYKKAGWYRSGIPGISSTHASAITQENXLLDNTARIEGWLDRFPMFDWVGGRTSELSAVGLLPAALQGIDVKEMLVGAALMDEETRNTVVKENPAALLALSWYWATDGIGSKDMVVLPYKDSLLLLSRYLQQLVMESLGKEYDLDGNRVNQGLTVYGNKGSTDQHAYIQQLREGVHNFFVTFIEVLRDRPPGHDWELEPGVTCGDYLFGMLQGTRXCSLSNDRESISVTVGEVTPRAVGALVALYERAVGIYASXLVNINAYHQPGVEAGKKAAGEVLALQKRVLTVLNEASCKDPAEPLTLEQIADRCHCPEDIEMIYKIIQHMAANDRALIAEGSCGSPRSVKVYLGECNVDDL

SEQ ID NO: 4845 - protein, 141 aa, Triticum aestivum
IRHEAAQTVRRNRATCLQLARRAKMIGDLLHQLHAAQLMQQPETRNPMEQLEETLRRALLLVRSCQGRGYLYRCFMGARHADELREVQGEITFYLQLFPLVSYVDTTLTWVRLLNKAGAPEPPSCKEVQPVLIVSDKSSRN

SEQ ID NO: 4846 - protein, 248 aa, Triticum aestivum
  misc_feature (108)..(108): Xaa can be any naturally occurring amino acid
METGEFVREPSAGSSVVAGSAEDDAERSFKEGHASSYRRASGEQNSGIRRQAHGGYELERSSHRSSSDRLVSERRLMQRESMPVTAESSDLRHRLLKQRRLNDSRSTXSPTRRDRRYPEDERGSHHRRRGEERAAHDGLSRSRLQGRIKLPGEASLDRLGPHPHLEKERGHRDRLSPPKQTDLRAKLHDRLKARSNEEVPGNLKSSVVKASSGEDAGVVNFSGPKSLAELRAKKAAYRSGNTVKNAGR

SEQ ID NO: 4847 - protein, 345 aa, Triticum aestivum
MGVDYYKVLGVDRGASDDDLKKAYRKLAMRWHPDKNPTTKKEAEAKFKQISEAYEVLSDFQKRTIYDQLGEEGLKGQPPPGAGGPGASSFYPGGGQSTSFHFNPRSADDIFAEFFGFSGPSFLGGMPGGSMRGEPRSYGGGVFSNEYLAKRFAEGSAGNMPRPSHKPAPIENQLSVTLADLYKGVAKKMKISREVIETSGRVSQVEEILTIDVKPGWKKGTKITFPEKGNESPSMMPADIVFIIEEKPHDVFTREGNDLVMTQKISLVEALTGYTVQLTTLDGRSLSRQVNSVIHPSYEEVIPGEGMPIPKEPCKKGNLRVKFSIKFPSRLTSDQKAGIKRLLGS

SEQ ID NO: 4848 - protein, 420 aa, Triticum aestivum
MLLRPALPVAVSSTLPLFSHLAAVRRRCSIAATGMAGVSAASPAAAQIGSFLSKKPYAPPSWASHLALAPSHTFSLGHFPTPIHQWNLPNLPEGTEVWIKRDDLSGMQLSGNKVRKLEFLLSDAVAQGADCVITVGGIQSNHCRATAVAAKYLNLDCYLILRTSKLLVDQDPGLVGNLLVERLLGAHIDLVSKEEYGKIGSVALADLLKKRLLEEGRKPYVIPVGGSNSLGTWGYIEAVRELEQQIQLSGDVQFDDIVVACGSGGTIAGLALGSKLSSLTAKVHAFSVCDDPEYFYDYVQGLIDGLQSGLDSHDIVSIQNAKGLGYAMNTAEELKFVKDIATATGIVLDPVYSGKGAYAMLKDMADNPSKWKGRKVLFVHTGGLLGLYDKVDQMSSLAGSWRRMDLEESVPRKDGTGKMF

SEQ ID NO: 4849 - protein, 115 aa, Triticum aestivum
  misc_feature (99)..(99): Xaa can be any naturally occurring amino acid
MPCLNVSTNVNLEGVDTSAILAEASKSVANIIGKPEAYVMVVLKGSVPMAFGGTQEPAAYGELVSIGGLNPDVNKKLSAGIASILESKLSVPKSRFYLXFYDSKRSDFGWNGSTF

SEQ ID NO: 4850 - protein, 152 aa, Triticum aestivum
RSRKIAHMPKPEASLDKVTFKGMTREAITVHSHVNVTNPYSHRIPICDIAFNLKCGGKEVASGTIPDPGWIEDSGEVTKLEVPAKVPYDFLISLMKDLGRDWDIDYELLVKLTIDLPIIGNFTIPLETAGEFKLPTLSDFFGGAAKTEEATA

SEQ ID NO: 4851 - protein, 114 aa, Triticum aestivum
SENICSHYCDIAFNLKCGGKEVASGTIPDPGWIEDSGEVTKLEVPAKVPYDFLISLMKDLGRDWDIDYELLVKLTIDLPIIGNFTIPLETAGEFKLPTLSDFFGGAAKTEEATA

SEQ ID NO: 4852 - protein, 169 aa, Triticum aestivum
  misc_feature (101)..(101): Xaa can be any naturally occurring amino acid
MVKVPAMASLMDKAKGFVADKIAHMPKPEASLDKVTFKGMTREAITVHSHVNVTNPYSHRIPICDIAFNLKCGGKEVASGTIPDPGWIEDSGEVTKLEVPXKVPYDFLISLMKDLGRDWDIDYELLVKLTIDLPIIGNFTIPLETAGEFKLPTLSDFFGGAAKTEEATA

SEQ ID NO: 4853 - protein, 176 aa, Triticum aestivum
TSPKSMMIAQVIGTAMGCIISPLTFMLFYKAFDIGNPDGTWKAPYALIYRNMAILGVEGFSVLPKYCIAISGGFFAFAAIFSIARDVMPHKYAKYVPLPMAMAVPFLVGRSFAIDMCLGSLIVIAWTKINEKEAGFMVPAVASALICGDGIWTFPASILALAKIKPPICMKFLPAA

SEQ ID NO: 4854 - protein, 492 aa, Triticum aestivum
MAGGGGKAKPLEFTPTWIVALVCSVMIIISLLFERLLHRLGKRLIRSRKKPLYEALLKVKEELMLLGFISLLLTVFQGPMGKLCVSPSAMLHLQPCKPPPHETDHLGGAVFTGVLGGGRRLLAGGASSSDEYCLKKDKVPLLSSDAIHQLHIFIFVLAVTHFLLSAITVLLGMAQTRNWRHWETKIQENNGSAPQMIKHVQEFKFIQDHFKGHRKRSRIFGWMRSFFKQLYGSVTEEDYTTMRLGFIMKHCKGTPKFNFYSYMIRALEVDFKKVVGISWYLWAMLMIFLLLNVEGWYVYIWITLVPFIMLLMVGSKMEHIITELAYEVAQKHTAIRGDLVVSPSDNFFWFHRPKLVLLLIHIVLFQNAFEIAFFFWLLVTYGFKSCIMGKPAYVITRVVISVICQVLCGYSTLPLYAVVSHMGNSFKKTIFDENVTEGLVNWAEKARRGTRTPNKITTDASSSPIDEANGGAVQMTHTRPHSRGEQGTARLI

SEQ ID NO: 4855 - protein, 492 aa, Triticum aestivum
MAGGGGKAKPLEYTPTWIVALVCSVMIIISLLFERLLHRLGKRLIRSRKKPLYEALLKVKEELMLLGFISLLLTVFQGPMGKVCVSPSAMLHLQPCKPPPHETDHLGDAVFTGVLGGARRLLAGGASSSDKYCLKKDKVPLLSSDAIHQLHIFIFVLAVTHFLLSAITVLLGMAQTRNWRHWETKIQENNGSAPQMIKHVQEFKFIQDHFKGHRKRSRIFGWMRSFFKQLYGSVTEEDYTTMRLGFIMKHCKGTPKFNFYSYMIRALEVDFKKVVGISWYLWAMLMIFLLLNVEGWYVYIWITLVPFIMLLMVGSKMEHIITELAYEVAQKHTAIRGDLVVSPSDNFFWFHRPKLVLLLIHIVLFQNAFEIAFFFWLLVTYGFKSCIMGKPAYVITRVVISVICQVLCGYSTLPLYAVVSHMGNSFKKTIFDENVTEGLVNWAEKARRGTRTPNKITTDASSSPIDEANGGAVQMTNTRANSSVEQGTARLI

SEQ ID NO: 4856 - protein, 251 aa, Triticum aestivum
  misc_feature (19)..(19): Xaa can be any naturally occurring amino acid
SLICFWQFDMGDVLIGGKXTGFCAAGCAAIADSGTSLLAGPKAIITQINEKIGAAGVVSQECKTVVSQYGEKILDQLLAETQPAKICSSVGLCTFDGTHGVSAGIRSVVDVEAGKSNGLFNDAMCNACETAVVWMQSQLAQNQTQDLVLQYINQLCERIPSPMGESSVDCSRLASMPDIAFTIGGRKFALKPEQYILKVGEGAATQCISGFTAMDIPPPRGPLWILGDVFMGAYHTVFDYGNLKVGFAEAA

SEQ ID NO: 4857 - protein, 165 aa, Triticum aestivum
  misc_feature (20)..(20): Xaa can be any naturally occurring amino acid
  misc_feature (29)..(29): Xaa can be any naturally occurring amino acid
  misc_feature (57)..(57): Xaa can be any naturally occurring amino acid
  misc_feature (66)..(66): Xaa can be any naturally occurring amino acid
  misc_feature (88)..(88): Xaa can be any naturally occurring amino acid
  misc_feature (93)..(93): Xaa can be any naturally occurring amino acid
  misc_feature (101)..(101): Xaa can be any naturally occurring amino acid
VMASSATSVAPFQGLKSTAXLPVSRRSNXASLGSVSNGGRIRCMQVWPIEGIKKFEXTLSYLPPLXAREALLKQVDYLIRSKWVPCLXFTKVXGFIFREHXRISLGTTNGRYWAMWESCPMFGATDPNKRWIKQGEGGSRKGVTPGAVLSGNPSGSNQCGQGGVA

SEQ ID NO: 4858 - protein, 256 aa, Triticum aestivum
MNPRDSGDDRPGATAGSSSAAPAQQHQRQSLEWRFAQVFGERAAGEDVQEVDIISAIEFDKSGDHLATGDRGGRVVLFERTDARDEHANRRELERQDVPITRHPEFRYKTEFQSHEPEFDYLKSLEIEEKINKIKWCQTANNALFLLSTNDKTIKYWKVQEKKVKQVSVMALDTSRTVGDGTTSRASTSTSEPPLPNGGCSKKSDSLNSDLAFPPGGYPSLRLPVVTSQDVNLCARCRRVYAHAHDYHINSISNNR

SEQ ID NO: 4859 - protein, 130 aa, Triticum aestivum
  misc_feature (40)..(40): Xaa can be any naturally occurring amino acid
MAPTVMASSATSVAPFQGLKSTAGLPVSRRSNGASSAASXNGGRIRCMQVWPIEGIKKFETLSYLPPLSTEALLKQVDYLIRSKWVPCLEFSKVGFIFREHNASPGYYDGRYWTMWNCYVRVTTHTVSTR

SEQ ID NO: 4860 - protein, 83 aa, Triticum aestivum
MHPKARIHADPAAPEPDRIDGLPDSLVLLILNKLEDVHSLGRCAAVCRRFSDLVPLVHDVYVKIDRVVGGRNRLLCPSRNFPL

SEQ ID NO: 4861 - protein, 140 aa, Triticum aestivum
ADGVFQAGAGSTTGRTLLQAKRDCPVNFEFQNYTVITSRCKGPKYPAKDCCDSFKEFACPFNNYINDESNDCASTMFSYINLYGKYPPGLFAHECREGKLGLSCEGVPQKDVVKSGVQRARSSSLALITLMCGLVALFFQ

SEQ ID NO: 4862 - protein, 364 aa, Triticum aestivum
MMASEPVARAVAEEVGRWGSMKQTGVSLRYMMEFGSVPTDRNLLLSAQFLQKELPIRIARRALELESLPFGLSAKPAILKVRDWYLDSFRDIRYFPEVRNRDDELAFTQMIKMIKVRHNNVVPTMALGVQQLKNEQFSSRKLPPGFDEIHGFLDRFYMSRIGIRMLIGQHVALHEPEPQPGVIGLINTKLSPIQVAQIASEDARSICMREYGSAPDINIYGDQNLTFPYVTSHLHLMLFELVKNSLRAVQERYMNSDKDVPPVRIIVADGTEDVTIKVSDEGGGIRRSGLPRIFTYLYSTAKNLPDMEGPSEGVTMAGYGFGLPVSRLYARYFGGDLQIISMEGYGTDAYLHLSRLGDSEEPLP

SEQ ID NO: 4863 - protein, 188 aa, Triticum aestivum
  misc_feature (80)..(80): Xaa can be any naturally occurring amino acid
  misc_feature (86)..(86): Xaa can be any naturally occurring amino acid
  misc_feature (101)..(101): Xaa can be any naturally occurring amino acid
  misc_feature (109)..(109): Xaa can be any naturally occurring amino acid
  misc_feature (132)..(134): Xaa can be any naturally occurring amino acid
  misc_feature (138)..(138): Xaa can be any naturally occurring amino acid
  misc_feature (140)..(140): Xaa can be any naturally occurring amino acid
  misc_feature (144)..(144): Xaa can be any naturally occurring amino acid
  misc_feature (151)..(151): Xaa can be any naturally occurring amino acid
  misc_feature (157)..(157): Xaa can be any naturally occurring amino acid
  misc_feature (161)..(161): Xaa can be any naturally occurring amino acid
  misc_feature (164)..(164): Xaa can be any naturally occurring amino acid
  misc_feature (168)..(168): Xaa can be any naturally occurring amino acid
  misc_feature (172)..(172): Xaa can be any naturally occurring amino acid
  misc_feature (175)..(175): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYXIRSKWXVPCLQFNKVGFILRXEHNASPGXYYDGRYWTMWKLLCSGCNDPHKXXXKVEXVXKDYXYPYVRIXRFNNMXQVHXSTXRLKXTGCXDPXKAKHKGILNAFNL

SEQ ID NO: 4864 - protein, 147 aa, Triticum aestivum
RSSLLTGYQLMDFWDRLCTYLRVRKVSVLDVSKKFEVDYRVLHAIATGCSWYGQWGFKLGSGSFGITSETYSKAIENLSSVSLSHFFPHSRYPRNQLQDTIAFYQSLSKRPLTTFRDLFLYVLGLAAGKSVHTHLVTMHKRELAYDA

SEQ ID NO: 4865 - protein, 214 aa, Triticum aestivum
  misc_feature (129)..(129): Xaa can be any naturally occurring amino acid
  misc_feature (206)..(206): Xaa can be any naturally occurring amino acid
MSMHLALSCAPAFVPSQEVVEAPLLHPLLSINHGLNTFLIEDKGGAIAIMCASLFFLGTWPAVLTLLERRGRLPQHTYLDYSITNLLAAVLIALTFGQLGDAKHNMPNFFTQLSQDNWPSVMFAMAGGXVLSVGNLSTQYAWAYVGLSVTEVISSSMVVVIGTTLNYFLDNRINKAEILFTGVACFLVAVILGSAVHASNAADNEXKLSESTNT

SEQ ID NO: 4866 - protein, 195 aa, Triticum aestivum
  misc_feature (184)..(184): Xaa can be any naturally occurring amino acid
MDGGGGGGGGGGSTSGDDGKQEKHLVLAHKLFLLSHPDVDDLSKVDLRSDVLSAVKSDDMAPLFESLAAAGVLEPDAVLLSEMRARIDEEIRKLDEKIADAEENLGESEVREAHLAKSLYFVKVGEKEKALEQLKVTEGKTVAIGQKMDLVFYTLQMGLFYMDLDLISKSIDKAQKSFEEGGDXERKNRLKVYEG

SEQ ID NO: 4867 - protein, 402 aa, Triticum aestivum
MDGGGGGGGGGGGGGSTSGDDGKQEKHLVLAHKLFLLSHPDVDDLSKVDLRSDVLSAVKSDDMAPLFESLAAAGVLEPDAVLLSEMRARIDEEIRKLDEKIADAEENLGESEVREAHLAKSLYFVKVGEKEKALEQLKVTEGKTVAIGQKMDLVFYTLQIGLFYMDFDLISKSIDKAKKLFEEGGDWERKNRLKVYEGLYCMATRNFKKATSLFLDSISTFTTYELFPYDTFIFYTVLTSIISLDRVSLKQKVVDAPEILAVISKVPHLSEFLNSLYNCQYKSFFVAFSGLTEQIKLDRYLQPHFRYYMREVRTVVYSQFLESYKSVTMEAMASAFGVTVDFIDQELSRFIAAGKLHCKIDKVAGVLETNRPDERNAFYQSTIKQGDFLLNRIQKLSRVIDL

SEQ ID NO: 4868 - protein, 128 aa, Triticum aestivum
  misc_feature (22)..(23): Xaa can be any naturally occurring amino acid
  misc_feature (107)..(107): Xaa can be any naturally occurring amino acid
HHGARTKWKSQAEKGSSTSPNXXVWVGRAMALLAELFGNRVEQQDWTMTQACTESCSHTVKKWHGWLASSSVSVAMKLGPNKDKFMEVISGPGEIKAGSENLCSPLXTFIKENQGWLPSVRLAEKKTS

SEQ ID NO: 4869 - protein, 219 aa, Triticum aestivum
MPISSSLSARLGPGPAPAPARWGPYARPSEPRRTGAGSGCAKASRPPLRLEPATERLLGPARRAESRGSSRGAAAPTPARRRLGDLKKSDPKTDPKPAGTNPEPIQEPRVEESRGCGGFAFLCALAGHEEAITGISMPMGSDKLYSGSADGSVRVWDGNSGKCVDVIKIGGKIGCMITHDKWVFIGIPKSVEAWNIQTGMKLSLQGPSGLVCSMTIKDE

SEQ ID NO: 4870 - protein, 89 aa, Triticum aestivum
  misc_feature (51)..(51): Xaa can be any naturally occurring amino acid
  misc_feature (53)..(53): Xaa can be any naturally occurring amino acid
MRDVPKLSPLVAHRVHADPLSGLEFTSESIVTICREGLIKIWARPQHSENXQXPNSSELAAGNAISKDKMITSPNKAGTSSSSFKQPSS

SEQ ID NO: 4871 - protein, 195 aa, Triticum aestivum
  misc_feature (47)..(47): Xaa can be any naturally occurring amino acid
MGSGLSHNHRSSVAPQQQPSSARVIAADGSLTEFATSSPVSVSDVLXGNAGGPFFLCSSDALYFDEDVPALGGGEQLRPGQIYFVLPVAMLGRPLSSADMAAMAVRASEALATRARPRGRGAGIRKVRVTPVHGEGGRGDVDAQVNAKLNERTLGEYSATASGGPARIGKKAAVAAFPPARKALKPLSAIPEDAE

SEQ ID NO: 4872 - protein, 160 aa, Triticum aestivum
  misc_feature (67)..(67): Xaa can be any naturally occurring amino acid
  misc_feature (80)..(80): Xaa can be any naturally occurring amino acid
  misc_feature (82)..(82): Xaa can be any naturally occurring amino acid
  misc_feature (89)..(89): Xaa can be any naturally occurring amino acid
  misc_feature (110)..(110): Xaa can be any naturally occurring amino acid
  misc_feature (120)..(120): Xaa can be any naturally occurring amino acid
  misc_feature (128)..(128): Xaa can be any naturally occurring amino acid
  misc_feature (142)..(142): Xaa can be any naturally occurring amino acid
  misc_feature (145)..(145): Xaa can be any naturally occurring amino acid
VFFDTGSSNLWVPSSKCYFSIACYLHHKYKSTKSTTYKKNGETCTISYGSGSIAGFFSEDSVLVGEXVVKNKKSSETTRXSXPTFIIGXFDGILGLGFQKISRWKVPSNXQSMQEQKLIXEGIFPSGXTVIPITLGSEPLFXGLXKHYKGKHTYVQSPQR

SEQ ID NO: 4873 - protein, 121 aa, Triticum aestivum
MPCLNVSTNVNLEGVDTSAVLADASSTVATIIGKPEAYVMVVLKGSVPMAFGGTQEPAAYGELVSIGGLNADVNKKLSAGIASILESKLSIPKSRFYLKFHDSKAHPAQEHAQCLHALHQE

SEQ ID NO: 4874 - protein, 112 aa, Triticum aestivum
  misc_feature (44)..(44): Xaa can be any naturally occurring amino acid
MPCLNVSTNVNLEGVDTSAVLADASSTVATIIGKPEAYVMVVLXPMAFGGTQEPAAYGELVSIGGLNADVNKKLSAGIASILESKLSIPKSRFYLKFHDSKRSDFGWNGSTF

SEQ ID NO: 4875 - protein, 386 aa, Triticum aestivum
  misc_feature (268)..(268): Xaa can be any naturally occurring amino acid
  misc_feature (288)..(288): Xaa can be any naturally occurring amino acid
MAKPISIEVWNPSGKYRVVSTKSMPGTRWIKLLTDNDCRLKICTEKKTILSVDDILALIGDHCHGVIGQLTEDWGEVLFSALKRAGGTAFSNMAVGYNNVDVDAANRNGIAIGNTPGVLTETTAELAASLSVAAARRIVEADQFMRAGLYDGWLPHLFVGNLLKGQTVGVIGAGRIGSAYARMMIEGFKMNLIYFDLYQSTRLEKFVTAYGQFLKANGEQPVTWKRASSMEEVLREADVISLHPVLDKTTYHLINPERLAMMKKEAVXVNASRGPVIDEVALVEHLRXNPMFRVGLDVFEDEPYMKPGLAEMKNAVVVPHIASASKWTREGMATLAALNVLGKIKGYPVWGNPNAVEPFLDEKAAPPPACPSIVNAKQLGLPSSKL

SEQ ID NO: 4876 - protein, 238 aa, Triticum aestivum
MNSTLFIIGVIGNIISVLVFISPIPTFWRIVRSRSTEDFEAAPYVLTLLNTLLWLYYGLTKPDGLLIATVNGFGAVMETIYLVLFLVYAADKGKRVKTAKLVAVLDIGFFGVVFAATTFAIGGLDIKIMVIGLICACLSVFMYGSPLAAVRRVITSRSVEYMPFFLSFFLFPHGGVWATYAILDKDVFLGVPNGTGCFLGAIQLVIYAVYMNSRVASHSHGSDEPASLLSSEGSNLCS

SEQ ID NO: 4877 - protein, 330 aa, Triticum aestivum
MVSSTKGKVCVTGASGFLASWLIKRLLECGYHVIGTVRDPGNRKKVGHLWKLPGANERLQLVRADLLEEGSFDDAVMACEGVFHIASPVLGKSDSNCKEATLGPAINGTLNVLRSCKKSPFLKRVVLTSSSSAVRIRDETQQPELLWDETTWSSVPLCEKLQLWYALAKVFAEKAALDFAKENNIDLVTVLPSFVIGPSLSHELCTTASDILGLLQGDTDRFTSYGRMGYVHIDDVARSHILVYETPEARGRYLCSSVVLDNNELVGLLTKQFPVFPIPRRLSNPYGKQAYQLNTSKLQGLGLKFKGVQEMFNDCVESLKAQGHLLECPL

SEQ ID NO: 4878 - protein, 280 aa, Triticum aestivum
METYTTDDALTAMGFGKLQGLVLVYAGMGWVAEAMEVMLLSFVGPLIREEWKISAQDESLRSSVVFLGMLIGACGWGYVSDKYGRRTGLLLSTLFTTGMGFLSALSPNYLCLMALRFLVGVGLGGSHVYSSWFLEFVPAQNRGFWMIIFSFFWTIGTVLEASLAWIVVSTLTWRWLLALTAIPCFLLLPFFGITPESPRYLCAQNRISDATLVLERIAETNQATLPPGVLVYPRDGEVDHSTLTSEADHLLPLREKDCTDDDVISPKSGSAAALRSLLSR

SEQ ID NO: 4879 - protein, 329 aa, Triticum aestivum
MAFALKASASPALAAASSAASSPSFSAASAAPRGRAAAARRVSLRGAAHPVAAIRASATAVAGDKRTISGTFTNLKEQDKIAFIPFIVAGDPDLATTAKALKVLDACGSDVIELGVPYSDPLADGPVIKASATRALTKGTTFEDVISMVKEVVPELSCPLALFTYYNPILKRGVANFMSVVKEAGVHGLVVPDVPLEETDILRSEAAKNNLELVLLTTPTTPTERMERITKASEGFVYLVSTTGVTGTRANVSFKVEALLKEIKQVTDKAVAVGFGVSTPEQVKQIAGWGADGVIVGSAMVRQLGESGSPEEGLKKLEELAKSLKAAFP

SEQ ID NO: 4880 - protein, 177 aa, Triticum aestivum
  misc_feature (75)..(75): Xaa can be any naturally occurring amino acid
  misc_feature (106)..(106): Xaa can be any naturally occurring amino acid
KLKKNGQRSFNSAPYRADWGPTSHAPGPHGRGISVVPAEVDVPLEETDILRRELAKTNLELVLLTTPTTPTERMXELPKPSEGFVYLVSTTGVTGTRANVSFKVKXLLKEIKQVTDKAVAVGFGVSTPEQVKQIAGWGADGVIVGSAMVRRLGESGSPEEGLKKLEELAKSLKAAFP

SEQ ID NO: 4881 - protein, 344 aa, Triticum aestivum
GWHAPLPPTLRGLVGIAAAGRRRVTASVAPPRASPGGRAFRAVASGSGGRTTPESSSSSSPALPQLQPRRGLATRRAVLRNLISGGLESEDGKLSCGYSSFKGRRPTMEDRYDVKFAKMKGQSVSLFGVFDGHAGALAAEYLKEHLLDNLIEHPQFLRNPKLALKTTFLKTDADFLESVTTPYREDGSTALAAVLVGDQIYVANVGDSRAIALKGGKAIPLSDDHKPNLKDERTRIENAGGGVSYDGFTWRVDGILAMSRAFGNRSLKNYVIAEPDIQETQVSSDLEYLVLATDGLWDVVQNEDVISLMRATDEPEVAAVKLTEMAHSRHSSDNITCIVVGFHH

SEQ ID NO: 4882 - protein, 307 aa, Triticum aestivum
  misc_feature (244)..(244): Xaa can be any naturally occurring amino acid
  misc_feature (250)..(250): Xaa can be any naturally occurring amino acid
STSLHLFEFSDPRDADEPRDHLDGRDFDGSPMIDEFAKRAPRAHGRRGDRHPGGRGGDREYMGRGPPPGSGRCFNCGIDGHWARDCQAGDWKNRCYRCGDSGHIQRDCQNSPKNLKRGKSYSRSPSPRRGRVRDRSYSTSRSRSYSRSVSPRRDERRSRSPRDSRSPRRSPRDSRSPMKSPRGSRSPMRSPRDSRSPRRSASPVKGRARSPTPPGSRSPAPRENSRSPMKADSPNNMSPAANGXRSPSPXDGEDNGNHRAPMWKCLTWWSVEMDQNPFQCSPSGRASPGEGREMDHILPTVMKLKHV

SEQ ID NO: 4883 - protein, 242 aa, Triticum aestivum
SCPLPRLGFPPLRSRRMPRYDERDRYGGNTRLYVGRLPSRTRTRDLEDLFGRYGRVRHVDMKHEFAFVEFSDPRDADEARYNLDGRDFDGSRMIVEFAKGVPRGQGGGGDRDRGRGGDREYMGRGPPPGSGRCFNCGIDGHWARDCKAGDWKNRCYRCGDSGHIERDCQNSPKNLKRGKSYSRSPSPRRGRVRDRSYSRSPMKADSPNNMSPAANGRSPSPRDGEDNGNHRAPSGSASPGGG

SEQ ID NO: 4884 - protein, 330 aa, Triticum aestivum
  misc_feature (55)..(55): Xaa can be any naturally occurring amino acid
  misc_feature (178)..(178): Xaa can be any naturally occurring amino acid
MSRDRYGGNTRLYVGRLPSRTRTRDLEDLFGRYGRVRHVDMKHEFAFVEFSDPRXDADEARYNLDGRDFDGSRMIVEFAKGVPRGQGGGGDRDRGRGGDREYMGRGPPPGSGRCFNCGIDGHWARDCKAGDWKNRCYRCGDSGHIERDCQNSPKNLKRGKSYSRSPSPRRGRVRDRSXGRSRSRSYSRSVSPRRDERRSRSPRDSRSPRRSPRDSRSPRRSPRDSRSPRRSPRDSRSPMKSPRGSRSPMRSPRDSRSPRRSASPAKGRARSPTPPGSRSPAPRENSRSPMKADSPNNMSPAANGRSPSPRDGEDNGNHRAPSGSASPGGG

SEQ ID NO: 4885 - protein, 310 aa, Triticum aestivum
MGGRCFLNLLPCSTTPCKAGVGIGTPASSSCPNSVHHHRTRSARGPRRNAAARVSCSAAAAQAPPSQSTIKVVIVGATKEMGRAAIAALSGMDEALEIPVLNDLTMVLGSIAQTRATGVVVDFSEPSSVYDNVKQAAAFGLSSVVYVPKIEMDTVTELSAFCDKASMGCLVAPTLSIGSVLLQQAAIQASFHYNNVEIVESRPNPSDLPSPDAIQIANNISDLGQIYNRQDMDSDNPARGQVLGEDGVRVHSMVLPGLASSTSVVLSGPGEVYTLKHDVTDVQSLMPGLILAIRKVIRLKNLIYGLEKFL

SEQ ID NO: 4886 - protein, 156 aa, Triticum aestivum
  misc_feature (76)..(76): Xaa can be any naturally occurring amino acid
  misc_feature (113)..(113): Xaa can be any naturally occurring amino acid
  misc_feature (122)..(122): Xaa can be any naturally occurring amino acid
  misc_feature (126)..(126): Xaa can be any naturally occurring amino acid
  misc_feature (128)..(128): Xaa can be any naturally occurring amino acid
  misc_feature (134)..(134): Xaa can be any naturally occurring amino acid
  misc_feature (136)..(138): Xaa can be any naturally occurring amino acid
TSVAPFQGLKSTAGLPVSRRSNGASLGSVSNGGRIRCMQVWPIEGIKKFETLSYLPPLSTEALLKQVDYLIRSKWXCLASSQQVGFIFREHNASPGYYDGRYWTMWKLPMFGXTDATQVINXVEEXKXEYPDAXVXXXGKFREMVKILHGVARSGG

SEQ ID NO: 4887 - protein, 220 aa, Triticum aestivum
MSGGAAAGAAAAVSRFIKCVAVGDGAVGKTCMLICYTCNKFPTDYIPTVFDNFSANVSVDGSIVNLGLWDTAGQEDYSRLRPLSYRGADVFILSFSLTSRASYENVHKKWMPELRRYAPGIPVLLVGTKLDLREDRAYLADHAADSIITTEQGEELRRQIGAVAYIECSSKTQRNIKAVFDTAIKAVLQPQRHKEVARKEIRTRSSRSVRRYFCGSVCLA

SEQ ID NO: 4888 - protein, 147 aa, Triticum aestivum
SSKIVKFEGARRLAFKHIEAFVLTFSDPQMFSTAASSSGAAALSQVADALFIQEAGHLRCSRAEIARFVDTLRNPSSVLRACAAFALLQFTMPAGRHAVHHAALLQKAGASRVLRWAAAAATAPIEAKIFARIVLRNLELHQAGPST

SEQ ID NO: 4889 - protein, 126 aa, Triticum aestivum
AAASAFSVSTSSYNFVISPFLPSFCNAPYRSAFNGHLRCSRAEIARFVDTLRNPSSVLRACAAFALLQFTMPAGRHAVHHAALLQKAGASRVLRWAAAAATAPIEAKIFARIVLRNLELHQAGPSS

SEQ ID NO: 4890 - protein, 164 aa, Triticum aestivum
  misc_feature (64)..(64): Xaa can be any naturally occurring amino acid
  misc_feature (82)..(82): Xaa can be any naturally occurring amino acid
MAGRDRDPLVVGRVVGDVLDPFIRTTNLRVTFGNRTVSNGCELKPSMVAQQPRVEVGGNEMRTXFYTLVMVDPDAPSPSDPXNLREYLHWLVTDIPGTTGASFGQEVMCYESPRPTMGIHRFVLVLFLQLGRQTVYAPGWRQNFNTRDFAELYKLGPTVAAVYF

SEQ ID NO: 4891 - protein, 518 aa, Triticum aestivum
  misc_feature (117)..(117): Xaa can be any naturally occurring amino acid
  misc_feature (204)..(204): Xaa can be any naturally occurring amino acid
MAGGAVVNTSGGKDYPGRLTLFVFFTCVVAATGGLIFGYDIGISGGVTSMNPFLKKFFPEVYDKKQMKGSASQYCKYDNQLLQTFTSSLYLAALVSSFFAATVTRVVGRKWSMFTGXLTFLIGAALNGAAENIAMLIVGRILLGVGVGFANQSVPVYLSEMAPARLRGMLNIGFQLMITIGILAAALINYGTNKIKAGYGWSIXTWTLAAVPAGIITLGSLFLPDTPNSLIERGHPEAARRMLNRIRGSDVDISEEYADLVVASEESKLVQHPWRNILQRKYRPQLTMAIMIPFFQQLTGINVIMFYAPVLFETLGFKGDASLMSAVITGLVNVFATLVSVFTVDRLGRRKLFLQGGTQMLLSQLVVGTLIAVKFGTSGVGEMPKGYAAAVVLFICLYVAGFAWSWGPLGWLVPSEIFPLEIRPAGQSINVSVNMLFTFVIAQAFLTMLCHMKFGLFYFFAGWVVIMTVFIALFLPETKNVPIEEMVLVWKGHWFWRRYIGDADVHVGANNGKGAAIA

SEQ ID NO: 4892 - protein, 562 aa, Triticum aestivum
  misc_feature (124)..(124): Xaa can be any naturally occurring amino acid
  misc_feature (330)..(330): Xaa can be any naturally occurring amino acid
  misc_feature (371)..(371): Xaa can be any naturally occurring amino acid
  misc_feature (464)..(464): Xaa can be any naturally occurring amino acid
MLVLFETPAGFALFKVLDEGKLSSVEDLWKDFASSDKARKVVELKAFNKFENTSDALSAATLLIDSKPSKGLRKFLQKHCDGETLAVADSKLGNAIKEKLQIDCLHNSAVMELMRGLRNQLTEXLMSGLAEHDLGPMSLGLSHSLSRYKLKFSPEKVDTMIIQAIGLLDDLDKELNTYAMRVREWYGWHFPELTKIVADNIHYAKAVKMMGNRVNAVNLDFSEILPEEVEAELKEAAVISMGTEVNDLDLSNIRELCDQVLALSEYRAQLYDYLKSRMNTIAPNLTALVGELVGARLISHGGSLMNLAKQPGSTIQILGAEKALFRALKXTKHATPKYGLIYHASLIGQAAPKHKGKISRSLAAKSALAIXYDALADGDDNSMGLESRIKLETRLRVLEGKELGRSAGSTKGKPKIEAYEKDRKGGGALITPAKTYNSAADLVLGQTTEETPKKSEVASKKRKXQDEEPTAEAAEQDGEQEKEKSKKKKKKSKDIEETPAAVTDASEKKKKKKSKEAEDTPAANTDGEKKKKKKKSDAEDAPMEVDVSAKKEKKKKKKKADE

SEQ ID NO: 4893 - protein, 253 aa, Triticum aestivum
  misc_feature (42)..(42): Xaa can be any naturally occurring amino acid
GPKVMVPNEKLQLSEIVTNSEQQVHDTNTKSRVEDMWKEMNXGLPVKMPNPPTRPLKTVAKEKKTKATNNWMTILGLPPKKASANDQVPPNEQQQTQHKTSEDTKKLAANALAAVRDAATAASGRGKVEITEVRDFAGKDIEIKKLVDADSKEAVEKASAAGASPSAVDNILEQIRKKQKLSVLDKTKKDWGEYKAEKGVEEELGAYKKSSNQYLDRQSFLKRADYREYELERDARLSLMAKRKSESMQDDDV

SEQ ID NO: 4894 - protein, 148 aa, Triticum aestivum
GSKAMVADEKLPASGDANNSEQQLHDTDTNSRVEDMWKKMNSGLPAKMPKPAMVKLKTAAKEKKPKATNNWMTILGLPPKMASANDQVPKNEQQQTQHKTSEDAKKLAANALAAVRDAATAASGRGKVEIPEVRHFAGKDIEIKKLVD

SEQ ID NO: 4895 - protein, 190 aa, Triticum aestivum
  misc_feature (57)..(57): Xaa can be any naturally occurring amino acid
GSKAMVADEKLPASGDANNSQQQLHDTDTKSRVEDMWKKMNGGLPVKMPKPAMVELXTAAKEKKPKATNDWMTILGLPPKKASAHDQVPRNVQHQTQHETSEDAKKLAANALAAVTDAATAASGRGKVEITEVTDFAGKDIEIKKLVDADSKEAVEKASAAGASPSAVDNILEQIRKKQKLSVLDKTKKD

SEQ ID NO: 4896 - protein, 187 aa, Triticum aestivum
MLPAAMAAGLACSRPRSTIQHRRRTHRTSRVLVAGEEASKMAGRKGGDRKKAVTRSAKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKTTTKSPKKKAAAAKE

SEQ ID NO: 4897 - protein, 188 aa, Triticum aestivum
  misc_feature (120)..(120): Xaa can be any naturally occurring amino acid
MLPAAMAAGLAWSRPRSTIQHRRRTHRTSRVLVAGEEASKMAGRKAGDRKKAVTRSVKAGLQFPVGRIGRYLKKGRYAQRVGSGAPVYLAAVLEYLAAEVLELAGNAAKDNKKTRIIPRXHLLLAVRNDQELGRLLAGVTIAHGGVIPNINSVLLPKKSPAAAEKEAKSPKKKTTTKSPKKKAAAAKE

SEQ ID NO: 4898 - protein, 187 aa, Triticum aestivum
MLPAAMAAGLAWSRPRSTIQHRRRTHRTSRVLVAGEEASKMAGRKGGDRKKAVTRSAKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKTTTKSPKKKAAAAKE

SEQ ID NO: 4899 - protein, 116 aa, Triticum aestivum
  misc_feature (7)..(7): Xaa can be any naturally occurring amino acid
DVCFKQXMKAFADNITDWKNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 4900 - protein, 159 aa, Triticum aestivum
  misc_feature (72)..(72): Xaa can be any naturally occurring amino acid
  misc_feature (89)..(89): Xaa can be any naturally occurring amino acid
  misc_feature (100)..(100): Xaa can be any naturally occurring amino acid
  misc_feature (128)..(128): Xaa can be any naturally occurring amino acid
  misc_feature (138)..(138): Xaa can be any naturally occurring amino acid
MAPTVMASSATSVAPFQGLKSTAGLPVSRRSNGASLGSVSNGGRIRCMQVWPIEGIKNSETLSYLPPLSTEXLLKQVDYLIPSKWVLAXRFSKVGSSSRXAQPSPGYYDGRYWTCWNCYVPGALTHTXINEVEESRRXPDPIPHRFHKSQVHAHSPSTT

SEQ ID NO: 4901 - protein, 178 aa, Triticum aestivum
  misc_feature (100)..(100): Xaa can be any naturally occurring amino acid
  misc_feature (109)..(109): Xaa can be any naturally occurring amino acid
  misc_feature (131)..(131): Xaa can be any naturally occurring amino acid
  misc_feature (137)..(137): Xaa can be any naturally occurring amino acid
  misc_feature (149)..(149): Xaa can be any naturally occurring amino acid
MAPTVMASSATSVAPFQGLKSTAGLPVSRRSNGASLGSVSNGGWIRCMQVWPIEGIKKFETLSYLPPLSTEALLKQVDYLIRSKWVPCLEFNKVGFIFRXEHNASPGVXYNGRYWTMWKLPMFGCTDATQXINEVEXVKKGVPDAYVRXIGFQKMLKVQWRQLHPSNQPGAKESRQRP

SEQ ID NO: 4902 - protein, 329 aa, Triticum aestivum
  misc_feature (64)..(65): Xaa can be any naturally occurring amino acid
  misc_feature (97)..(97): Xaa can be any naturally occurring amino acid
  misc_feature (102)..(102): Xaa can be any naturally occurring amino acid
  misc_feature (124)..(124): Xaa can be any naturally occurring amino acid
  misc_feature (137)..(137): Xaa can be any naturally occurring amino acid
  misc_feature (157)..(157): Xaa can be any naturally occurring amino acid
MRAVAIASPGGPEVLEEREVEDLAAPGDGEVLLGLAAAGVNRTDTVQRQGGYPAPSGASPYPGXXCSGSILALGANVHPRWAVRDQVCALLAGGGYXRRWWXPAALLLPVPEGVSLTDAAGLPXVACTVWSNAFMTXSHLSPGESFLIHGGSSGIGXTLPYKMAKHLGIKVFVTAGSQEKLDACAGLGADVCINYKTEDFAACIKEETNGNGGDVILDNVGGSYLQRNLDSLAVDGRLFIIGFMGGSVTEVNLQAMLARRLTIQVAGLRSRSLANKAQIVSEVERNVWPAVASGNVKPVVYRTLPLSEAAEAHKLMESSSHIGKILLIP

SEQ ID NO: 4903 - protein, 289 aa, Triticum aestivum
  misc_feature (91)..(91): Xaa can be any naturally occurring amino acid
  misc_feature (96)..(96): Xaa can be any naturally occurring amino acid
  misc_feature (156)..(156): Xaa can be any naturally occurring amino acid
TENTALQKGDQGGFPFYGKGGGPPKANFIGAGFFGLEKPERVPIIGPKVSFTLEDSKLCCNPDPWGTFWICPWEEEEKEDDDAYSDYDEIXQDGRXREPEIICSHLDHVNMLGLSKTTLRLRYLIKWVGTSLLQLRLPDSGNGDGVPLVQIYGPKXIKYERGAAVAFNIKDCNTGTSLINPETVQKMAEKEALNVGVGFLSRIRLMDNQKHGVADVGLSSSLCRPTSNGRHEKKNSKNAIVGIEVVTASLGFLTNFDDVYRLWAFVAKFLDSSFLEQERLSSIPEDAER

SEQ ID NO: 4904 - protein, 285 aa, Triticum aestivum
  misc_feature (10)..(10): Xaa can be any naturally occurring amino acid
RFRDCVSVNXDDFVTDVESGDMLLVDGGMMSFLVKSKTEDSVKCEVIDGGELKSRGDLGAELPIEEVPLLQEEIIRMCRSMGKAVIVATNMLESMIVHPTPTRAEVSDIAIAVREGADAVMLSGETAHGKFPLKAVKVMHTVALRTEATIIGGETPSNLGQVFKNHMSEMFAYHSTMMSNTLGTSIVVFTRTGFMSILLSHYRPSGTIFAFTDQEIVRQRLALYQGVCPVHMEFSDCAEKTFADALSYLLKHGMVKEGEEVALVQSGRQPIWRSQSTHNIQVRKV

SEQ ID NO: 4905 - protein, 313 aa, Triticum aestivum
  misc_feature (24)..(24): Xaa can be any naturally occurring amino acid
LANFLPNVRSGGWSDIGSRQYMEXDTHVCIADLAKNFGYPTVDKEVVSFYGVFDGHGGKDAAHFVRDNLPRVIVEDADFPLELEKVVSRSFVQIDSQFADKCSHQRTLTLSSGTTALTAMIFGRSLLVANAGDCRAVLSRCGIAMEMSMDHRPCSLSEKLRVESLGGYVDDGYLNGLLGVTRALGDWHLEGMKEASRPGGGPLSAEPEIKLTTLTKDDEFLVIGSDGLWDVFSNQNAVDFARRRLQEHNDVKRCCREIVEEAIRRGATDNLTAVLVSFHLVAPPQIRVNQPRRVARSISADGLNSLRILLGSQ

SEQ ID NO: 4906 - protein, 81 aa, Triticum aestivum
MALGHELVHHGYSQSSKWSTDISPNLEWKLIYVGSAEDENYYQQFESVLVGPVNVGTYHFVLEVVERCRLGSGVVRSTTVQ

SEQ ID NO: 4907 - protein, 330 aa, Triticum aestivum
  misc_feature (139)..(139): Xaa can be any naturally occurring amino acid
MATGVGEARGETVLVTGASGFIGSWTVRLLLARGYDVHAAVLNPDDKAETEHLLALAGGDEGRVRFFPCDLLDGAAMLAAARGCSGVFHLASPCTVDRVLDPQKELVVPAVEGTLNVLRAAKEAGGVRRVVVTSSVSAXVPSPGWPAGEVLDERCWTDIDYCDKNGVWYPASKTLAEKAAWKFAEENGLDVVVVNPGTVLGPMIPPRINASMAMFLRLLEGCTEEYKDFFIGPVHVEDVALAHITLFENPSASGRHLCVEPICHWSDFASKVAELYPDYKVPKFPEDTQPGLVRAETVPKKLMALGLQFTPLEKIIRDAVESLRSRGCIA

SEQ ID NO: 4908 - protein, 114 aa, Triticum aestivum
  misc_feature (14)..(14): Xaa can be any naturally occurring amino acid
  misc_feature (48)..(48): Xaa can be any naturally occurring amino acid
KTFTLTPEQYVVKXLEQSGQTICISGFMAFDVPPPRGPLWILGDVFMXAYHTVFDFGENKIGFPNPPRVQRSRPVLYNTGNNCNFNNNFYRLIKGQMNTTFCIAVWLMDLKQTK

SEQ ID NO: 4909 - protein, 512 aa, Triticum aestivum
MDAASLLPFAIALVAIPISLALLDRLRLGRLPPGPRPWPVVGNLRQIKPVRCRCFQEWAERYGPIISVWFGSSLTVVVSTSELAKEVLKEHDQQLADRPRNRSTQRFSRNGQDLIWADYGPHYIKVRKLCNLELFTQKRLEALRSIREDEVTAMVESVHRAAAGPGNEGKPLVVRNHLAMVSFNNITRLAFGKRFMNANGDIDEEGQEFKIIVNNGIKIGASLSVAEYIWYLRWLCPLNEELYKTHNERRDRLTKKIIEEHAQALQERGAKQHFVDALFTLREKYDLSDDTVFGLLWDMITAGMDTTVISVEWAMAELVRNPRVQKKLQEELDSVVGRDRVMSETDFPNLPYLMAVVKESLRLHPPTPLMLPHKASASVKVGGYSIPKGANVMVNVWAVARDPKVWSSPLEFRPERFLEESIDIKGSDFRVLPFGAGRRVCPGAQLGINLVASMIGHMLHHFEWSLPEGARPEDISMMESPGLVTFMGTPLQAVATPRLENEELYKRVPVEI

SEQ ID NO: 4910 - protein, 269 aa, Triticum aestivum
  misc_feature (200)..(200): Xaa can be any naturally occurring amino acid
TRPSSSKHREAFEKEVAVWQKLDHPNVTKFVGASMGTSQLKIPAGKKGGSSHGPGQRCVVVVEYQHGGTLKTLLFQHRDKKLPYKKVVQLALDMARGLSYLHSQKIVHRDVKAENMLLDRKKSVKIADFGVARVEAQDDDNMTGQTGTLGYMAPEVLEGRPYDHKCDVYSFGVLLWETYCCALAYPNYSIADISYHVVKXGIRPDIPRCCPKPLSEIMTRCWDGNPDHRPEMAEVVAMLERIDTTKGKSMTPAVPDHTSQGCSCFGFSK

SEQ ID NO: 4911 - protein, 235 aa, Triticum aestivum
  misc_feature (166)..(166): Xaa can be any naturally occurring amino acid
  misc_feature (173)..(173): Xaa can be any naturally occurring amino acid
  misc_feature (179)..(179): Xaa can be any naturally occurring amino acid
  misc_feature (224)..(224): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQHIEDILLKVSAQXVPDSGPXVTYIGXGGSRNFGKMVQNGIEYGDMQLIGEGDEVLKAVGRLTNGGLEQVFXEWNKGKLLNFL

SEQ ID NO: 4912 - protein, 142 aa, Triticum aestivum
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPP

SEQ ID NO: 4913 - protein, 460 aa, Triticum aestivum
MNSLQSFLAVAPVKPAAAAARLPSSRRARVSACLATPAPAPTTPAAAASARRELSAASRAVMADEAKYIVGTYKRAQVVFVAGRGCKLYDIDGREYLDMAAGIAVNALGHGDPDVDAAAADQRGRLVHASNVGYTVPQVELAKRLVEASFADRAFFANSGTEANEAAIKFARKYQRVAHPNGDAPTEFMSFTNCFHGRTIGSLALTSKVQYREPFEPVMPGSTFVEYGNLEEAKKVIQSGKIAAVFVEPVQGEGGIHSATKEFLQGLRDACDEAGALLVFDEVQCGLGRTGYLWAHEVYGVVPDIMTLAKPLANGLPIGVALVTEKVAAAINYGDHGTTFGGGPFVCHAALATLDKIQKPGFLAEVTKKGEYFKQLLKTKLSGNPHVKEIRGAGLIVGIELDVPAGPLVDACLNAGVFLLTAGKGNVVRLVPALIVSEKELEQAAEVIRECLPALEASTS

SEQ ID NO: 4914 - protein, 363 aa, Triticum aestivum
MWWRAVARARRRIPGARPVSTAAAGKSGREVVVPRFGGPEVLQLRQGVPAPDLKPGEVLVRARAVSINPLDLRMRAGYGRCIFEPLLPLIIGRDISGEVAATGTSVSSFYIGQEVFGALHPTAIRGTCADYAVLSQDELTSKPSTLTHVEASAIPFAALTAWRALYGTAGISKGQRLLVLGGGGAVGLSAVQLAVAAGCSVSATCGAQSIEQVLAAGAEKAIDYATEDTESTVTGKFDAVLDTIGVAETERIGINLLRRGGHYMTLQGEAASLADRYGLYVGLPAATATLLKKQMQYRCSHGIEYWWTYMRADPDGLHEIQRLSGAGKLQIPVEKTFPISQVREAHEAKEKRLVPGKVVLEFD

SEQ ID NO: 4915 - protein, 269 aa, Triticum aestivum
  misc_feature (139)..(139): Xaa can be any naturally occurring amino acid
  misc_feature (146)..(146): Xaa can be any naturally occurring amino acid
MAAMNSDLGGLGPRPANAPPNPFESAMYGAGPGLIRTGLGAYGEKFLGSSSEFMQSNITQYLSDPQYYFQVNSQYVRNKLKVVLFPFFHRGHWTRITEPVGGRLSYKPPIQDINAPDLYIPLDGVWAPTLSLLGYALGXLGKVTPXEALTLQFTRGLVGWFLQVVLIKGLLYSLGSGEAPLLDIVAYAGYGFAGTSLAMLARIFWSYLYYFIMPWFCLCTGVFLVKTMKRVLLGGPRSYERHPSRNHYFLLFLAVVQFPMLFWLGNISG

SEQ ID NO: 4916 - protein, 297 aa, Triticum aestivum
  misc_feature (5)..(5): Xaa can be any naturally occurring amino acid
  misc_feature (194)..(194): Xaa can be any naturally occurring amino acid
AFSAXSPRWLSGGEKAKAIAVLEQIYDSGRLEEEVELLASASMHEFQSNCTGSYLDIFRLKELRLAFFAGAGLQAFQQFTGINTVMYYSPTIVQMAGFTSNRLALLLSLVVAAMNASGTIVGIYLIDRCGRRRLALTSLAGVVLSLVILATAFILQSSSSLCGSLFSGSCQGVLGWFAVGGLALYIAFFSPGMXPVPWAVTAEIYPEAYRGMCGGMSATVNWISNLIVAQTFLSIVGWVGTGPTFIIIAGIAVMALIFVALYVPETKGLSFEEVDLLWKERAWGSQGSHESLLGAAP

SEQ ID NO: 4917 - protein, 207 aa, Triticum aestivum
  misc_feature (21)..(22): Xaa can be any naturally occurring amino acid
  misc_feature (64)..(64): Xaa can be any naturally occurring amino acid
  misc_feature (189)..(189): Xaa can be any naturally occurring amino acid
  misc_feature (202)..(202): Xaa can be any naturally occurring amino acid
MVVNGRPLKKARTRAEASDFXXGFPAATDGGAVGTFREAVRGFLARHARLLPLPSIFSPAAGGXPRPHLLTWRVSLRVGEEGAEEDAGGCGVELNVVEEDVLRSRSVYCDQCRVVGWSGHPVCGKRYHFIIENDSIQMAGRRRTCCLRCGTPMAAAESGCLLCHFDMEGEELEECGYLHLDDSSHLLHXVVHANGYGHLLRXVNGRE

SEQ ID NO: 4918 - protein, 175 aa, Triticum aestivum
MAPTVMASSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4919 - protein, 143 aa, Triticum aestivum
  misc_feature (99)..(99): Xaa can be any naturally occurring amino acid
  misc_feature (111)..(111): Xaa can be any naturally occurring amino acid
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFXVSNNSSPGYYDXRYWTIVESCLCSGWNRTQTARLKRLEGRSKGP

SEQ ID NO: 4920 - protein, 138 aa, Triticum aestivum
  misc_feature (21)..(21): Xaa can be any naturally occurring amino acid
  misc_feature (80)..(80): Xaa can be any naturally occurring amino acid
  misc_feature (99)..(99): Xaa can be any naturally occurring amino acid
  misc_feature (102)..(102): Xaa can be any naturally occurring amino acid
  misc_feature (110)..(110): Xaa can be any naturally occurring amino acid
MAPAVMASSATTAAPFQGLKXTAGLPVSRRSCSAGLSSVSNGGRIRCMQVWPIEGIKKFETLSYLPPLSTEALLKQVDYXIRSKWVPCLEFSKVGFRLXREXNSSPRVLXTVRYWDKCGNCPIVRGCTDAKGCGWREV

SEQ ID NO: 4921 - protein, 162 aa, Triticum aestivum
  misc_feature (23)..(23): Xaa can be any naturally occurring amino acid
  misc_feature (80)..(80): Xaa can be any naturally occurring amino acid
  misc_feature (84)..(84): Xaa can be any naturally occurring amino acid
  misc_feature (88)..(88): Xaa can be any naturally occurring amino acid
  misc_feature (93)..(93): Xaa can be any naturally occurring amino acid
  misc_feature (96)..(96): Xaa can be any naturally occurring amino acid
  misc_feature (100)..(100): Xaa can be any naturally occurring amino acid
  misc_feature (103)..(105): Xaa can be any naturally occurring amino acid
  misc_feature (116)..(116): Xaa can be any naturally occurring amino acid
  misc_feature (126)..(126): Xaa can be any naturally occurring amino acid
  misc_feature (131)..(131): Xaa can be any naturally occurring amino acid
  misc_feature (134)..(134): Xaa can be any naturally occurring amino acid
  misc_feature (139)..(139): Xaa can be any naturally occurring amino acid
  misc_feature (146)..(146): Xaa can be any naturally occurring amino acid
  misc_feature (151)..(152): Xaa can be any naturally occurring amino acid
MAPAVMASSATTVAPFQGLKSTXAGLPVSRRSSGSLGSVSNGGRIRCMQVWPIEGIKKFETLSYLPPLSTEALLKQVDYXIRSXKWVXCLEFXKVXGFVXREXXXSPGLYNGRYWXQCWKLPIFGXPTPTXVLXNKVEXVKKGVPXPNVRXXGFKTPRGTTP

SEQ ID NO: 4922 - protein, 215 aa, Triticum aestivum
  misc_feature (78)..(78): Xaa can be any naturally occurring amino acid
  misc_feature (169)..(169): Xaa can be any naturally occurring amino acid
MAPAVMASSATTVAPFQGLKSTAGLPVSRRSCSAGLSSVSNGGRIRCMQVWPIEGIKKFETLSYLPPLSTEALLKQVXDYLIRSKWVPCLEFSKVGFVFREHNSSPGYYDGRYWTMWKLPMFGCTDATQVLNEVEEVKKEYPDAYVRVIGFDNMRQVQCVSFIAFRPPXCEESGQGLKVQVEVIDIHVMLVKFVGGSAFSVLLLLLICEYMSICM

SEQ ID NO: 4923 - protein, 174 aa, Triticum aestivum
MAPAVMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4924 - protein, 186 aa, Triticum aestivum
  misc_feature (85)..(85): Xaa can be any naturally occurring amino acid
  misc_feature (145)..(145): Xaa can be any naturally occurring amino acid
  misc_feature (170)..(170): Xaa can be any naturally occurring amino acid
MAPAVMASSATTVAPFQGLKSTAGLPVSRRSSGSLGRVSNGGRIRCMQVWPIEGIKKFETLSYLPPLSTEALLKQVDYLIRSKWXVPCLEFSKVGFRLPVKHNSSPRVLRRSILGQCGSCLCSGCTDATQVLNEVEGGQEGYPDXFRVIGFDNLRQVQCVSFIAFRPQVXRSPGKAKLQVETMAYV

SEQ ID NO: 4925 - protein, 190 aa, Triticum aestivum
  misc_feature (72)..(72): Xaa can be any naturally occurring amino acid
MAPTVMASSATSVAPFQGLKSTAGLPVSRRSSSAGLSSVSNGGRIRCMQVWPIEGIKKFETLSYLPPLSTEXLLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGQGLNYELKQWPMYEGLL

SEQ ID NO: 4926 - protein, 175 aa, Triticum aestivum
  misc_feature (63)..(63): Xaa can be any naturally occurring amino acid
MAPTVMATSVTSVAPFQGLKSTAGLPVSRRSSSAGLGSVSNGGRIRCMQVWPIEGIKKFETLXYLPPLSTEALLKQVEYLIRSKWVPCLEFSKVGFVFREHNSSPGYYDGRYWTMWKLPMCGCTDTTQVLKEVEDVKKEYPDAYVRVIGFDNLRQVQCVSFIAFRPPGCEESDKA

SEQ ID NO: 4927 - protein, 175 aa, Triticum aestivum
MAPTVMAASVTSVAPFQGLKSTAGLPVSRRSSSAGLGSVSNGGRIRCMQVWPIEGIKNFETLCDLPPLSTEALLNQVEYLIRSKWVPCLEFSKVGFVFREHNSSPGYYDGRYWTMWKLPMCGCTDTTQVLKEVEEVKKEYPDAYVRVIGFDNLRQVQCVSFIAFRPPGCEESDKV

SEQ ID NO: 4928 - protein, 100 aa, Triticum aestivum
  misc_feature (91)..(91): Xaa can be any naturally occurring amino acid
MAPTVMASSATSVAPFQGLKSTAGLPISRRSSSAGLSSVSNGGRIRCMQVWPIEGIKKFETLSYLPPLSTEALLKQVDYLIRSKWVPCLEXFTRLGFVFR

SEQ ID NO: 4929 - protein, 145 aa, Triticum aestivum
  misc_feature (90)..(90): Xaa can be any naturally occurring amino acid
  misc_feature (100)..(100): Xaa can be any naturally occurring amino acid
MAPAVMASSATTVAPFQGLKSTAGLPVSRRSGSAGLSSVSNGGRIRCMQVWPIEGIKKFETLSYLPPLSTEALLKQVDYLIRSKWVPCLXFNKVGFVFRXEHNNSPRATKNSILDKCGKLPNVRGATERKRKAQTKGWKAKKRYP

SEQ ID NO: 4930 - protein, 179 aa, Triticum aestivum
  misc_feature (91)..(91): Xaa can be any naturally occurring amino acid
  misc_feature (104)..(104): Xaa can be any naturally occurring amino acid
  misc_feature (133)..(133): Xaa can be any naturally occurring amino acid
  misc_feature (136)..(137): Xaa can be any naturally occurring amino acid
  misc_feature (144)..(144): Xaa can be any naturally occurring amino acid
  misc_feature (146)..(146): Xaa can be any naturally occurring amino acid
  misc_feature (151)..(151): Xaa can be any naturally occurring amino acid
MAPTVMASTATSVAPFQGLKSTAGLPVSRRSSSAGLSSVSNGGRIRCMQVWPIEGIKKFETLSYLPPLSTEALLKQVDYLIRSKWVPCLEXFSKVGFVFREHNXSSPGYYDGRYWTMWKAAYVRGGTDATQVXNEXXREVKKEXPXDAYVXVIGFRTGAKLRLIRFKGQPGLPKEWERA

SEQ ID NO: 4931 - protein, 138 aa, Triticum aestivum
  misc_feature (125)..(125): Xaa can be any naturally occurring amino acid
GTFVAPFQGLKSTAVLPISRRSSSAGLSSVSNGGRIRCMQVSPIEGIKKFETLSYLPPLSTEALLKQDDYLIRSKWVPCLEFSMVGFVFREHNSSPGYYDGRYWTMWKLPMFGCTDAIQVLNEVXEVKMEYPDSYVRL

SEQ ID NO: 4932 - protein, 160 aa, Triticum aestivum
  misc_feature (100)..(100): Xaa can be any naturally occurring amino acid
  misc_feature (113)..(113): Xaa can be any naturally occurring amino acid
  misc_feature (116)..(116): Xaa can be any naturally occurring amino acid
  misc_feature (118)..(118): Xaa can be any naturally occurring amino acid
  misc_feature (131)..(131): Xaa can be any naturally occurring amino acid
  misc_feature (134)..(134): Xaa can be any naturally occurring amino acid
PAVMASSATTVAPFQGLKSTAGLPVSRRSGSAGLSSVSNGGRIRCMQVWPIEGIKKFETLSYLPPLSTEALLKQVDYLIRSKWCPASIQQVGSVSVSTTXPRYYDGRYWDMWXLPXFXCTDQPSAQQVEEXRRXLTLAVQFDKQMLTHASGTARASKSIE

SEQ ID NO: 4933 - protein, 174 aa, Triticum aestivum
  misc_feature (23)..(23): Xaa can be any naturally occurring amino acid
MAPTVMASSATSGTPFQGLKSTXAGLPISRRSSSAGLSSVSNGGRIRCMQVWPIEGIKKFETLSYLPPLSTEALLKQVDYLIRSKWVPCLEFSKVGFVFREHNSCHGYYDGRYWTMWKLPMVWCTDATQVLNEVEEVKKEYPDAYVRVISIDNLRQVQCVSFIAFMPPGCEESG

SEQ ID NO: 4934 - protein, 141 aa, Triticum aestivum
  misc_feature (57)..(57): Xaa can be any naturally occurring amino acid
  misc_feature (85)..(86): Xaa can be any naturally occurring amino acid
  misc_feature (88)..(88): Xaa can be any naturally occurring amino acid
  misc_feature (90)..(90): Xaa can be any naturally occurring amino acid
  misc_feature (102)..(103): Xaa can be any naturally occurring amino acid
  misc_feature (107)..(107): Xaa can be any naturally occurring amino acid
  misc_feature (118)..(119): Xaa can be any naturally occurring amino acid
  misc_feature (124)..(125): Xaa can be any naturally occurring amino acid
  misc_feature (132)..(132): Xaa can be any naturally occurring amino acid
  misc_feature (135)..(135): Xaa can be any naturally occurring amino acid
MAPAVMASSATTVAPFQGLKSTAGLPVGRRSSGSLSSVSNGGRIRCMQVWPIEGIKXFETLSYLPPLSTGGLLKQVDYLDSLKVXXCXRXNKVGSSPVEHNXXPGYXDGRYWDKLELXXFRVEXXTQGAEQXEEXKKDTLP

SEQ ID NO: 4935 - protein, 131 aa, Triticum aestivum
  misc_feature (61)..(61): Xaa can be any naturally occurring amino acid
MAPAVMASSATTVAPFQGLKSTTGLPISRPSGSAGLSNVSNGGRIRCMQVWPIEGIKKFEXTLSYLPPLSKEALLKQVDYLIRSKWVPALSSAKVWASVFRGATTSPRVLTNGRITNVGNFPKVRGTGRQP

SEQ ID NO: 4936 - protein, 133 aa, Triticum aestivum
  misc_feature (34)..(34): Xaa can be any naturally occurring amino acid
  misc_feature (70)..(70): Xaa can be any naturally occurring amino acid
  misc_feature (91)..(91): Xaa can be any naturally occurring amino acid
  misc_feature (100)..(101): Xaa can be any naturally occurring amino acid
  misc_feature (103)..(104): Xaa can be any naturally occurring amino acid
MAPAVMASSATTVAPFQGLKSTAGLPVGRRSSGXLSSVSNGGRIRCMQVWPIEGIKKFETLSYLPPLSTXALLKQVDYLIRSKWVPCLEFXAKVGFVLRXXHXXSPGYNERGEYWDNVESWMRHLTPIHATER

SEQ ID NO: 4937 - protein, 175 aa, Triticum aestivum
  misc_feature (24)..(24): Xaa can be any naturally occurring amino acid
MAPAVMASSATTVAPFQGLKSTAXGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4938 - protein, 143 aa, Triticum aestivum
  misc_feature (58)..(58): Xaa can be any naturally occurring amino acid
  misc_feature (72)..(72): Xaa can be any naturally occurring amino acid
  misc_feature (82)..(82): Xaa can be any naturally occurring amino acid
  misc_feature (124)..(124): Xaa can be any naturally occurring amino acid
  misc_feature (142)..(142): Xaa can be any naturally occurring amino acid
MAPTVMASSATSVAPFQGLKSTAGLPVSRRSSSAGLSSVSNGGRIRCMQVWPIEGIKXFETLSYLPPLSTEXLLKQVDYLIXRSKWVPCLQFNKVGSFSRGAKQFPPGNTMGQYWAMWELPMFXGCTDATQVLNEWRRSKKXT

SEQ ID NO: 4939 - protein, 142 aa, Triticum aestivum
  misc_feature (100)..(100): Xaa can be any naturally occurring amino acid
  misc_feature (107)..(107): Xaa can be any naturally occurring amino acid
  misc_feature (115)..(115): Xaa can be any naturally occurring amino acid
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKGWLRLPXEHNSSPXYYDGRYWXTMWKLPMFGCNDATQVLSKWRSQRRIP

SEQ ID NO: 4940 - protein, 145 aa, Triticum aestivum
  misc_feature (60)..(60): Xaa can be any naturally occurring amino acid
  misc_feature (94)..(94): Xaa can be any naturally occurring amino acid
  misc_feature (119)..(119): Xaa can be any naturally occurring amino acid
  misc_feature (125)..(125): Xaa can be any naturally occurring amino acid
  misc_feature (130)..(130): Xaa can be any naturally occurring amino acid
  misc_feature (144)..(144): Xaa can be any naturally occurring amino acid
MAPAVMASSATTVAPFQGLKSTAGLPVSRRSSGSLGSVSNGGRIRCMQVWPIEGIKKFEXTLSYLPPLSTEALLKQVDYLIRSKWVPCLEVQQXGFVFREAKQLPPGTTTVDNGTMWKXLPMFGXCNDPXKVLKQVEGRSKKEXP

SEQ ID NO: 4941 - protein, 175 aa, Triticum aestivum
  misc_feature (169)..(169): Xaa can be any naturally occurring amino acid
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGXEESGKA

SEQ ID NO: 4942 - protein, 175 aa, Triticum aestivum
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4943 - protein, 175 aa, Triticum aestivum
MAPTVMASSATSVAPFQGLKSTAGLPVSRRSSSAGLGSVSNGGRIRCMQVWPVEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4944 - protein, 174 aa, Triticum aestivum
MAPAVMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4945 - protein, 174 aa, Triticum aestivum
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4946 - protein, 140 aa, Triticum aestivum
  misc_feature (117)..(117): Xaa can be any naturally occurring amino acid
  misc_feature (129)..(129): Xaa can be any naturally occurring amino acid
MAPTVMASSATSVAPFQGLKSTAGLPISRRSSSAGLSSVSNGGRIRCMQVWPIEGIKKFETLSYLPPLSTEALLKQVDYLIRSKWVPCLEFSKVGIVFREHNSSPGYYDGRYWTMWXLPMFGCTDATQXLNEVEEARRST

SEQ ID NO: 4947 - protein, 161 aa, Triticum aestivum
  misc_feature (91)..(91): Xaa can be any naturally occurring amino acid
  misc_feature (106)..(106): Xaa can be any naturally occurring amino acid
MAPTVMASSATSVAPFQGLKSTAGLPVSRRSSSAGLSSVSNGGRIRCMQVWPIEGIKKFETLSYLPPLSTEALLKQVDYLIRSKWVPCLEXFSKVGFVFREHNSSXPGYYDGRYWDNVGKLAMFRGGTTLQKVLKRRWGGVKERSNLNAYVPRHRVSNLQG

SEQ ID NO: 4948 - protein, 175 aa, Triticum aestivum
  misc_feature (24)..(24): Xaa can be any naturally occurring amino acid
MAPAVMASSATTVAPFQGLKSTAXGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4949 - protein, 175 aa, Triticum aestivum
  misc_feature (71)..(71): Xaa can be any naturally occurring amino acid
MAPAVMASSATTVAPFQGLKSTAGLPVSRRSSGSLGSVSNGGRIRCMQVWPIEGIKKFETLSYLPPLSTEXALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 4950 - protein, 532 aa, Triticum aestivum
MRSPSGARPSSGGGAAADDDFAFYYSFFQDAAAASPLPLALDGAAMPNNRRRKRGGDDDSAAAPIKDGSNNGRKRSIATIITSLAALEAEGHADSAGAADASRRELALLESNADNKSQAMMDYFAKMEGSFDADADSEAAARSKRSRLSASAAAVAVVAGEEAATNTAASASPPRAGHHQRRLWVKDRSQAWWDQCNSPDFPEAEFRRAFRMGRETFDMICEALGSAVAKEDTMLRAAIPVRQRVAVCIWRLATGEPLRLVSKRFGLGISTCHKLVLEVCGAIKSVLMPRFLQWPDEAAAGRFKEGFERSFGVPGVIGAMYTTHIPIIAPKISVAAYFNRRHTERNQKTSYSITLQGVVGPDRAFTDVCIGWPGSMPDDQVLEKSMLHQRAAAGMMHDACLVGGASYPLMDWVLVPYTHQNLTWTQHAFNEKVGDIRNVAVEAFARLKTRWACLQKRTEVKLQDLPVVLGACCVLHNICEMRREELEPEVPFALFDDDTTPETPVRSETAKQERDSIAHNLLHRGFAGTTFF

SEQ ID NO: 4951 - protein, 378 aa, Triticum aestivum
  misc_feature (12)..(12): Xaa can be any naturally occurring amino acid
EEFGTRLQAPSXSMGIGTTNSRNLSQMLSQHLRPTAEPNPLRRWYRRASYFLEDNWRRCWVILLWLSICGGLFTWKFMQYREPARGKVMGYCVCVAKGGAETLKFNMALILLPVCRNTITWFRNRTAAGRFVPFDDNINFHKVIAAGISVGAGLHIISHLTCDFPRLLHATEEEYEPMKPFFGDDQPPNYWWFVKGTEGWTGLVMLALMAVAFTLATPWFRRGRVRLPGPLSRLTGFNAFWYTHHLFIIVYALLIVHGHFLYLTKKWQKKSTWMYLAVPMVMYACERLTRALRSSVRPVKILKVAVYPGNVLSLHLSKPQGFRCKSGQYIFVNCAAVSPFQWHPFSITSAPHDDYISVHIRTLGDWTREPQSVFEKVC

SEQ ID NO: 4952 - protein, 609 aa, Triticum aestivum
  misc_feature (12)..(12): Xaa can be any naturally occurring amino acid
EEFGTRLQAPSXSMGIGTTNSRNLSTRLSQHLRPTAEPNPLRRWYRRASYFLEDNWRRCWVILLWLSICVGLFTWKFMQYRERAVFKVMGYCVCVAKGGAETLKFNMALILLPVCRNTITWFRNRTAAGRFVPFDDNINFHKVIAAGISVGAGLHIISHLTCDFPRLLHATEEEYEPMKRFFGDDQPPNYWWFVKGTEGWTGLVMLVLMAIAFTLAMPWFRRGRLSLPKPLNRLTGFNAFWYSHHLFVIVYALLIVHGHFLYLTKKWQKKSTWMYLAVPMVMYACERLTRALRSSVRPVKILKVAVYPGNVLSLHFSKPQGFRYKSGQYIFVNCAAVSPFQWHPFSITSAPQDDYVSVHIRTLGDWTRELKNVFSKVCRPPTEGKSGLLRAEYDRDVGAMSNPSFPKVLIDGPYGAPAQDYKQYDIVLLVGLGIGATPMISIIKDIINNMKRLEGDVESGNPGDASTSASFRTRRAYFYWVTREQGSFEWFRGVMDEIAESDKKSVIELHNYCTSVYEDGDARSALIAMLQSLNHAKNGVDIVSGTRVKTHFARPNWRNVYKRIALNHREQRVGVFYCGAPVLTKELRDLAQDFSRKTNTKFEFHKENF

SEQ ID NO: 4953 - protein, 262 aa, Triticum aestivum
  misc_feature (67)..(67): Xaa can be any naturally occurring amino acid
MPNVKSAAGAGAIPAGSSVGDGEVEAGFAKLQGEDFEYYMQTYSIMLGRNSKKSTVDVDLSSLGGGXMNISRHHARIFYDFQRRRFALDVIGKNGCLVEGVLHLPGNPPVKLDSQDLLQIGDKKFYFLLPTRSIFASFAARQAPVIPPQIPPLAYARPGHPRVPDFHDRFSEGDYGRDSDDIGNGVGEGGMKGQLRPRSLPEIWTLWWAQNHVEALEHWVKPQIPNKSGVKGCGQHHLKGKKGVRLLLEVVFNPVAPENGCL

SEQ ID NO: 4954 - protein, 428 aa, Triticum aestivum
VTSAPNIPRRLLKQSSENGAKAEDDPCGNTGLHENKHDANDSSKKEDPLLAVPGVLLLCCGLMLPCFHAERKEGRRQNTTSIQRNAVESLSSFDVSTSSDKIPPTPHRIPPSPSRFAPSPHIARVGSVDLSVQQILRATQNFSHSFKLGEGGFGTVYRAVLSDGQVVAVKRAKKDHFAGPSDEFSNEVELLAKIDHRNLVRLLGYTDKGNERIIITEYVPNGTLREHLDGQHGRTLDYNQRLEIAIDVAHALTYLHLYAEKTIIHRDVKSSNILLTDSYRAKVSDFGFARSGPSDTEKTHISTKVKGTAGYLDPEYLRTYQLTPKSDVFSFGILLVEIISARRPVELKRAAEERITIRWTFKKFNEGNMREILDPLLEDRVDEEVLEKLLSLAFQCAAPTREDRPTMKEVGEQLWEIRKEYGKSVRRA

SEQ ID NO: 4955 - protein, 123 aa, Triticum aestivum
  misc_feature (10)..(10): Xaa can be any naturally occurring amino acid
WGNSMGDLMXNVALAMNGGDGVQIAMSGCYAGPMFNTLAGLGISMLLGAWSTAPNSYVLPQDRSLIYTMSFLVAGLVWALVTLPRSGMRPNKTLGVGLIALYSVFLFIRVSSAMGILPLPGLN

SEQ ID NO: 4956 - protein, 68 aa, Triticum aestivum
RMSQDDANKGSSWSDIWGSPTRYQKNDEDTKERVKRAAAAARRWREYSRKGADRPPTFKLPEAASNQE

SEQ ID NO: 4957 - protein, 472 aa, Triticum aestivum
WPAWLSAVAGEAINGWTPRRADTFEKIDKIGQGTYSNVYKARDSLSGKIVALKKVRFDNLEPESVRFMAREILILRRLDHPNVMKLYGLVTSRMSCSLYLVFDYMVHDLAGLAASPDIKFTLPQVKCYVHQLLSGLEHCHNQGVLHRDIKGSNLLLDDDGVLKIADFGLASFFDPSHKQPMTSRVVTLWYRPPELLLGATDYGVGVDLWSAGCILAELLAGKPIMPGRTEVEQLHKIFKLCGSPAEEYWKKSKLPHATIFKPQQPYKRRIAETFKDFPQSALRLIETLLSIDPADRLTATAALNSDFFKTEPRACDPSSLPQYPPSKEMDAKRRDEEARRLRAAGSRPNGDGARKTRTRDRPRAVPAPEANAELQANIDKRRLITHANAKSKSEKFPPPHQDGALGYPLGCSNHMEPTFEPPDPSSFSTVFPYDKTAVPTWSGPLVDPPGGNQKRKHKSGRSSKQPSTARAR

SEQ ID NO: 4958 - protein, 389 aa, Triticum aestivum
  misc_feature (169)..(169): Xaa can be any naturally occurring amino acid
  misc_feature (185)..(185): Xaa can be any naturally occurring amino acid
  misc_feature (197)..(197): Xaa can be any naturally occurring amino acid
  misc_feature (215)..(215): Xaa can be any naturally occurring amino acid
MASATLLKSSFLPKKAEWGVARQVAAPRVSMVVRAGAYDDELVKTAKTIASPGRGILAMDESNATCGKRLDSIGLENTEANRQAFRTLLVSVPGLGNHISGAILFEETLYQSTVDGKKIVDILVEQGVVPGIKVDKGLVPLTGSNDESWCQGLDGLASREAAYYQQGAXRFAKWRTVVSIPNGPXSELAVKEAAWGXLARYAAISQDNGLVPIVXEPEILLDGEHGIERTFEVAQKVWAETFYQMAQNNVMFEGILLKPSMVTPGAECKDRATPEQVADYTLKLLSRRVPPAVPGIMFLSGGQSEVEATLNLNAMNQGPNPWHVSFSYARALQNTCLKTWGGRPENVKAAQEALLLRAKANSLAQLGKYTSDGEAAEAKEGMFVKNYSY

SEQ ID NO: 4959 - protein, 343 aa, Triticum aestivum
MPNVKSAGGAGASAIPAGGDGEVEAGFAKLQGEDFEYYMQTYSIMLGRNSKKSTVDVDLSSLGGGMNISRHHARIFYDFQRRRFALDGGGRHGGLVEGVLHLPGNPPVKLDSQDLLQIGDKKFYFLLPTRSIFASFAARQAPVIPPQIPPPAYARPGHPRVSDFHDRFSEGDYGRDSDDIGNGVGEGGMKGKLKRTKKSPGDLDIYGGHRINVEPIGTFGEDNRPEIRSRGDRDLDNQHILQSEEKEVVSSVATVLSDLCGPGQWMPMRALHAELVGRFGNVWHHSRVRKYLTWEDWSPIIAKGRPWFGLLELLRKHPEHFVINTKWKGREISEFVSLVSLLS

SEQ ID NO: 4960 - protein, 91 aa, Triticum aestivum
  misc_feature (3)..(3): Xaa can be any naturally occurring amino acid
  misc_feature (21)..(21): Xaa can be any naturally occurring amino acid
  misc_feature (25)..(25): Xaa can be any naturally occurring amino acid
  misc_feature (31)..(31): Xaa can be any naturally occurring amino acid
  misc_feature (64)..(64): Xaa can be any naturally occurring amino acid
  misc_feature (68)..(68): Xaa can be any naturally occurring amino acid
  misc_feature (74)..(74): Xaa can be any naturally occurring amino acid
MSXSACPNRTQSPACNLKLKXAPYXDCPGGXALQGVTLVAIQPSHPEGSNAAMSAARNGAFISXAFDXPFKFAXPKALMKRRTYLLEMNGF

SEQ ID NO: 4961 - protein, 245 aa, Triticum aestivum
MGTGRLVFHLLLLSNVLLHALLATPAEGLVRIALKKRPVDENGVVLVAGRLTGDDAEAKGHVVALKNYHNAQYHGEIGIGTPPQNFTVIFDTGSSNLWVPSSKCFLSIACYFHASYKAKRSSTYKKNGKIVAIQYGTGAISGYVSQDNVQVGDVVVKNQDFIEATMEPSITFMVAKFDGIFGLGFKEISKGDVVPVWYNMVSQGLVSSPIFSLWLNRHAGEGQGGQIVFGGIDPNHHNGDHTYVP

SEQ ID NO: 4962 - protein, 171 aa, Triticum aestivum
HEMLKGVTPELSCPIVLFTYYNPILKRGVGNFMSTIKQAGIHGLVVPDLPLEETALLRSEAIMHNIELVLLTTPTTPTDRMKGIAQASEGFLYLVSAVGVTGARSNVNLRVEHLLREIKKVTDKPVAVGFGVSTPEHVKQIVGWGADGVIVGSAIVKQLCEAATPEEGLER

SEQ ID NO: 4963 - protein, 274 aa, Triticum aestivum
  misc_feature (7)..(7): Xaa can be any naturally occurring amino acid
  misc_feature (167)..(167): Xaa can be any naturally occurring amino acid
  misc_feature (234)..(234): Xaa can be any naturally occurring amino acid
  misc_feature (243)..(243): Xaa can be any naturally occurring amino acid
YDPRFRXNFDDILAQSDAFMVARGDLGMEIPVEKIFYAQKVMIFKCNIQGKPVVTATQMLESMIKSPRPTRAEATDVANAVLDGTDCVMLSGETAAGAYPELAVQTMAKICLQAESCVDYSAVFKSIMSSAPIPMSPLESLASSAVRTANSAKATLILVLTRGRTTXARLVAKYRPSMPIRYHPIFVVVPELKTVEFDWICSDEGPARQSLIVRGVIPMRSAGTAKAFDSEATXEEALRFAIXNAKEMGLCNAGESIVALHRIGNASVIKLLTV

SEQ ID NO: 4964 - protein, 207 aa, Triticum aestivum
  misc_feature (55)..(55): Xaa can be any naturally occurring amino acid
  misc_feature (68)..(68): Xaa can be any naturally occurring amino acid
LAWSRPRSRAEATDVANAVLDGTDCVMLSGETAAGAHPELAVQTMAKICLQAESXCVDYSAVFKSIMXSAPIPMSPLESLASSAVCTANSAKATLILVLTRGGTTARLVAKYRPSMPILSVVVPELKTVEFDWICSDEGPARQSLIVRGVIPMLSAGTAKAFDSEATEEALRFAMKNAKEMGLCNAGESIVGLHRIGNASVIKLLTV

SEQ ID NO: 4965 - protein, 479 aa, Triticum aestivum
  misc_feature (237)..(237): Xaa can be any naturally occurring amino acid
  misc_feature (240)..(240): Xaa can be any naturally occurring amino acid
  misc_feature (246)..(246): Xaa can be any naturally occurring amino acid
  misc_feature (252)..(252): Xaa can be any naturally occurring amino acid
MGRAFVYVVLGGGVAAGYAALEFARRGGYSRGELCIISEEAVAPYERPALSKGYLLPEDPSRLPKFHTCVGANDELLTTKWYKEQGIELVLGTRVISADVRRKTLLTATGETISYKTLIIATGARALKLEEFGISGSDAANICYLRNLEDADKLVNAMSSCSGGNAVVIGGGYIGMECAAALVTNKIKVTMVFPEKHCMGRLFTEKIADYYESYYTLKGVTFTKGTVLTSFEKDSTXEGXLSVISXKMGNHXLPADMGVVGIGIRANTSLFEGQLLMEKGGIKVNGQMQTSDSSVYAVGDVAAFPIKLFDGDIRRLEHVDSARRTARHAVAAILEPSKSRDVDYLPFFYSRVFTLSWQFYGDNVGEVIHYGDFTSNSPRFGAYWVSKGQITGAFLEGGDRDDYEALSVVVWRKTKVSDMSELERQGLAFAIQESKKDVPDSGVTLGEKPTFVWYATAGVVAAVSISAFGYWYGRKRRRW

SEQ ID NO: 4966 - protein, 239 aa, Triticum aestivum
VNKKTGKEGRRRSIPHRIALGLEHSSFSPLLGEEEEEEDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVRAAIKVKASVIICFTSSGRAARLIAKYRPTMP

SEQ ID NO: 4967 - protein, 528 aa, Triticum aestivum
  misc_feature (403)..(403): Xaa can be any naturally occurring amino acid
MHSTNLLLEEPIRMVSILEPSKPNFFPAMTKIVGTLGPKSRSVEAISACLKAGMSVARFDFSWGDAAYHQETLENLKLAIKATKKLCAVMLDTVGPELQVVNKSEVTISLEENESVVLTPHQGQEASSKLLPINFAGLAKAVKPGATIFVGQYLFTGSETTSVWLEVSEVQGDDVVCVIKNSATLAGSLFTLHCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKRTVKYVGEPMTHLESIASSAVXRAAIKVKASVIICFTSSGRAARLIAKYRPTMPVLSVVIPRLKTNQLKWSFTGAFEARQSLIVRGLFPMLADPRHPAESTSTTNESVLKVALDHGKASGVIKSHDRVVVCQKVGDSSVVKIIELDD

SEQ ID NO: 4968 - protein, 76 aa, Triticum aestivum
KGLIVSDVPYAETCPFRNEAIKNNLELVLLTTPATPAERMKKITSASEGFVYLVSVNGVTGPRPNVNPRVKDLLKE

SEQ ID NO: 4969 - protein, 294 aa, Triticum aestivum
MVEAPEMSAPLLAGRPAAVEAVPPWREQLTVRAIVVSALLGVLFCLVTHKLNLTVGIVPSLNVAAGLLGYFLVRIWTAALGMFGIVSKPFTKQENTVIQTCVVACYGLAISGGFGSYMLAMDQKTYELIGTDYPGNTAVDVKNPSLSWMIGFMFLVSFIGIFSLVALRKVMVIDYKLTYPSGTATAMFINSVHAATGVELVEKQVSCLGKYLSISFLWNCFKWFFSGVGDSCGFDNFPSLGLAAFKNTFYFDFSPTYIGCGLICPHIVNCSALLGAIISWGFLWPYISTKKIRA

SEQ ID NO: 4970 - protein, 406 aa, Triticum aestivum
  misc_feature (204)..(204): Xaa can be any naturally occurring amino acid
  misc_feature (213)..(213): Xaa can be any naturally occurring amino acid
  misc_feature (252)..(252): Xaa can be any naturally occurring amino acid
  misc_feature (303)..(303): Xaa can be any naturally occurring amino acid
  misc_feature (344)..(344): Xaa can be any naturally occurring amino acid
MDGLVAFSRRRRRWLLLAALGTASAYGAYKIYHLPAVAARRRRLVRLAAALAAFLDAAASSADAAALVSSDLADFVRSDSDELPRSVAQLAKLAASPEVSATVSALSHPIAAGVLRGVGSAPGPGSGDKVALTDRLVDKLFSDSGERLASAVAGSFARHLVMAFYSGPSPPGQTSSSPDWVNVVATGKGHKGISRWVEGLGAPXVGVVIDRTXHLHPYEQVLEGGPHSTQPGQGHGLACSRFATAAGGDLVXTLHQVFSTPSGGLKSGNLAPPHQPLAGPGRRSRHAPGPAVWRPSFSHVCLXPPNRPCAFRCRGRVTLPLSCSKSGESRGRHNGERKNGNKRXAAGCATVRYMSDKSMVSNTICIALRLHVINGTGLLVNTWAGSQQGRGFSLVVWARCICTNHR

SEQ ID NO: 4971 - protein, 503 aa, Triticum aestivum
MVAPAAIPQRQLFIDGDWRAPALGRRLPVINPTTEVTIGEIPAGTSEDVDAAVAAARAALKRNRGRDWSRAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASVTCLELGDVCKEIGLPSGVLNIVTGLGHEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGEGGIDNYLSIKQVTEYTSDAPWGWYKAPAN

SEQ ID NO: 4972 - protein, 176 aa, Triticum aestivum
  misc_feature (136)..(136): Xaa can be any naturally occurring amino acid
PNLREALWPSLEEARTKILSIWDQADIVKVSEVELEFLTGINSVEDDVAMKLWRPTFKLMLVTLGDQGCKYYTKDFRGTVPSYKVQQVDTTGAGDAFIGSLLRKIVQDPSALQDKTKLEGAIKFANACGAITATKXKGAIPSMPKENKCCRLMEKALDPLMIPITSNLQLYGNRSG

SEQ ID NO: 4973 - protein, 149 aa, Triticum aestivum
ARTKILSIWDQADIVKVSEVELEFLTGINSVEDDVAMKLWRPTFKLMLITLGDQGCKYYTKDFRGAVPSYKVQQVDTTGAGDAFIGSLLRKIVQDPSALQDKTKLEGAIKFANACGAITATKKGAIPSLPKEDEVFRLMEKRRPAYDFQ

SEQ ID NO: 4974 - protein, 317 aa, Triticum aestivum
  misc_feature (247)..(247): Xaa can be any naturally occurring amino acid
  misc_feature (254)..(254): Xaa can be any naturally occurring amino acid
  misc_feature (262)..(262): Xaa can be any naturally occurring amino acid
  misc_feature (277)..(277): Xaa can be any naturally occurring amino acid
  misc_feature (284)..(284): Xaa can be any naturally occurring amino acid
  misc_feature (290)..(291): Xaa can be any naturally occurring amino acid
  misc_feature (300)..(302): Xaa can be any naturally occurring amino acid
MAGGGELVVSFGEMLVDFVPTVAGVSLAEAPAFLKAPGGAPANVSIAVARLGGEAAFVGKLGDDEFGRMLAAILRDNGVDDGAVVFDAGARTALAFVTLRADGEREFMFYRNPSADMLLTADELNVDVIKRAAVFHYGSISLIAEPCRSAHLRAMEVAKEAGALLSYDPNLREALWPSLEEARTKILSIWDQADIVKVSEVELEFLTGINSVEDDVAMKLWRPTFKLMLVTLGDQGCKYYTKDFRGXVPSYKVXQVDTTGAXGDAFMGSLLRKLSNXSALQDKXKLEGAXXCNACGASRXXXGHFHPSGSDFIVFKH

SEQ ID NO: 4975 - protein, 229 aa, Triticum aestivum
MMKYLSSQIFRQASSIKQVKARQIFDSRGNPTIEADVITDLGVFRAAVPSGASTVKYEALELRDGNKAEYMGKGVTKAVKNVLDVISPALKGWDPVRQTDIDNLMVKELDGTSNEFGYCKNKLGANAILSVSLAVARAGAAARNVPLYEHVKSLTQLKGKSKYVLPTPSFNVINGGKHGGNGLAMQEFMILPTGATSFTHAMRAGSEVYHHLMKIIKKKYGLKCYNVGD

SEQ ID NO: 4976 - protein, 156 aa, Triticum aestivum
MDVSGAAAKGKKGAAGRKAGGPRKKSVTRSVKAGLQFPVGRIGRYLKKGRYAPRVGTGAPVYLAAVLEYLAAELLELAGNAAKDNKKSRIIPRHLLLAVRNDEELGKLLAGVTIAHGGVIPKINPVLLPKKTAEKEGKEPKSPKKAAKSPKKATKA

SEQ ID NO: 4977 - protein, 155 aa, Triticum aestivum
MDVSATGAGAKAKKGAAGRKAGGPRKKSVSRSVKAGLQFPVGRIGRYLKKGRYAQRVGTGAPVYLAAVLEYLAAELLELAGNAAKDNKKSRIIPRHLLLAVRNDEELGKLLAGVTIAHGGVVPKINPVLLPKRTAEKVPKEGKSPKKAAKSPKKA

SEQ ID NO: 4978 - protein, 565 aa, Triticum aestivum
MLSRLAARRPRPGSARAAAYRSSAAASSSVLPDALDRSSDAYARNAAAVGGLLSDLRSRVSQVLGGGGAGAVKRNEGRGKLLPRDRIDRLLDPGASFLELSQLAGSDVYEEALPSGGIITGIGPVHGRLCMFVANDPTTKGGTYYPITVKKHLRAQEIASECKLPCIYLVDSGGANLPKQAEVFPDRDNFGRIFYNQAKMSADGIPQIAVVLGSCTAGGAYIPAMADESIIVKGNGTIFLAGPPLVKAATGEEISAEDLGGASVHCKVSGVSDHFAQDERHGLALGRNIVKNLHLAAKETSIHNSACDYQEPLYDVQELRSIAPADTKQSFDIRSIIARIVDGSEFDEFKKLYGTTLVTGFARICGQPVGIIGNNGILFTESALKGTHFIELCAQRNIPLIFLQNISGFMVGSKSEASGIAKAGAKMVMAVSCSKVPKITIIVGGSFGAGNYGMCGRAYSPNFLFMWPTARISVMGGIQAAGVLAQIEKNNRKRQGVEWTKDDEEAFKAKVVEAYDKEGSPYYSTARLWDDGIIDPADTRRVLSLCLSASAKPVPEDTKYGVFRM

SEQ ID NO: 4979 - protein, 158 aa, Triticum aestivum
  misc_feature (101)..(101): Xaa can be any naturally occurring amino acid
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAXRNDEELGKLLAGVTIAHGGVIPKINPVLLPKRTAEKEGKEPKSPKKATKSPKKTTKA

SEQ ID NO: 4980 - protein, 457 aa, Triticum aestivum
  misc_feature (360)..(360): Xaa can be any naturally occurring amino acid
MAAFVLFLCLLVPLVLACAVRARKKGAGGRSSSGGGGGKKGGSSSLPLPPGSMGWPYVGETTQLYSSKNPNVFFARKRNKYGPIFKTHILGCPCVMVSSPEAAKFVLVTQAHLFKPTFPASKERMLGPQAIFFQQGDYHAHLRRLVSRAFSPEAIRGSVPAIEAIALRSLGSWEDLQVNTFQEMKTYALNVALLSIFGEEEMQYIEELKQCYLTLEKGYNSMPVNLPGTLFHKAMKARKRLGAIVAHIISARRERERGSDLLGSFMDGREALTDDQIADNAIGVIFAARDTTASVLTWMVKFLGDNPAVLKAVTEEHAEIAREKALSGEALSWADTRRMRLTGRVIQETMRVASILSFPXFRNIHHNPDHFPSPEKFDPSRFEVAPKPNTFMPFGNGTHSCPGNELARLEMLVLCHHLATKYRWSTSKSESGVQFGPFALPINGLPMTFTRKDKNKA

SEQ ID NO: 4981 - protein, 158 aa, Triticum aestivum
MDVSGTGAGAKGKKGAAGRKAGGPRKKSVTRSVKAGLQFPVGRIGRYLKKGRYAQRVGTGAPVYLAGVLEYLAAELLELAGNAAKDNKKSRIIPRHLLLAVRNDEELGKLLAGVTIAHGGVIPKINPVLLPKRTAEKEGKEPKSPKKTTKSPKKTTKA

SEQ ID NO: 4982 - protein, 425 aa, Triticum aestivum
  misc_feature (371)..(371): Xaa can be any naturally occurring amino acid
  misc_feature (393)..(393): Xaa can be any naturally occurring amino acid
FSLVALRKVMVIDYKLTYPSGTATAMLINSFHTTSGAELAEKQVSCLGKYLSISFVWNCFKWFFSGVGDSCGFDNFPSLGLAAFKNTFYFDFSPTYIGCGLICPHIVNCSTLLGAIISWGFLWPYISTKAGEWYPAGLGSNDFKGLYGYKVFISVSVILGDGIYNLIKIIYATIKEIMNARSKQGRLPLVRAQDDDESSELSSEEKLLNDVFVKDSIPPWLAGSGYVGLAAISTATVPMMFSQLKWYLVLSAYVVAPLLAFCNSYGTGLTDWNLASTYGKIGLFIFASWVGQHGGVIAGLAACGVMMSIVSTAADLMQDFKTGYLTLSSPRSMFVSQLIGTALGCVIAPLTFWLYWAAFDIGNPDGMFKAXPYAAIFREMAILGVEGFSGLPXHCLAICSFFFFCAYDTLRVSEVSSSCSVLNDY

SEQ ID NO: 4983 - protein, 290 aa, Triticum aestivum
FSLVALRKVMVIDYKSAYPSGTATAMLINSFHTTSGAELAEKQVSCLGKYLSISFVWNCFKWFFSGVGDSCGFDNFPSLGLAAFKNTFYFDFSPTYIGCGLICPHIVNCSTLLGAIISWGFLWPYISTKAGEWYPAGLGSNDFKGLYGYKVFISVSVILGDGIYNLIKIIYATIKEIMNARSKQGRLPLVRAQDDDESSELSSEEKLLNDVFVKDSIPPWLAGSGYVGLAAISTATVPMMFPQLKRYLSLSAYVGGPLLAFCNLYGTGLTDWNLAFTYGKDGPFIFALWV

SEQ ID NO: 4984 - protein, 232 aa, Triticum aestivum
  misc_feature (56)..(56): Xaa can be any naturally occurring amino acid
  misc_feature (129)..(129): Xaa can be any naturally occurring amino acid
  misc_feature (154)..(154): Xaa can be any naturally occurring amino acid
  misc_feature (211)..(211): Xaa can be any naturally occurring amino acid
RSFAPTVNDVFEALELLKSAIHSAGHDGIMQIGMDIAASEFYNETTKKYDLHFKDXKLSKSVPHLSSSELYNVYAKYVEQYPIVSIEDPFDQDDWDGYQHMTSQLGNKVQIVGDDLLVTNPKRIATGIXRKSCTALLLKVNQIGTLTESIEAYXQSKKNNWGVMVSHRSGETEDSFIADLVVGLSTGQIKTGAPSRSERLAKYNQLLRIEXELGDRGVYAGKNFRFPYKLIE

SEQ ID NO: 4985 - protein, 324 aa, Triticum aestivum
MEAETAAKRARENEGAAAADGAGEQAGISAVIPGWFSEISPMWPGEAHSLKVEKVLFQGKSDYQDVLVFQSSTYGKVLVLDGVIQVTERDECAYQEMITHLPLCSIKDPKKVLVIGGGDGGVLREVSRHSSVEQIDICEIDKMVVDVSKQFFPHLALGFEDPRVSLHIGDGVAFLKNAPEGTYDAVIVDSSDPVGPAQELFEKPFFESVSRALRPGGVVCTQAESIWLHMHIIEDIVTNCRQVFKGSVNYAWTTVPTYPSGVIGFMLCSTEGPSVDFQHPVFSIEEDEYSTKSKGPLKFYNSEFHTASFCLPSFARRVIEAKAN

SEQ ID NO: 4986 - protein, 323 aa, Triticum aestivum
  misc_feature (71)..(71): Xaa can be any naturally occurring amino acid
  misc_feature (83)..(83): Xaa can be any naturally occurring amino acid
  misc_feature (103)..(103): Xaa can be any naturally occurring amino acid
MEAETAAKRARENEGAAAADGAGEQAGISAVIPGWFSEISPMWPGEAHSLKVEKVLFQGNSCYQDVPVYLXTTVPEGVLLDGXIQGPGGRVPYQEMITHLPLXQAKNPKKVLVIGGGDGGVLREVSRHSSVEQIDICEIDKMVVDVSKQFFPHLALGFEDPRVSLHIGDGVAFLKNAPEGTYDAVIVDSSDPVGPAQELFEKPFFESVSRALRPGGVVCTQAESIWLHMHIIEDIVTNCRQVFKGSVNYAWTTVPTYPSGVIGFMLCSTEGPSVDFQHPVFSIEEDEYSTKSKGPLKFYNSEFHTASFCLPSFARRVIEAKAN

SEQ ID NO: 4987 - protein, 324 aa, Triticum aestivum
MEAETAAKRARENEGAAAADGAGEQAGISAVIPGWFSEISPMWPGEAHSLKVEKVLFQGKSDYQDVLVFQSSTYGKVLVLDGVIQVTERDECAYQEMITHLPLCSIKDPKKVLVIGGGDGGVLREVSRHSSVEQIDICEIDKMVVDVSKQFFPHLALGFEDPRVSLHIGDGVAFLKNAPEGTYDAVIVDSSDPVGPAQELFEKPFFQSVSRALRPGGVVCTQAESIWLHMHIIEDIVTNCRQVFKGSVNYAWTTVPTYPSGVIGFMLCSTEGPSVDFQHPVFSIEEDEYSTKSKGPLKFYNSEFHTASFCLPSFARRVIEAKAN

SEQ ID NO: 4988 - protein, 239 aa, Triticum aestivum
  misc_feature (13)..(13): Xaa can be any naturally occurring amino acid
LTDWNLASTYGKXIGLFIFASWVGQHGGVIAGLAACGVMMSIVSTAADLMQDFKTGYFTLSSPRSMFVSQLIGTALGCVIAPLTFWLYWSAFDVGNPDGMFKAPYAVIFREMAILGVEGFSALPQHCLAICSFFFFAAIAINLLRDVTPDSVSKFIPLPMAMAVPFYIGAYFAIDMFVGTVILFVWERVNRKESEDFAGAVASGLICGDGIWSVPSAMLSIMRIDPPMCMYIKPSLTYG

SEQ ID NO: 4989 - protein, 192 aa, Triticum aestivum
  misc_feature (3)..(3): Xaa can be any naturally occurring amino acid
  misc_feature (5)..(5): Xaa can be any naturally occurring amino acid
  misc_feature (20)..(20): Xaa can be any naturally occurring amino acid
CCXTXADFLQDFRLVRYLSXPGPFFTLMDCSCCVIAPLTFWLYWSAFDVGNPDGMFKAPYAVIFREMAILGVEGFSALPQHCLAICSFFFFAAIAINLLRDVTPDSVSKFIPLPMAMAVPFYIGAYFAIDMFVGTVILFVWEKINRKESEDFAGAVASGLICGDGIWSVPSAILSIMRIDPPMCMYFKPSLA

SEQ ID NO: 4990 - protein, 394 aa, Triticum aestivum
IASVVGAALLLFLLICLCRRSGRTKTRALEMPPPSPSPAVIPGGRKPPELPSGAAVAPMATVGHPAGQSTSGKKLVFFGSAAAVQPFDLEDLLRASAEVLGKGAIGTTYKAVLESSATVAVKRLKDVTMSEPEFRERIADIGELQHEFIVPLRAYYYSKDEKLLVYDFMPMGSLSAVLHGNRGSGRTPLDWTIRSSIALAAARGIEYIHSTSSSTSHGNIKSSNILLSKSYQARVSDNGLATLVGSSSSGPSRASGYRAPEVTDPRRVSQKADVFSFGVLLLELLTGKAPSQAALNDEGVDLPRWVQSVVRSEWTAEVFDMELLRNQSSEEQMIQLLQLAIDCVAQVPDARPTMSHVVVRIEEIKMSGGSTEETDQQQSALNQGDEMVEGPSSP

SEQ ID NO: 4991 - protein, 172 aa, Triticum aestivum
  misc_feature (109)..(109): Xaa can be any naturally occurring amino acid
MQGEVEQQQQAPMQMVLRVKHPSSLSSGSEEASEGEGSSRSALSVFKAQEDQIERKKMEVRDKVFAQLGRVEEESKRLAFIRQELEGMADPTRKEVESIQRRIDTVNRXQLKPLSKSCVKKEKEYKEILEAYNEKSKEKAILVNRLIELVSESERMRMKKLEELNKTVDSLY

SEQ ID NO: 4992 - protein, 128 aa, Triticum aestivum
  misc_feature (26)..(26): Xaa can be any naturally occurring amino acid
  misc_feature (39)..(39): Xaa can be any naturally occurring amino acid
YGDKSFSSQLGRTFAVFWIMRPPGEXTSTIILALFFMCXAIVVGSVYCCRAAARAGLTRRVTTMDLEAADLDSDRKVGAAEFVVYKLKELGKISQEDISSFLEEFDKLDIDQSGTLSTYDLTQAQSGQ

SEQ ID NO: 4993 - protein, 159 aa, Triticum aestivum
MVSNGELSQPQAGEYGLAVMRRRPKTKIVCTLGPASRSVDMIEKLLRAGMCVARFNFSHGSHDYHQETLDNLHAAMERTGILCAVMLDTKGPEIRTGFLKDGKPIQLRKGQEIVISTDYSIKGDDKMISMSYKKLAVDLKPSSVILCADGTITLTVLHC

SEQ ID NO: 4994 - protein, 341 aa, Triticum aestivum
  misc_feature (135)..(135): Xaa can be any naturally occurring amino acid
MVSNGELSQPQAGEYGLAVMRRRPKTKIVCTLGPASRSVDMIEKLLRAGMCVARFNFSHGSHDYHQETLDNLHAAMERTGILCAVMLDTKGPEIRTGFLKDGKPIQLRKGQEIVISTDYSIKGDDKMISMSYKKXLAVDLKPGSVILCADGTITLTVLHCDKEQGLVRCCCENTAMLGERKNVNLPGVVVDLPTLTEKDREDILQWGVPNKIDMIALSFVRKGSDLVEVRKVLGEHAKSIMLMSKVENQEGVANFDDILAQSDAFMVARGDLGMEIPVEKIFYAQKVMIFKCNIQGKPVVTATQMLESMIKSPRPTRAEATDVANAVLFKHNKVGTGGGKG

SEQ ID NO: 4995 - protein, 186 aa, Triticum aestivum
MVSNGELSQPQAGEYGLAVMRRRPKTKIVCTLGPASRSVDMIEKLLRAGMCVARFNFSHGSHDYHQETLDNLHAAMERTGILCAVMLDTKGPEIRTGFLKDGKPIQLRKGQEIVISTDYSIKGDDKMISMSYKKLAVDLKPGSVILCADGTITLTVLHCDKEQGLVRCCCENTAMLGERKNVNLSG

SEQ ID NO: 4996 - protein, 340 aa, Triticum aestivum
MVSNGELSQPQAGEYGLAVMRRRPKTKIVCTLGPASRSVDMIEKLLRAGMCVARFNFSHGSHDYHQETLDNLHAAMERTGILCAVMLDTKGPEIRTGFLKDGKPIQLRKGQEIVISTDYSIKGDDKMISMSYKKLAVDLKPGSVILCADGTITLTVLHCDKEQGLVRCCCENTAMLGERKNVNLPGVVVDLPTLTEKDREDILQWGVPNKIDMIALSFVRKGSDLVEVRKVLGEHAKSIMLMSKVENQEGVANFDDILAQSDAFMVARGDLGMEIPVEKIFYAQKVMIFKCNIQGKPVVTATQMLESMIKSPRPTRAEATDVANAVLFKHNKVGTGGGKG

SEQ ID NO: 4997 - protein, 252 aa, Triticum aestivum
MSSSVGGGGGGGAALAGGDVAGLLDKAKELDQLRKEQDDVATEINKIHKKIISSPEMVDKSVDAMMARLRGFYVQARELSESEVSASSALVGLLDGLLQSGVSAAPRKKIEISEQKKKRMKSDTDTTRFSSASMRSQLDQAANLKGEQVAARVKSDDEKDEWFVVKVIHFDKETKEFEVLDEEPGDDEESAQKFERKYKLPMSYIIPFPKKGDPSSAQDFGQGRQVLAVYPGTTALYRATVASQRKGFSDVP

SEQ ID NO: 4998 - protein, 286 aa, Triticum aestivum
  misc_feature (54)..(54): Xaa can be any naturally occurring amino acid
  misc_feature (246)..(246): Xaa can be any naturally occurring amino acid
QEYSDPRDADEARYNLDGRDVDGSRIIVEFAKGVPRGSGGSREREYVGRGPPPXGTGRCFNCGIDGHWARDCKAGDWKNKCYRCGERGHIERNCQNSPRSLRRERSYSRSPSPRRGRARSRSYSRSRSYSRSRSRSYSESPRGRRTERDERRSRSISYSRSPRRSLSPEAKDMDRSPTPDRSRSPRRSISPVAKDNGDSPRGREKSRRPSDGYRSPVANGRSLRSPANNGSPSPGRDNRGSPRPEXNNGSPSPKGNADGGSPSPRGNDDDDGRRGSGSPRGRSVSP

SEQ ID NO: 4999 - protein, 231 aa, Triticum aestivum
  misc_feature (115)..(115): Xaa can be any naturally occurring amino acid
GTREIPVQIKGNPNNGGGGGGGKKDAGGKQNQGGGGGNARGRGKNGGGGQANNAKGGGGGGAPGGGGQAGQPGKKGGGGGPGLGVGGPMGGIGMPPQQQAMMRPNMMGAAGFPGXGPMGGPMGHHPHMGGAQGGGGAAHGMPAGGMPPPGFFQGGAGGGMPSGPAEMMQAAGNPMAQQQYMAMMQHQQQMMMQQQQQQQQPAMMNGHAHAHPHPGGGGAPAGYPAMPMGYG

SEQ ID NO: 5000 - protein, 158 aa, Triticum aestivum
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKEPKSPKKTTKSPKKTTKA

SEQ ID NO: 5001 - protein, 109 aa, Triticum aestivum
MSSSVGGGGGGGAALAGGDVAGLLDKAKELDQLRKEQDDVATEINKIHKKIISSPEMVDKSVDAMMARLRGFYVQARELSESEVSVSSALVGLLDGLLQSGVSAAPRKK

SEQ ID NO: 5002 - protein, 38 aa, Triticum aestivum
HASDETYEEIVRTSKRTIPYLFVRGDGVILVSPPLRTV

SEQ ID NO: 5003 - protein, 219 aa, Triticum aestivum
MDSEHWISRLAAAKRFYAAQLGHIDDMSGMGMEEVDMDMEDDGEMDMEMEMQMEEARWPEVACPYCYEDYDLGSLCVHLEEDHPYEPHPAPCPICSEKITRDMLNHITMHHGYLFKALLGGGHSHRSRNTTAATTNIYADPLLSSFGLGFATSDAEEPSKSSVPVLDDTSILKEAPPQPWESSIDSSLTSEEREQKRKQATSRATFVQDLVLSTLFGDD

SEQ ID NO: 5004 - protein, 232 aa, Triticum aestivum
MDSEHWISRLAAAKRFYAAQLGHIDDMAGMGMEEMQLEEARWPEVACPYCYEDYDLGSLCVHLEEDHPYEPHPAPCPICSEKITRDMLNHITMHHGYLFKNGSRLRRFVIPERRALSLLSRDLRDAHLQALLGGGHSHRSRNTTAATTNIYADPLLSSFGLGFATSDAEEPSKSSVPVLDDTSILKEAPPQPWESSIDSSLTSEEREQKRKQATSRATFVQDLVLSTLFGDD

SEQ ID NO: 5005 - protein, 219 aa, Triticum aestivum
MDSEHWISRLAAAKRFYAAQLGHIDDMAGMGMEEVDMDMEDDGEMDMEMEMQLEEARWPEVACPYCYEDYDLGSLCVHLEEDHPYEPHPAPCPICSEKITRDMLNHITMHHGYLFKALLGGGHSHRSRNTTAATTNIYADPLLSSFGLGFATSDAEEPSKSSVPVLDDTSILKEAPPQPWESSIDSSLTSEEREQKRKQATSRATFVQDLVLSTLFGDD

SEQ ID NO: 5006 - protein, 191 aa, Triticum aestivum
MTERSTHAPPAISSQAILAHLSTPRILSPPPAQQLAMDASATVAAGKAKKGAAGRKAGGPRKKSVARSVKAGLQFPVGRIGRFLKKGRYAQRVGSGAPVYLAAVLEYLAAELLELAGNAAKDNKKSRIIPRHLLLAVRNDQELGRLLAGVTIAHGGVIPNINPVLLPKKTAEKSPKEPKSPKKTAKSPKKA

SEQ ID NO: 5007 - protein, 229 aa, Triticum aestivum
PRVRPSRTGLHRPRAQSSIMATAAARLLIACLNVAFLLMAFFFCVSRPAVPRDSATSMNGWSGDEREGHGHGGGCDGAHRRLEVDKDRCGYDAATSSSVAGRCYPRGRGYVDYLYLFYCVCGDEHRALGYAAMAAWLAVLFYVLGDTAAVYFCSSLEGLSRLLRLSPAVAGVTLLSLGNGAPDALSTVASFASRGTGKGASTAVGLNGLLGGALFVSSAVLGVICLRVG

SEQ ID NO: 5008 - protein, 456 aa, Triticum aestivum
  misc_feature (394)..(394): Xaa can be any naturally occurring amino acid
  misc_feature (448)..(448): Xaa can be any naturally occurring amino acid
MAAAAPPLAAALLAVLLALAAPAAAEIRSTAIRADPRTIIPLDEFGFSNQGVLELNVTGIAFDPPASPDLDLSQFGFFLSTLDAWVHVLRQLQDLEVTCALQSDLVRLAYSFDRLRPPANPAGVAVARSSSFTLAFRVTEPGQYTLVFANCLAGAGGDLKVSMDVSSAMYNVDPATGQRAYLSVGSSALPSIYFLFCVVYAALAAGWVSILLRKRTAVFRIHYFMLAVLVLKGFNLLAEAEDKSYIERTGTAHGWDVLFYIFSFLKGISLFTLIVLIGTGWSFLKPYLADREKKVLMVVIPLQVVANIAQVVIDESGPYARDWVTWRQIFLLVDVVCCCAILFPIVWSIKNLREAARSDGKAAVNLMKLTLFRQYYVVVICYIYFTRVVVYALXTITSYRYLWTSVVAGEIATLAFYVFTGYRFRPEVHNPYFAIDDDEEEAAAEALXKLDDEFEL

SEQ ID NO: 5009 - protein, 198 aa, Triticum aestivum
SAGSAVPLAAVLLRGLPDDPSTGVIHGVVLFVMGVFISWNGPATNFPIFAEIVPEKSRTSIYALDRSFETVLSSFAPPIVGILAQRVYGYRPDDKGTSTQLDRENAASLAKALYTAIAIPFTVCAAIYSFLYCSYPRDRDRARMQSLAESEMQQVEHEGSRLEGGDGDGGSIVHGLKEESPEAEKDTAKLLSDVEQGR

SEQ ID NO: 5010 - protein, 214 aa, Triticum aestivum
QQPQQPFPQPQQTFPQQPQLPFPQQPQQPFPQLTSELSHGNRICGSEGAVTAETTHSTDVNLYRNVFITSFGEVPGLILSAAIVDKFGRKLSMSSMLYISCLCIAPLMFSQTESLTTVFLFGARICISASFIVLHIYAPEIYPTAVRATGVGFASSIARFGGILCPLVAVGLVHACHQTAAIAVFITVMLVSAVAVSYFPLETSGRKLSDHIAA

SEQ ID NO: 5011 - protein, 249 aa, Triticum aestivum
  misc_feature (107)..(107): Xaa can be any naturally occurring amino acid
LHEMADSAESAQLVSARKSNPVDHASKPGIGGLNAILRLLSPNLIRSTLLLWTVFLGLAFLYYGLVLLTSELSHGNRICGSEGAVTAETTHSTDVNLYRNVFITSFXEVPGLILSAAIVDKFGRKLSMSSMLYISCLCIAPLMFAQTESLTTIFLFGARICISASFIVLHIYAPEIYPTAVRATGVGFASSIARFGGILCPLVAVGLVHACHQTAAIAVFITVMLVSAVAVSYFPLETSGRKLSDHIAA

SEQ ID NO: 5012 - protein, 146 aa, Triticum aestivum
MAGRKGGDRKKSVTRSVKAGLQFPVGRIGRYLKKGRYAQRVGSGAPVYLAAVLEYLAAEVLELAGNAAKDNEKTRIIPRHLLLAVRNDQELGRLLAGVTIAHGGVIPNINSVLLPKKSPDRLEKEAKSPKKNTTTKSPNKKVATNE

SEQ ID NO: 5013 - protein, 154 aa, Triticum aestivum
  misc_feature (9)..(9): Xaa can be any naturally occurring amino acid
  misc_feature (11)..(11): Xaa can be any naturally occurring amino acid
  misc_feature (93)..(93): Xaa can be any naturally occurring amino acid
  misc_feature (97)..(97): Xaa can be any naturally occurring amino acid
  misc_feature (113)..(113): Xaa can be any naturally occurring amino acid
  misc_feature (116)..(116): Xaa can be any naturally occurring amino acid
  misc_feature (129)..(129): Xaa can be any naturally occurring amino acid
  misc_feature (133)..(133): Xaa can be any naturally occurring amino acid
  misc_feature (141)..(141): Xaa can be any naturally occurring amino acid
  misc_feature (148)..(148): Xaa can be any naturally occurring amino acid
MDGSKLKKXAXKKFGGPRKKSVTKSIKAGLQFPVGRIGRYLKKGRYAQRVGSGAPVYLAAVLEYLAAEVLELAGNAAKDNKKTRIVPRHLLLXAIRXDQELGRLLSGVTIAHXGVXPNINPVLLPKKAXEKAXKAGTAAKXPKKGTKXPKKTKG

SEQ ID NO: 5014 - protein, 260 aa, Triticum aestivum
  misc_feature (21)..(21): Xaa can be any naturally occurring amino acid
  misc_feature (35)..(35): Xaa can be any naturally occurring amino acid
  misc_feature (37)..(37): Xaa can be any naturally occurring amino acid
  misc_feature (46)..(46): Xaa can be any naturally occurring amino acid
  misc_feature (49)..(49): Xaa can be any naturally occurring amino acid
  misc_feature (66)..(66): Xaa can be any naturally occurring amino acid
  misc_feature (93)..(93): Xaa can be any naturally occurring amino acid
FAPGFFVGGGRSRFPLDAKPXFHLVGGPPSGGPPXPXRSLPKINLXAPXDQVCLLTSVISTGVGAXTLNVAKPKKGMTVAIFVLEAVGLAAMXGARMSGASRIIGVDLNPAKHEQANKFACTDFVNPKDHTKPVQEVIVQMTDGGVDRAVECTGNADAMISAFECVHDGWGVAVLVGVAHKEAVFKTHPMNFLNERTLRGTFFGNYKPRTGLPGVVDMYMRKELELDKFITHSVPFSQINTAFDLMLKGEGLRCVIRMEE

SEQ ID NO: 5015 - protein, 365 aa, Triticum aestivum
  misc_feature (199)..(199): Xaa can be any naturally occurring amino acid
  misc_feature (215)..(215): Xaa can be any naturally occurring amino acid
  misc_feature (294)..(294): Xaa can be any naturally occurring amino acid
  misc_feature (308)..(308): Xaa can be any naturally occurring amino acid
  misc_feature (316)..(316): Xaa can be any naturally occurring amino acid
MTTLNQFDLLGDVDNDDPSQLLAAAAAAAAKKAQANKTEAAPAGKAAQTAAAAKLPTKSAPPAQAGRDARSGGPPSRGGFGRGEPGRGRGGGRYGQNRDFGSENTNGYQGGYGGVGSGDGAVAGGGDGERGPRPYRGGGGRRGGYRNGEFGDDSERPPRRNYERHSGTGRGQGMKRDGAGRGNWGSSTDEGLAQETDEXLLKIEDNAPIAEKQGXEQDDAPPTTVEKKDHKDGAAKEEEENEEDKEMTLEEFEKIREEQRKALLALKTEERKVEVDKDLQSLQPLSTQKSNDEXFIKLGSDKEKRREXTDRDERAXKSLTITSSSGCRGKRLYGAVVLKGAGRGPGTPRFKGGLEEIQQGKGRPS

SEQ ID NO: 5016 - protein, 152 aa, Triticum aestivum
  misc_feature (144)..(144): Xaa can be any naturally occurring amino acid
MAGAGVTTTGSPCGACKFLRRRCAAECVFAPYFCAEDGASQFAAIHKVFGASNAAKLLQQVAPGDRSEAAATVTYEAQARLRDPVYGCVAHIFALQQQVVALQAQVAHARTQAHLGPAATAMHPLLQQQLQQQAWQVAEQHDHXSMTSTQSS

SEQ ID NO: 5017 - protein, 108 aa, Triticum aestivum
MAVASIVHAPSLLAVQTFRGQRNAAANRSPRAAAFRVRAAKLPAGVQVPRAQPKLSEPFLGFTKTAEVWNSRACMMGLIGTFIVELILNKGVLEIIGFEVGKGLDIPL

SEQ ID NO: 5018 - protein, 108 aa, Triticum aestivum
MAVASMVHAPSLLAVQTFRGQKNAAANRSPRAAAFRVRAAKLPAGVQVPRAQPKLSEPFLGFTKTAEVWNSRACMMGLIGTFIVELILNKGVLEIIGFEVGKGLDIPL

SEQ ID NO: 5019 - protein, 212 aa, Triticum aestivum
  misc_feature (170)..(170): Xaa can be any naturally occurring amino acid
RGRGRGQWYQRRALASLDGGCDQLEVVADLLLGISLSRQARYAPSGTERASQQREALKVLGVAEKKMEGKDFRVLYNLSLENAEQRKLDAAALYAKKLLKLENGSELRSWLLVARITSAQKRFEDAESIVNAALDQTAKWCQGDCCKPKPKFRLQTGQFKKAVETYTQLXLAVIQLRRKSFTSGRFWYYTGPKVVGNLANPEAWYNLGPFGT

SEQ ID NO: 5020 - protein, 159 aa, Triticum aestivum
MKSFLSLLCSVFLLPLVVQSVPVIKRASASDWENRVIYQLLTDRFAKSTDDTNGCSNLSDYCGGTFQGIINHLDYIAGMGFDAIWISPIPKNVNGGYHGYWASDFSQINEHFGTADDLKKLVAAAHAKNMYVMLDVVANHAGTPSSGGDYSGYTFGQSF

SEQ ID NO: 5021 - protein, 141 aa, Triticum aestivum
SVIYADTVGDLGYASELGNYAEYSGAPKEEEVLQYARVLLDCATADPDGRKRALLIGGGIANFTDVAATFNGIIRALREKESKLKAARMNIYVRRGGPNYQTGLAKMRTLGTELGVPIEVYGPEATMTGICKEAIDCIMAA

SEQ ID NO: 5022 - protein, 159 aa, Triticum aestivum
MDASATGAGTKAKKGPAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKRTAEKEPKEGKSPKKTAKSPKKADKKA

SEQ ID NO: 5023 - protein, 156 aa, Triticum aestivum
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKAAKSPKKADKKA

SEQ ID NO: 5024 - protein, 174 aa, Triticum aestivum
MSEPIPLLPRPDEHQPPDMDASATGAGAKSKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKAAKSPKKAEKKA

SEQ ID NO: 5025 - protein, 155 aa, Triticum aestivum
MDASATVAAGKAKKGAAGRKAGGPRKKSVARSVKAGLQFPVGRIGRFLKKGRYAQRVGSGAPVYLAAVLEYLAAELLELAGNAAKDNKKSRIIPRHLLLAVRNDQELGRLLAGVTIAHRGVIPNINPVLLPKKTAEKSPKEPKSPKKTAKSPKKA

SEQ ID NO: 5026 - protein, 510 aa, Triticum aestivum
  misc_feature (194)..(194): Xaa can be any naturally occurring amino acid
  misc_feature (473)..(473): Xaa can be any naturally occurring amino acid
MGTRGLAVLLLAAVLLQGLLPASEAEGLVRIALKKRAIDRNSRVAKSLSDREEVHLLGGASNTLPSEEEGDIVSLKNYMNAQYFGEIGVGTPPQKFTVIFDTGSSNLWVPSAKCYFSIACYLHARYKAGASSTYKKNGKPAAIQYGTGSIAGYFSEDSVTVGDLVVKDQEFIEATKEPGVTFLVAKFDGILGLXGFKEISVGKAVPVWYNMVEQGLISDPVFSFWLNRHADDEGEGGEIIFGGMDPKHYVGEHTYVPVTQKGYWQFDMGDVLVGGKSTGFCAGGCAAIADSGTSLLAGPTAIITEINEKIGAAGVVSQECKTIVSQYGQQILDLLLAETQPKKVCSQVGLCTFDGTRGVSAGIRSVVDDEPVKSNGLRTDPMCSACEMAVVWMQNQLAQNKTQDLILDYVNQLCNRLPSPMGESAVDCASLGSMPDIEFTIGGKKFALKPEEYILKVGEGAAAQCISGFTAMXDIPPPRGPLWILGDVFMGPYHTVFDYGKLRVGFAKAA

SEQ ID NO: 5027 - protein, 233 aa, Triticum aestivum
  misc_feature (63)..(63): Xaa can be any naturally occurring amino acid
TVRPLLKRTNNWFFLQPKKTPPICPLWQKGNVIGVGWKKGGLFLILNRKKKFCEEDFFSLTGXFMRLQKHTQPKHPDSRPSEIDPARQVDWDNFQQSSDIVDVLSTIHAQVPNGIVLGDYVIEYGDDDTGDDYEVLRRVRRKWWSFICCKAFCRYPRSRRRGRGRDSRGSGRRNSNQAHLENFNLEVPTQAVDLRELRFDEIDDEYIVTGAVPSMATPGRMASFHYRDTRYGR

SEQ ID NO: 5028 - protein, 246 aa, Triticum aestivum
MARKKIREYDSKRLLREHLKRLAGIDLTILSAQITQSTDFAELVSQQPWLSTMKLVVKPDMLFGKRGKSGLVALNLDFDQVKEFVKERLGVEIEMGGCKAPITTFIVEPFVPHDQEYYLSIVSERLGSTISFSECGGIEIEENWDKVKTIFLPTEKPMTPDSCAPLIATLPLEAAWSGGVAIKGVFAVFQDLDFSFIEMNPFTMVNGEPYPLDMRGELDDTASFKNFNKWGNLEFPLPFGRVFSST

SEQ ID NO: 5029 - protein, 151 aa, Triticum aestivum
  misc_feature (142)..(142): Xaa can be any naturally occurring amino acid
TRTVKIADFGVARHEAANPSDMTGEIGTLGYMAPEVLNGNAYNRKCDVYSYGICLWEVYCCDMPYADLSFSEVTSAVVRQNLRPEIPRCCPSAFANVMKRCWDANPDKRPEMAEVVTMLEAIDTSKGGGMIPVDQARGIGCXSCLRPRRGP

SEQ ID NO: 5030 - protein, 109 aa, Triticum aestivum
MAVASMLHAPSLLAVQPFGGQRNAASANRSPRAAAFRVQAAKLPAGVQVPKAQPKLSEPFLGFTKTAEVWNSRACMMGLIGTFIVELILNKGVLEIIGFEVGKGLDIPL

SEQ ID NO: 5031 - protein, 155 aa, Triticum aestivum
MDASATVAPGKAKKGAAGRKAGGPGKKSVSRSVKAGLQFPVGRIRRFLKKGRYAQRVSSGAPVYLAAVLEYLAAELLELAGNAAKDNKKSRIVPRHLLLAVRNDQELGRLLAGVTIAHGGVIPNINPVLLPKKAAEKSPKEPKSPKKTAKSPKKA

SEQ ID NO: 5032 - protein, 384 aa, Triticum aestivum
  misc_feature (272)..(272): Xaa can be any naturally occurring amino acid
  misc_feature (302)..(302): Xaa can be any naturally occurring amino acid
  misc_feature (349)..(349): Xaa can be any naturally occurring amino acid
  misc_feature (370)..(370): Xaa can be any naturally occurring amino acid
MRLITPRYLCDTIEYSSYASNALGALPYGRPAGGRTSDFERPPGQWYQRRALASLDGGCDQLEVVADLLLGISLSRQARYAPSGTERASQQREALKVLGVAEKKMQDKDFRVLYNLSLENAEQRKLDAAALYAKKLLKLENGSELRSWLLVARITSAQKRFEDAESIVNAALDQTAKWCQGDLLQTKAKIQAANGQFKKAVETYTQLLAVIELRKKSFNSGIFVLQGTKDDGSMETEAWYNLALLYLSLSQWRDTELCISKIRLSVHILPWXYHATGKLLEARGFLKEALGAYSKALDLDPXHVPSLISAAVALRQLGGRPLPAARCLLTDALRLDRTNHVAWFNLGSXYEDEGGSSSAALEAAECFQAXLPFSKKTAPAEPFR

SEQ ID NO: 5033 - protein, 323 aa, Triticum aestivum
MPPNSTPQRRAQLQQHHHRPVTAGGRSQEAAMSAVASDEEAFQEVDPTGRFGRYAAVLGLGSVKKVYRGFDQEEGIEVAWNRVRLRALAERDPSMVDRLHAEVRLLRSLHHDHIIGFHKVWLDRDAGVLNFITEVCNSGSLRDYRDRHKHVSLKALKKWARQILEGLDHLHTHDPCIIHRDLNCSNVFINGNTGQVKIGDLGLAAIVDKDHTAHTILGTPEFMAPELYSETYTESVDIYAYGMCVLEMVTREMPYGECESVVQIYHSVTNGVPPAALRRLRDPEMRAFIQRCIGKPRNRPSAADLLRDPFFHGIDDDTTGTLS

SEQ ID NO: 5034 - protein, 228 aa, Triticum aestivum
  misc_feature (29)..(29): Xaa can be any naturally occurring amino acid
KKTKRSCSLCFCFTGHGIIALLGNKSAVXLFESKEVLFLRALHMNMKCGEAKMLRQIETTKTKYKFYTAALLLVTAIVVGTVFLWKVEKLSLVDSFYCVCATITTLGYGDKSFSSQLGRTFAVFWIITSTIILALFFMYLAEIYTERRQKMLAKWVLTRRVTTMDLEAADLDSDRKVGAAEFVVYKLKELGKISQEDISSFLEEFDKLDVDQSGTLSTYDLTQAQSGQ

SEQ ID NO: 5035 - protein, 53 aa, Triticum aestivum
GTDVPLLEGHSSGRDEAVGFIQAWRIPGVAPFALCLFFCKLVAYTFLCWLPFF

SEQ ID NO: 5036 - protein, 145 aa, Triticum aestivum
  misc_feature (12)..(12): Xaa can be any naturally occurring amino acid
GTPDGPTCHTGXETCYYFSVYDALQGSKSNQERQVATTLYSLEDTISRRKEARGTEGSGKPSWTKKLLLDNQLLCSKIREEAGELIETLLENEDKSRTASEMADLLYHAMVLLSVRDVKMEEVLEVLRRRFSQSGVEEKASRKKS

SEQ ID NO: 5037 - protein, 253 aa, Triticum aestivum
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAATVKSA

SEQ ID NO: 5038 - protein, 160 aa, Triticum aestivum
  misc_feature (45)..(45): Xaa can be any naturally occurring amino acid
MDGSKAKKVAAKKFGGPRKKSVTRSIKAGLQFPVGRIGRYLKKGXRYAQRVGSGAPVYLAAVLEYLAAEVLELAGNAAKDNKKTRIIPRHLLLAVRNDQELGRLLAGVTIAHGGVIPNINSVLLPKESPAAAGEGGQSPKEEEHHQSPKEEGRRQRIPSP

SEQ ID NO: 5039 - protein, 67 aa, Triticum aestivum
GKKFALNPKEYILKVGEGAAAQCLSGFPPMDIPPPRGPLWILGDVFMGPSPPVFDYGKLGVGFAKAA

SEQ ID NO: 5040 - protein, 146 aa, Triticum aestivum
  misc_feature (138)..(138): Xaa can be any naturally occurring amino acid
MAGRKGGDRKKAVTRSVKAGLQFPVGRIGRYLKKGRYAQRVGSGAPVYLAAVLEYLAAEMLELAGNAAKDNKKTRIIPRHLLLAVRNDQELGRLLAGVTIAHGGVIPNINSVLLPKKSPAAAEKEAKSPKKKTSTKVXQEEVAAKE

SEQ ID NO: 5041 - protein, 282 aa, Triticum aestivum
  misc_feature (113)..(113): Xaa can be any naturally occurring amino acid
  misc_feature (133)..(133): Xaa can be any naturally occurring amino acid
  misc_feature (152)..(152): Xaa can be any naturally occurring amino acid
LGGYHRRHARWPPSLLAAACAAAAAAPPSTAAAAGLRGPPSSPAGGSPPSSARPRPPLPPRAAPVSVVPQTKEVKLPTWAEFELGKAPVYWKTTNGLPPAPGEGLKIFYNPGXTKLTPNEQFGIAFNGGFNQXPIMCGRASRRQDERCKKEXGKPVPPSTTIRIRVPQHAMTLVFSFTNGNEWDGAYTLKFKVPKPWLDKPLSFFNEGLADELNMEGACDRAIFPDENIVITSCDIGGFYEEGGDRCKLDIVSGCMDPTSHMFDPLATIDDGSCPLDSDTEE

SEQ ID NO: 5042 - protein, 580 aa, Triticum aestivum
  misc_feature (298)..(298): Xaa can be any naturally occurring amino acid
  misc_feature (308)..(308): Xaa can be any naturally occurring amino acid
  misc_feature (312)..(312): Xaa can be any naturally occurring amino acid
  misc_feature (317)..(317): Xaa can be any naturally occurring amino acid
  misc_feature (342)..(342): Xaa can be any naturally occurring amino acid
  misc_feature (355)..(355): Xaa can be any naturally occurring amino acid
  misc_feature (377)..(377): Xaa can be any naturally occurring amino acid
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALDFXDFDKLDRVRXPKIXYAGMXQYDGELKLPSSPCSPPLLRGLGEYXENGVRTFSCGKHXVGHALFLDWKPGSGYFGETREXVARIPSTGGITLNEKPNIKALVFAEGNGHAILSGELTQVRINIPNGDMIGHPGDVKATLVACKAADEAVKMVLDPVEQVGGIYFVTADHGNAEDMVKRNKSGLPMLYKSGSIQISTWHTPQPVPVVIGGHGLIPGVRFRSDNQTTGLAYVASTVMNLHGFQAPADYEATLLEVIDKYQFNTAPFGAEIGAADFVAIFLGWGKE

SEQ ID NO: 5043 - protein, 187 aa, Triticum aestivum
MAGAGVTTTGSPCGACKFLRRRCAAECVFAPYFCAEDGASQFAAIHKVFGASNAAKLLQQVAPGDRSEAAATVTYEAQARLRDPVYGCVAHIFALQQQVVALQAQVAHARTQAQLGAATAMHPLLQQQLQQQAWQVAAAADQHDHQSMTSTQSSSGCYSGAHQRSDGSSLHGAEMYCGYGEQEEGSY

SEQ ID NO: 5044 - protein, 155 aa, Triticum aestivum
MDASATVAAGKAKKGAAGRKAGGPRKKSVARSVKAGLQFPVGRIGRFLKKGRYAQRVGSGAPVYLAAVLEYLAAELLELAGNAAKDNKKSRIIPRHLLLAVRNDQELGRLLAGVTIAHGGVIPNINPVLLPKKTAEKSPKEPKSPKKTAKSPKKA

SEQ ID NO: 5045 - protein, 132 aa, Triticum aestivum
MEDAEGKPRVIIREYSPSTDRAGTEAVDRECEVGQPGGMSLHADLLGDPVARIRHSPAYLMLVAETSAQPGRIVGLIRGTVKSVATGKSCPGAPAFASVGYILGLRVSPSHRRMGVALRLVGHLEALVRADG

SEQ ID NO: 5046 - protein, 514 aa, Triticum aestivum
  misc_feature (362)..(362): Xaa can be any naturally occurring amino acid
MANLVQELMLETPPRAWFLFLLPLLLLSLHHWFTRKTGSTGQRLPPSPPALPIIGHLHLVGALPHVSLRDLARKHGPDVMLLRLGAVPTLVVSSPRAAEAVLRTHDHVLASRPRSVVSDVIMYGSSDIAFAPYGEYWRQARKLVTTHMLSVKKVQSFRSAAAEEVSMSMAKINEAATASGTVDMSELLNSFSNDMACRIVSGKFFLKDGRSKLFGELINDTSRLLGGFNLEEYFPALGRVGVLKRAVCAKAERVRNRWADLLDKVIDDRVSKRKSASDHKDGDFVDILLSVQQEYDLTREHMKALLTDVFFGATDTSANALEFTLAELMRKPHLMLKLQDEVRSIIPRGQEIVSEADMNNMXYLRAVIKESLRLYPVAPLLAPHLAMADCTIHGYMVPAGTRVVVNAWAIGRDSSSWEDAEEFIPERFTDEGNATNVNFKGNDFQFLPFGAGRRICPGINLGIANVELMLANLVCHFDWELPVGVERKDIDMTEVFGLTVRRKEKLLLIPKSRM

SEQ ID NO: 5047 - protein, 175 aa, Triticum aestivum
MYDNYRNPHPPGMQMPPPNPQPGPYDNPLYGASSGLIKTGLGVYGEKFLGSSSEFMQSNISRYFSNPQYYFHVNDQYVRNKLKVILFPFLHRGHWTRISEPVGGRLSYKPPMYDINAPDLYIPFMAFGTFIILAGFTLGFWGKFTPEAINLQFTRGLIGWGLQIVFLKGLLYSMG

SEQ ID NO: 5048 - protein, 302 aa, Triticum aestivum
  misc_feature (154)..(154): Xaa can be any naturally occurring amino acid
TSLYKKAGWYRSGIPGISSTHASGLAEKLLGNEDETDDEDDNEFALPDGSQSPVSNELLEKHKNLLTLFNRMESSIRLLRLRKKMTTFTNIATQVEVLTKRKFLYSHLAQMKHLFPEAIQINRILLHDQKSLCMYADMEITLLKDAVECSNPSXSPAIAICEAFRSKLLCFLGSHHKDIDVPEATLPEPFNLREGLYLDALHYGHSAEGVLEFSLENGFSNASHFPQSFQKLMSQKSITKVTEKTRLLSDPVEVTSLGADDTGGPDRSSYKHVSPVNTNISDTPSRHSISFCENSTPKQVIS

SEQ ID NO: 5049 - protein, 76 aa, Triticum aestivum
  misc_feature (20)..(20): Xaa can be any naturally occurring amino acid
  misc_feature (42)..(42): Xaa can be any naturally occurring amino acid
RPQQHFGGGRKINENKLFSXKKSRWTPYGNTKCIICKQQVHXQDGKYCHTCAYSKGVCAMRGPQAAGAKLYKQSNV

SEQ ID NO: 5050 - protein, 96 aa, Triticum aestivum
MVCTKCEKKLGKVIVPDKWKEGASNTFEGGGRKINENKLLSKKSRWTPYGNTKCIICKQQVHQDGKYCHTCAYSKGVCAMCGKQVLDTKLYKQSNV

SEQ ID NO: 5051 - protein, 72 aa, Triticum aestivum
  misc_feature (14)..(14): Xaa can be any naturally occurring amino acid
NSFEGGGRKINENXLLSQKSRWTPYGNTQCIICKPQVHQDGKYCHTCAYSKGVCAMCGKPVLDPKLYKPSNV

SEQ ID NO: 5052 - protein, 670 aa, Triticum aestivum
  misc_feature (544)..(544): Xaa can be any naturally occurring amino acid
MAAGSAAPLLAAVACTVLVLLAPAVSGDAATLESVPDLVKAMYVNIESFPCVRLLNLSGEIGCSNPGHGLVIAPIVRFKNSDDQLAQPSAVLLPLDQMPAFFLRVSNEPELYHKVAGVLVESNGDKLLELSPDRKFPQEDFAPYSNVSHDWNPAGSGIMWNRYDFPVFLLSEESTQTLRKIADKNEKSSNGYQANVAEFDLVMQTTKAETNGSESCLKEQSCLPLGGQSVWASLPPMSNASAEHQKPIIMVVASQDSASFFRDRSLGADSPISGLIALLTAVDALSHLHDLGKLKKQLVFAAFDGEAWGYLGSRKFLQELDEGDDSVNGINSSMIEQVLEIGSVGKGISQGDTLFYAHASRNSSISKKILDGLQSGSDSLGSDNVKVKPAASSNPGVPPSSLMSFMTKNTSTSGVVLEDFDSQFSNRFYHSHLDSPANINSSSIAAAAALAARSLYILATGDMTVDLMTLNTIKVNVTLVEELIGCLLTCDPGLSCGIAKSFISPSNACPSHYVGVFQDSPSSTQFPSYADDTSRFIWNFLADXTSTLASNVSSCTGKCNNESEVCVGGEVEGGGRCVVSTTRYVPAYSTRLKFEDNAWHVLPANSSDPMGAADPVWTESYWNTISLRVYAVQSTTSDRLILLAGLAVTAASYLGVVVGRAYISKITKRD

SEQ ID NO: 5053 - protein, 202 aa, Triticum aestivum
LGTVGLAVAEGAKSAGASRIIGIDIDAKKFDVAKNFGVTEFVNPKDHDKPIQQVLVDLTDGGVDYSFECIGNVSIMRAALECCHKGWGTSVVVGVAASGQEIATRPFQLVTGRVWKGTAFGGFKSRSQVPWLVEKYMNKEIKVDEYITHNMNLTDINKAFDLLHEGGCLRCVLAMEQFVSCEVVMQIYPPPWDYRTRWPRNS

SEQ ID NO: 5054 - protein, 517 aa, Triticum aestivum
  misc_feature (377)..(377): Xaa can be any naturally occurring amino acid
  misc_feature (390)..(390): Xaa can be any naturally occurring amino acid
  misc_feature (400)..(400): Xaa can be any naturally occurring amino acid
MDSLLWFVELLSLLCFFVFYYRHLQSKKISKAEPTEWPILGHLFGMVANLSHFHDWATGILAGTRYNFEARAGITGVRFFVTCDPANVRHIFTSNFTNYPKGDEFAEIFDVFGDGIFNADGDSWRRQRAKSQLIMAGPRFRAFSARYSRDKVERSLLPFLAHAAEAGSTPCDLHDVFLRLTFDMTCNLVFGVDPGCLQIDLPVVPFARAMDDVLETLFLRHIISPACWKLMYRYEVGTERKMAAARRSIDRFAADSIAKRRVDHKLRPNEGVTDSSDMLSSFICNGDASEYSDEFLRDTTGNLLLAGRDTTGAGLSWFFYLLSKTPNVQQRILDKLAPDRFPEEAAGGRRRHGGVRRERAKRHGCTCPAALCERLRXLYPSVPFEHKAAXAGDVLPSEAXMKAGDKILIFSYCMARMEGVWGKDCMEFRPERWVTADGKLRYEPSYKFISFNAGPRTCLGKEMAFVQMKTAAAAVLWNFAVEAVPGHVVEPKLSIILHMKNGLAVTVKRRNVAGVHG

SEQ ID NO: 5055 - protein, 494 aa, Triticum aestivum
LAWSRPRSKTGRSPRDKRIVKDEAAAQELWWGKGSPNIEMDEHTFLTNRERAVDYLNSLDKVFVNDQFLNWDPENRIKVRIISARAYHSLFMHNMCIRPTEEELESFGTPDFTIYNAGKFPCNRYTHYMTSSTSVDINLGRREMVILGTQYAGEMKKGLFGVMHYLMPKRRILSLHSGCNMGRDGDVALFFGLSGTGKTTLSTDHNRLLIGDDEHCWSDNGVSNIEGGCYAKCIDLSREKEPDIWNAIKFGTVLENVVFDEHTREVDYTDKSVTENTRAAYPIEYIPNAKIPCVGPHPKNVILLACDAFGVLPPVSKLNLAQTMYHFISGYTALVAGTEDGIKEPQATFSACFGAAFIMLHPTKYAAMLAEKMQTYGATGWLVNTGWSGGRYGVGKRIKLPYTRKIIDAIHSGELLTANYQKTEVFGLEIPTAIEGVPSEILDPINTWTDKAAYKETLLKLAGLFGKNFEVFASYKIGEDSTLTEEILAAGPKV

SEQ ID NO: 5056 - protein, 204 aa, Triticum aestivum
  misc_feature (37)..(37): Xaa can be any naturally occurring amino acid
MAAIAGGNKIRNAKLVLLGDVGAGKSSLVLRFVKGQXVEFQESTIGAAFFSQTLAVNDDTVKFERWDTAGQERYHSLAPMYYRGAAAAIVVYDITNAASFTRAKKWVQELQALGNSNTIVALAGNKADLLEARQVPAEEAKAYAQENSLFFMETSAKTAINVNDVFYEIAKKLLQGQQVQNPQGGMVLNQRPPERMVSSSSCCA

SEQ ID NO: 5057 - protein, 317 aa, Triticum aestivum
  misc_feature (269)..(269): Xaa can be any naturally occurring amino acid
  misc_feature (288)..(288): Xaa can be any naturally occurring amino acid
  misc_feature (312)..(312): Xaa can be any naturally occurring amino acid
EYEAYPGEQIEQVCTKKQAGTAPEFPGYRRPTRPISEKEIAPIMTEYWEKAEFPFHAIPKLATLGLAGSTTKGYGCPGLSLTASAVSIAEVARVDASCSTFILVHSSLAMSTIALCGSEAQKQKYLPSLAQFKTVGCWALTEPDYGSDASSLKTSATKVPGGWQLDGQKRWIGNSTFADVLVILARNADTKQLNGFIVKKGAPGLRATKIQNKIGLRMVQNGDILLNKVFVPEEDRLTGIHSFQDISKVPSMSRIMVAWQPIGISMGVXKMCHRLFERKKELRATLAXFKLNQKKIVMMLGNIQAMLLGGWXLCKLY

SEQ ID NO: 5058 - protein, 389 aa, Triticum aestivum
  misc_feature (315)..(315): Xaa can be any naturally occurring amino acid
MADQSLAAPIRCKAAVSRAKGAPLVIEDIVVDPPKAYEIRMKVLCTSLCHTDITFWRGKEDFPLPPVFPRILGHEAYGVVESVGERVEGFAAGDTVVPTFLGQCDSCGGCASAGSNMCSALPFVVGPGMRRDGTTRFRDSQGEPLHDFLAVSSFSQYTVVDVNQVVKVDPAVPPKLACLLGCGAGTGVGAAWRLAKVQPGSSVVIFGLGAVGLSVAQGAKMCGAAKIIGVDLNPDKEELGKKFGVTDFVNPSKLGESPLSQVIIEMTGGGADYCFECIGAASVMTEAFRSAKQGNGKTVILGLEKDGKPISLASXFEVLFGKCVMGSLFGGMKPKTDIPILAEKCMNKELELEKLITHEVGLQEINPAFDLLLQGKSLRCIIWMDKLEV

SEQ ID NO: 5059 - protein, 362 aa, Triticum aestivum
MEPIPLLTPYKMGQFDLAHRVVMAPLTRQRSYGNVPQPHAAVYYGQRATAAGLLIAEATGVSDTAQGYTDTPGIWTAEHVEAWKPIVAAVHAKGALFFCQIWHVGRVSTFELQPGGAAPLSSTEKGVGPQMSFDGRLEEFSPPRRLTVEEIPAIIDDFRKAARNAIDAGFDGVEIHGANGYIIEQFLKDSANDRTDEYGGSLENRCRFALEVVDAVVKEVGGHRVGIRLSPFTDYMDCHDSDPHSLALYMSTKLNGHGILYIHMIEPRMAIVDGRRVVPKRLLPYREAFKGTFIANGGYDREEGGKVITEGYTDLVAFGRLFLANPDLPKRFEVGAELNKYDRMTFYTSDPVVGYTDYPFLE

SEQ ID NO: 5060 - protein, 362 aa, Triticum aestivum
MEPIPLLTPYKMGQLNLAHRIVLAPLTRQRSYGNVPQPHAALYYSQRASAGGLLITEATGVSDTAQGYRDTPGVWTAEHVEAWKPIVDAVHAKGALIFCQIWHVGRVSTYEYQPGGAAPLSCTDKGVGPQMSYDGRLEEFAPPRRLKVEEIPAIVDDFRKAARNAIDAGFDGVEIHGANGYLIEQFLKDSANDRTDEYGGSIENRCRFALEVVDAVVKEVGGHRVGIRLSPFTDYMDCHDSDPHALALHMSTKLNNYNIIYLHMVEPRMAIVDGRRVVPKRLLPYREAFKGTFMANGGYDREEGGKVVADGYTDLVSFGRSFLANPDLPKRFEIGAELNKYDRMTFYISDPVIGYTDYPFLD

SEQ ID NO: 5061 - protein, 517 aa, Triticum aestivum
  misc_feature (447)..(447): Xaa can be any naturally occurring amino acid
  misc_feature (455)..(455): Xaa can be any naturally occurring amino acid
  misc_feature (465)..(465): Xaa can be any naturally occurring amino acid
  misc_feature (479)..(479): Xaa can be any naturally occurring amino acid
MAAANGAKGFEVPELDIKFTKLFINGQFVDAASGKTFETRDPRTGEVIARIAEGDKADIDLAVKAAREAFDNGPWPRMPGCARARIMHKFADLVDQHVEELAALDTVDAGKLFMMGKMMDIPGGANLLRYYAGAADKIHGETLKMARPLHGYTLKEPVGVVGHIVPWNYPTTMFFFKVSPALAAGCTMVVKPAEQTPLSALFYAHLAKEAGIPDGVLNVVPGFGPTAGAAIASHMDVDKISFTGSTEVGRLVMQAAATSNLKPVSLELGGKSPVIVFDDADVDMAVNLVNMATYMNKGEICVAGTRIYVQEGIYDAFVKKSVELAKKSVVGDPFNPNVHQGPQVDKDQYEKVLKYIDVGKSEGATLLTGGKPCSDKGYYIEPTIFTDVTDDMSIAQEEIFGPVMALMKFKTVDEVIQKANSTRYGLAAGVVTKNIDTMNTVSRSVSXGLWVNCYXAFDPTPFGGXKMTVGKDMGRCLEXYCTQDVVTPLYTHLAVIGRHRTTHSKQKWKDALHFTNA

SEQ ID NO: 5062 - protein, 73 aa, Triticum aestivum
GNNITQNQSVLHIWCQVELLDQVGDPPSLPAELLTLPQTATVADLKMEAARTFQSIYLMLQSFVANQLLDCPT

SEQ ID NO: 5063 - protein, 433 aa, Triticum aestivum
  misc_feature (245)..(245): Xaa can be any naturally occurring amino acid
  misc_feature (255)..(255): Xaa can be any naturally occurring amino acid
  misc_feature (276)..(276): Xaa can be any naturally occurring amino acid
MLSTAPAAYSTSFAAFPTLARRRHRHRRVLLPFAAATDGAERFAASSSIADYLRYRRPMSGDLSVGGGGGKLQTAVVRYEKRFPWSLIHPFLLVDLVSTVHIADKEYFDKLQQALEDYDCVLYEMVISRDNLNNQQDPTFAKKMRSSRKGFSILGFIQKQMARILSLDYQLDCLDYGDEKWQHADLDYETFKLLQTERGESFLTFAVDMTLKSTKALVQPTSPDGLDFWRSKLLWASRVLPMPLXGLFVITGLCXPVDKPDGYPELEALSKLDLGXAALKIFLAKQLTSDFNAMTAPAEDKSVIIGERNRVATEKIKGAINRGYKRIAVLYGGGHMPDLGRRLREELNMVPSNVQWVTAWSIRSRELDKKSLPFLKTMAEVSGWPLNRYETLALLIFSSVLAVDLWFWEFLVESSLNWASLAGSWIDQCSAPF

SEQ ID NO: 5064 - protein, 140 aa, Triticum aestivum
MTAPAEDKSVIIGERNRVATEKIKGAINRGYKRIAVLYGGGHMPDLGRRLREELNMVPSNVQWVTAWSIRSRELDKKSLPFLKTMAEVSGWPLNRYETLALLIFSSVLAVDLWFWEFLVESSLNWASLAGSWIDQCSAPF

SEQ ID NO: 5065 - protein, 151 aa, Triticum aestivum
  misc_feature (70)..(70): Xaa can be any naturally occurring amino acid
  misc_feature (76)..(76): Xaa can be any naturally occurring amino acid
MSAKRISWVPQGFPSHDGVKRRPSDCIRTHYRANWPGRRMLPARHGPGMPAEYPDRKLVDMYKEAYDSMXIPKYVXTVTPEYKPKLMPLLIEMKEAEKTSLKESERIEKEIAELKEMKKKISTMTADEYFAKHPELKKKFDDEIRNDYWGY

SEQ ID NO: 5066 - protein, 170 aa, Triticum aestivum
  misc_feature (22)..(22): Xaa can be any naturally occurring amino acid
  misc_feature (36)..(36): Xaa can be any naturally occurring amino acid
  misc_feature (44)..(44): Xaa can be any naturally occurring amino acid
  misc_feature (55)..(55): Xaa can be any naturally occurring amino acid
  misc_feature (65)..(65): Xaa can be any naturally occurring amino acid
  misc_feature (71)..(71): Xaa can be any naturally occurring amino acid
  misc_feature (73)..(74): Xaa can be any naturally occurring amino acid
  misc_feature (78)..(78): Xaa can be any naturally occurring amino acid
  misc_feature (89)..(89): Xaa can be any naturally occurring amino acid
  misc_feature (101)..(101): Xaa can be any naturally occurring amino acid
MPPGLAWSGQATGKPINWDGLXENAFFPKKERKEFXNLRRTLRXTVNHQMQEQVXPKEQTFQTTXCWDTTXRXXSKVXDMYKEANDSMXIPKYVNTVTPEXKPKFDALLIEMKEAEKTSLKESERIEKEIAELKELKKKISTMTADEYFAKHPELKKKFDDEIRNDYWGY

SEQ ID NO: 5067 - protein, 257 aa, Triticum aestivum
  misc_feature (152)..(152): Xaa can be any naturally occurring amino acid
MAAAAAAAGARRLLARRASSSPVSISALLRRGGAAAAAPHEPLLRPAALAGVASRLGFVRGMARRPGGDGYSPARSGGGGGGGDRAPTEMAPLFPGCDYEHWLIVMDKPGGEGATIPGCANEHWLIVMSKPGGEGATKHQMIDCYIQTLAKXLGSEEEAKKKIYNVSCERYFGFGCEIDEETSNKLEGIPGVLFVLPDSYVDPEHKDYGAELFVNGEIVQRSPERQRRVEPVPQRASDRPRYNDRTRYQRRRENQQR

SEQ ID NO: 5068 - protein, 108 aa, Triticum aestivum
FIAGHGSQSASVPEVDVDGPPIEEFSGMGLSKVIRADQKRFFFDLGSNNRGHYLRISEVAGADRSSIILPLSGLKQFHEMVGHFVDIMKDRLEGMTGANVRTVEPSQR

SEQ ID NO: 5069 - protein, 290 aa, Triticum aestivum
  misc_feature (71)..(71): Xaa can be any naturally occurring amino acid
SRQSLNPSSGGVGGGGGGSDVELVSKTLQFEHKLFYFDLKENPRGRYLKISEKTSTTRSTIIVPIAGVAWXLDLFDYYIRTDERHVFSQELRLDTKVFYFDIGENKRGRYLKVSEASVNRNRSTIIVPAGSSGEEGWEAFRNVLLEINDEASRLYVLPNHPSQQHLEPPERLPGLSDDVGAGFIAGHGSQSASVPEVDVDGPPIEEFSGMGLSKVIRADQKRFFFDLGSNNRGHYLRISEVAGADRSSIILPLSGLKQFHEMVGHFVDIMKDRLEGMTGANVRTVEPSQR

SEQ ID NO: 5070 - protein, 267 aa, Triticum aestivum
MAAMNIDLGGLAGRPTTSQADPFQSALYGAGPELIRSGLGAYSEKFLGSSSDFMQSNITQYLSNPQYYFQVNNQYVRNKLKVVLFPFLHRGHWTRITEPVGGRLSYKPPVQDINAPDLYIPLMAFATYIVVAGYALGVLGRFTPEALTIQFTKGLLGWFMQVILIKALLYSLGSGESPLLDIVAYAGYGFAGTSLAMLVRIFWSYSYYFLLPWFCICTGVFLVKTMKRVLQGASRTFERHPSRNHYFLLFLAAAQFPMLFWLGNIKG

SEQ ID NO: 5071 - protein, 149 aa, Triticum aestivum
MAAMNIDLGGLAGRPTTSQADPFQSALYGAGPELIRSGLGAYSEKFLGSSSDFMQSNITQYLSNPQYYFQVNNQYVRNKLKVVLFPFLHRGHWTRITEPVGGRLSYKPPVQDINAPDLYIPLMAFATYIVVARYALGVLGRVLHTQDNF

SEQ ID NO: 5072 - protein, 764 aa, Triticum aestivum
SGPAPRLRRWRPNATAGKGVGEVCAAVVEAATKVEDEGEEDEPVAEDRYALGGACRVLAGMPAPLGATALAGGVNFAVYSGGATAAALCLFTPEDLKADRVTEEVPLDPLMNRTGNVWHVFIEGELHNMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFKGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFTLADLVTYNKKYNLPNGENNRDGENHNLSWNCGEEGEFARLSVKRLRKRQMRNFFVCLMVSQGVPMFYMGDEYGHTKGGNNNTYCHDSYVNYFRWDKKEQYSELHRFCCLMTKFRKECEGLGLEDFPTAKRLQWHGHQPGKPDWSENSRFVAFSMKDERQGEIYVAFNTSHLPAVVELPERAGRRWEPVVDTGKPAPYDFLTDDLPDRALTIHQFSHFLYSNLYPMLSYSSVILVLRPDV

SEQ ID NO: 5073 - protein, 790 aa, Triticum aestivum
MTMMAMPEAPCLCARPSLAARARRPGSGPAPRLRRWRPNATAGKGVGEVCAAVVEAATKVEDEGEEDEPVAEDRYALGGACRVLAGMPAPLGATALAGGVNFAVYSGGATAAALCLFTPEDLKADRVTEEVPLDPLMNRTGNVWHVFIEGELHNMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFTLADLVTYNKKYNLPNGENNRDGENHNLSWNCGEEGEFARLSVKRLRKRQMRNFFVCLMVSQGVPMFYMGDEYGHTKGGNNNIYCHDSYVNYFRWDKKEQYSELHRFCCLMTKFRKECEGLGLEDFPTAKRLQWHGHQPGKPDWSENSRFVAFSMKDERQGEIYVAFNTSHLPAVVELPERAGRRWEPVVDTGKPAPYDFLTDDLPDRALTIHQFSHFLYSNLYPMLSYSSVILVLRPDV

SEQ ID NO: 5074 - protein, 164 aa, Triticum aestivum
  misc_feature (25)..(25): Xaa can be any naturally occurring amino acid
PRVRSPVSRSMPKMNPCAITTLVDXWRPETHTFHFYAREMTVTLQDVSLIIELPIKGEPICFSTDSDGWREIMVGLIGREPGVQGTSAGASYHWIAEHFGECPADADDETVQQYTRAYLWYVVSQTLFSDGTGVNASFMWLKLYAGWEHGLSWGKKNKKKQTHT

SEQ ID NO: 5075 - protein, 206 aa, Triticum aestivum
MSDNSIQRALLPENPDANVLQRKPSQGAKRFRRCRSAPRSETDEKPQENGSSLPAKELFSVVRPSFRLVGFLLFLYLLVGVVVFYLVMDQLSGKRTNRVLDALYFCIVTMTSVGYGDLVPNSDTTKLLACVFVFTGMAIIALFVSKSADYLVEKQEVLFFKALHMNMKCGEAKMLRQIETNKTKYKFYTAALLFVTAIVVGTCFLW

SEQ ID NO: 5076 - protein, 168 aa, Triticum aestivum
  misc_feature (112)..(112): Xaa can be any naturally occurring amino acid
MAALPLATAEACDANSHMITSGELRALQPVFRMYGGRRLFAGPVVTVKVFEDNVLVRGILEEKGEGRVLVVDGGGSLRRALLGGNIAMLAQNNGWAGIVINGCVRDVDEITXCDIGVRALGSHPMKSDKRGVGEKRVPVTVAGARICDGEWLYADADGILVSRTELSV

SEQ ID NO: 5077 - protein, 161 aa, Triticum aestivum
  misc_feature (78)..(78): Xaa can be any naturally occurring amino acid
  misc_feature (89)..(89): Xaa can be any naturally occurring amino acid
  misc_feature (120)..(120): Xaa can be any naturally occurring amino acid
  misc_feature (135)..(135): Xaa can be any naturally occurring amino acid
  misc_feature (140)..(140): Xaa can be any naturally occurring amino acid
YAADQAWSDAVERRALLRKDKLDSELNVYRTNLIKESIRMGYNDLGDFHYAQGHLSDAFKSYIRTRDYCTTSKHVVQXMCLNVILVSIXAGGNFMHVSNLCHQRRSKPKTIWFYYCRQLXLLLGLTYMETNKFKXAAPNXRQTKDNYLEILHKCMVMPLAL

SEQ ID NO: 5078 - protein, 436 aa, Triticum aestivum
MDVEDELPTAPASADGGESSHALVSGDQFDVEAYAAQYSGRTRVARLLFIAEKCGSEQMRLDALRLAYDWALKGEDTALHRDVSAKIAGRLGPRYAADQAWSDAVERRALLRKDKLDSELNVYRTNLIKESIRMGYNDLGDFHYAQGHLSDAFKSYIRTRDYCTTSKHVVQMCLNVILVSIELGQFMHVSNYVIKAEQTPDDMDPITAAKLRAAAGLAYMETNKYKLAARKFIETGSELRSNYSEVIAPQDVAVYGALCALASFDRSELKSKVIDNYNFRNFLELVPEVRELVNDFYASRYGSCLGYLEKLKSNLLLDMHLHAHIETLYKDIRHKAIIQYTFPFISVDLNLMAVAFQTSVSLLEKELAALITDNKIQARIDSHNKILYASHADQRNGTFQRALQTGIEFERDVKSMLLRANLLKHEYSQKAAERKV

SEQ ID NO: 5079 - protein, 251 aa, Triticum aestivum
  misc_feature (111)..(111): Xaa can be any naturally occurring amino acid
MGANGHPPPASAAAQNGSHSSGGGGGGGGGGGGGGGGANPSSGGTAAALRHDPGLSREWTPEEQAILDELLVKYASDAPVIRYAKIAMKLPEKTVRDVALRCRWMSKKESXGKRKKEDHSSSKKSKDKKEKVADSSSKPPVHIAGRPSVPPYSLPALPVDDDEISSKAIGGPTGELLETNAQVLSQISTNLGTMQIQDNISLLCQTRDNILRVLKEMNDAPEIMKQMPPLPVKINEELVNSILPRPTVPMQ

SEQ ID NO: 5080 - protein, 287 aa, Triticum aestivum
MADSMADSMVASFWGPVTSTTELCEENYARSSYIAEFYNTLSNAPCILLALIGLVNALRQRFEKRFSVLHISNMILSIGSIIFHATLQHVLQQSDETPMVWEILLYLYVLYSPDWHYRSTMPTFLVLYGAAFAVVHFFVRFQVVFKLHYIGLCLLCIPRMYKYYIQTKDLAAKRLAKLWVLTIFLATVCWLVDRIFCKKLSLWVINPQGHAWWHVLMGFNSYFANTFLMFCRAQQRGWEPRIIHLFGFLPYVRIRNPEEGVVVCRPPVFSGTESYATNAQKMQGEFW

SEQ ID NO: 5081 - protein, 711 aa, Triticum aestivum
MATRTTAHGATGDDEVAEAAGTALRHRHGHAGKGAGEAANGGASPEDASVEQVFADKAVPSWREQLTVRALVVSALLAVMFSVIVMKLNLTTGIIPSLNVSAGLLGFFFVRLWTNAFERMGLVGHPFTRQENTVIQTCVVSAYGIAFSGGFGSYLFGMSDTIAKQATEANDPWNIKEPHLGWMIGFLFLVSFIGIFALVPMRKIMIVDYKLTYPSGTATAYLINGFHTPEGAKLAKKQVKILGRYFMVSFFWGFFQWFFSGGDDCGFKNFPTLGLEAYKNRFYFDFSPTYIGVGMICPHIVNVSVMLGGIISWGIMWPLMGKKKGSWYPASLPESSLHGLQAYRVFISIALILGDGLYNFVKVLIRTIAGFISMVHKNSKAMLPVSDNGSPTAEAMSFDDERRTELFLKDQIPMAVAYGGYAVVASISIGTLPQIFPQLKWYYILVAYVVAPVLAFCNAYGSGLTDWSLASTYGKLAIFVFGAWAGLANGGVLVGLAACGVMMSIVSTASDLMQDFKTGYLTLASPKSMFISQVIGTSMGCVISPCVFWLFYKAFSDIGISGSEYPAPYAIVYRNMAILGVDGFNTLPENCLTLCYIFFAAAIAINLIRDLTPHKFSRFIPLPMAMAIPFYIGSYFAIDMFLGSFILFVWEKMNKAKADAYGPAVASGLICGDGIWTLPQSILALAKVNPPICMKFLTRGDNVKVDKFLGG

SEQ ID NO: 5082 - protein, 191 aa, Triticum aestivum
  misc_feature (119)..(119): Xaa can be any naturally occurring amino acid
  misc_feature (153)..(153): Xaa can be any naturally occurring amino acid
  misc_feature (174)..(174): Xaa can be any naturally occurring amino acid
  misc_feature (179)..(179): Xaa can be any naturally occurring amino acid
  misc_feature (187)..(187): Xaa can be any naturally occurring amino acid
AFKNFNKWGNIVFPLPFGRVLSPSESFIHELDEKTSASLKFTVLNPKGRIWTMVAGGGASVIYADTVGDLGYASELGNYAEYSGAPKEEEVLQYARVLLDCATSDPDGRKRPFQSGGGXANFTDVASTFKWASFRALREKDPKLKAARMNIIXESGPNYQTGTRQNATQARTGXPIEAXDKSDMTGXCKEP

SEQ ID NO: 5083 - protein, 167 aa, Triticum aestivum
LAWSRPRSEAPNWLTYDFPADVKDKLNARWGTNWKGQAQKWFLFRLTGGDDEINLMGDGSEKPEFSEWTWMTPHLAIDKAAESRTLVSDETLNLFAPYSIVRSHLLRLYYYSSFVSGLLYVMPVCVPSRDFVPMFAAARPPDTFPPTSSSPVSRRRCRCVARCAASL

SEQ ID NO: 5084 - protein, 409 aa, Triticum aestivum
  misc_feature (321)..(321): Xaa can be any naturally occurring amino acid
TVGSLGGLAALTVFVFYLLHQRKRKRAVGSNELMRSGSSMTSYSDVIELGGSPHIFTFEELEVATDGFSASRELGDGGFGTVYKGKLKDGRVVAVKRLYKNNYRRVEQFLNEVDILSRLLHQNLVILYGCTSRMSRDLLLVYEFIANGTVADHLHGSRSAERGLTWPLRLNIAIETAEALAYLHAVEIIHRDVKTTNILLDNNFHVKVADFGLSRLFPLEVTHVSTVPQGTPGYVDPVYHQCYKLTDKSDVYSFGVVLVELISSKPAVDMSRSHSEINLANMALNRIQNHEVVKLIDPELGYDTDPETKRTIDRVAEVAFXCLQLERDLRPSIKEVVEILTCVRDGDCRANSMKKKKASQKEDASLLKDGLQFSPDTVIHRFYSQSTNHSVASNASGLSITANAEKNAA

SEQ ID NO: 5085 - protein, 77 aa, Triticum aestivum
GIHLHTYLRVSSHKTIDGRGQRVRLTGKGLQLKDCHHVIVCNLQFEAGRGHDVDGIQIKPGSTNIWIDRCSLADYDD

SEQ ID NO: 5086 - protein, 165 aa, Triticum aestivum
MCKPRPTKRRQESPLSPSSSPARPRPRTPRRPEAMARKGVSYVTAAQLVSMVSDPRVAIIDVRDEERICDAHIAGSHHYASDGFADRLPEIAEATRAKDTLVFHCALSQVRGPSCARMFLDYLSEAKEESAVKSITVLERGFNGWELSGKAVCRCKDAPCKGVCS

SEQ ID NO: 5087 - protein, 104 aa, Triticum aestivum
VFISIAMILGDGLYNFVKVLVRTSVAFAAMVKKNSTIPVSDVGGAKATGEPVSFDEQRRTEQFMKDQIPKSVAYAGYAAVAAVSIATLPQIFPDLKWYYILVAY

SEQ ID NO: 5088 - protein, 175 aa, Triticum aestivum
MSVAAGVSDAAIAVRDKLRGKIGQTKVKRYWPGKKPEWADEAEDDIDLRAARVSLDEAFPKAEEGDRDRDRPPKDDRRLRRLAETRAENKEELRADHRRIRQAEIVSTAEEERDRQEAQVEEEDDEDAQEERRRRIKERQRLRAQEEEELLPQEDEPIEDDVQESEEFEYETDSE

SEQ ID NO: 5089 - protein, 312 aa, Triticum aestivum
  misc_feature (259)..(259): Xaa can be any naturally occurring amino acid
MSSSNGNGGKKPAPSGGRGGIRTLADINRGPSGFPGAGGSGSDSDEPQEYYTGGEKSGMLVQDPTRRNNVDSIFEQARVMGAQQVPLPSFEGQSSSSTSFAGTGRLLSVDAQTAPAAPQPPQDVLHNIHFWNNGFTVDDGPLRGYDDPANADFIESIKKSQCPQELEPADRRTAVHVNVIKRHGDYEEAARPRSAFQGVGRTLGGSSADESPAPAPVTQEPRSAPRSIGIVVDDSQPFTSIQLRLADGTRMVARFNLHXHTVGDIRSFIDASRPGAARPYQLQTGFPPKQLTDPTQTVDQAGLKNSVIMQKM

SEQ ID NO: 5090 - protein, 447 aa, Triticum aestivum
  misc_feature (16)..(16): Xaa can be any naturally occurring amino acid
MDVDCEVSAAAAAAVXNGLGGGVQPAAAPSVSADQLDVEAYAAQYSGRTRVARLLFIAEGCGVEAIQLEALRMAHDEARAREDTVLYLDAVLKINGRLGPRYRHDQAWVDSVNRRAEQRKEKLETELNGYRTNLIKESIRMGYNDIGDFFYAHGHLSEAFKSYIRTRDYCTTSKHIVQMCMHVILVSIELGQFAHVTNYVSKAEQTPDTLDAVIVAKLRAAAGLANLETKKYKLAARKFLETGPELGSNYSEVIAPQDVAVCGALCALASFDRSELKSKVIDNINFRNFLELVPEVRELVNDFYASPYGSCLEHLEPLKPNLLLDIHLREHLGTLYNDIRHKAIIQYTLPFISVDLNTMASAFKSSVSMLEKELAALITENKIQARIDSHNKILYARHADQRNATFQRALQTGNEFERDIKAMLLRANLIKHDFNQKNWPGQRKMNL

SEQ ID NO: 5091 - protein, 141 aa, Triticum aestivum
MDVDCEVSAAAAAAVTNGLGGGGQPAAAPPVSADQLDVEAYAAQYSGRTRVARLLFIAERCGVEAIQLEALRMAHDEARAREDTVLYLDAVLKINGRLGPRYRHDQAWVDSVNRRAEQRKEKLETELNGYRTNLIKESIRM

SEQ ID NO: 5092 - protein, 195 aa, Triticum aestivum
  misc_feature (65)..(65): Xaa can be any naturally occurring amino acid
TTLLLWFVFYANSFAYYGLVLLTAQLSNANRSCASGLKYVKSETDASLYKDTFVTSLPEIPGSNXSALLVEWFGRKATMWCLLFTCCGFLGPLVFYQSELWTTGLLFGARACAMGSYTVVCLYAPEVYPTSVRSTGVGIATAMGRVGGIICPLVAVGMLRSCHQMEAIIVFEVVLFLAAIACMLFPFETKGRAMN

SEQ ID NO: 5093 - protein, 161 aa, Triticum aestivum
  misc_feature (7)..(7): Xaa can be any naturally occurring amino acid
  misc_feature (124)..(124): Xaa can be any naturally occurring amino acid
VLNPKGXRIWTMVAGGGASVIYADTVGDLGYASELGNYAEYSGAPNQEEVLQYARVVLDCVTAEPCMAASRALLIGGGIANFTDVAATFSGIIQALREKESKLKASRMHLYVRRGGPNYQTGLXKMRKLGAEIGVPIEVYGPEETMTGICKQAIECIMAAS

SEQ ID NO: 5094 - protein, 131 aa, Triticum aestivum
MSYYDRRGESSVLEAFTLSPLPYPVILILMMVTLLLGASWFFSYEEFMEEASEQFSWFLLGVPIALVLLIRWISSVDTFEGYFGFYPTESRWRGYPAAPSEGSSPWGVAMVVLLLLVLASFHSTFQDMWKA

SEQ ID NO: 5095 - protein, 385 aa, Triticum aestivum
  misc_feature (208)..(208): Xaa can be any naturally occurring amino acid
MARPGHSTAWLPLLVLLFAAGATAQSCLSATFTGGRTFLKCNQLPVLGASLHWTYHAVNGTADIAFRAPSGADGWVGWGINPSGGGMAGSNVFIASQTSGAVSVLTTILRNTTPTLDNTALSFDVPVPASAEYAGGAYTIYATVALPGNTTSQNTVWQAGPVARLTSWASHHSDRGADVQSVQRLDFLSGTSTGASNSRLHRRNLHGXLNGGGWGVLIPLGAMIARYLRVFEAADPAWFYLHIACQISGYALGVAGWGLGLKLGSESKGLTYSTHRNIGIAIFCLATLQVFALFLRPDKKNKYRVYWNAYHHSVGYSVIVLAAVNIFKGLNILKPVTGWKTSYIVILATLAGVALVLEAITWAIVLRRRKRNQAHGGANGTGVQL

SEQ ID NO: 5096 - protein, 83 aa, Triticum aestivum
IANFTDVAATFSGIIRALREKESKLKAARVNIYVRRGGPNYQTGLAKMRALGSELGLPIEVYGPEATMTGICKQAIDYVMAEA

SEQ ID NO: 5097 - protein, 177 aa, Triticum aestivum
KTSASLKFTVLNPKGRIWTMVAGGGASVIYADTVGDLGYASELGNYAEYSGAPKEEEVLHYARVVLDCATADPDGRKRALLIGGGIANFTDVAATFSGIIRALREKESKLKAARVNIYVRSPPPNYQTGLAKMRALGSRAWSSQLRVYGPGGPTMTWNLASKAIGLNAMAEADSAIV

SEQ ID NO: 5098 - protein, 155 aa, Triticum aestivum
TGPEFSGRPTRPASVIYADTVGDLGYASELGNYAEYSGAPKEEEVLHYARVVLDCATADPDGRKRALLIGGGIANFTDVAATFSGIIRALREKESKLKAARVNIYVRRGGPNYQTGLAKMRALGSELGLPIEVYGPEATMTGICKQAIDCVMAEA

SEQ ID NO: 5099 - protein, 423 aa, Triticum aestivum
MARKKIREYDSKRLLKEHLKRLAGIDLQILSAQVTQSTDFTELSNQEPWLSSMKLVVKPDMLFGKRGKSGLVALNLDLAQVRQFVKERLGVEVEMGGCKAPITTFIVEPFVPHDQEYYLSIMSDRLGCTISFSECGGIEIEENWDKVKTIFLPTEKPMTLDACAPLIATLPLEVRTKIGDFIRGSFSVFQDLDFSFMEMNPFTLVNGEPYPLDMRGELDDTAAFKNFKKWGDIEFPLPFGRVLSPSESYIHELDEKTSASLKFTVLNPKGRIWTMVAGGGASVIYADTVGDLGYASELGNYAEYSGAPKEEEVLHYARVVLDCATADPDGRKRALLIGGGIANFTDVAATFSGIIRALREKESKLKAARVNIYVRRGGPNYQTGLAKMRALGSELGLPIEVYGPEATMTGICKQAIDCVMAEA

SEQ ID NO: 5100 - protein, 338 aa, Triticum aestivum
  misc_feature (6)..(7): Xaa can be any naturally occurring amino acid
  misc_feature (294)..(294): Xaa can be any naturally occurring amino acid
  misc_feature (306)..(306): Xaa can be any naturally occurring amino acid
  misc_feature (326)..(326): Xaa can be any naturally occurring amino acid
PWALNXXHRSPIRTPLQNTIALYWSLSDRQLVTVRDLFRFIMHLLHQARKDAETSKPAMDEHREVESNVLCMWTNEDINRAEAAMLKVLRAVRAGRWVSWRALRGAASKAVDSQELLDYSLRGLRGKLMDDGHFIAVRCNTETSAIEYRLETYSNQSPVDATVFGPSVEHLAHDLRFLYDALLNPETMLSSQPEVVGASAHNAAARILDCKQFIKHYDECAPESPPNPILLAVRCSIELLDHPKDYTAPPVELVLLPATATLGELKMLAARVFQETYLMFHSFQAEQLPESPNXSDTPPVKHVLGXSQLGRLRGRCTGDHRRMCQXQDGEGLKNWTVD

SEQ ID NO: 5101 - protein, 128 aa, Triticum aestivum
  misc_feature (64)..(64): Xaa can be any naturally occurring amino acid
  misc_feature (73)..(73): Xaa can be any naturally occurring amino acid
  misc_feature (81)..(81): Xaa can be any naturally occurring amino acid
  misc_feature (87)..(87): Xaa can be any naturally occurring amino acid
  misc_feature (95)..(98): Xaa can be any naturally occurring amino acid
  misc_feature (106)..(106): Xaa can be any naturally occurring amino acid
  misc_feature (110)..(110): Xaa can be any naturally occurring amino acid
  misc_feature (113)..(113): Xaa can be any naturally occurring amino acid
MSGVKKVTDVAAKAGKAIDWDGLAKMLVSDEARKEFANLRRTFEDVNHQLQTKFSQEPKPIDWXEYYIKGIGXKVVDMYKXAYDSIXEFPKYFDXXXXEYKQNLDXLLTXMKXQEKHSEGSREKEWLN

SEQ ID NO: 5102 - protein, 154 aa, Triticum aestivum
  misc_feature (35)..(35): Xaa can be any naturally occurring amino acid
  misc_feature (68)..(68): Xaa can be any naturally occurring amino acid
  misc_feature (83)..(83): Xaa can be any naturally occurring amino acid
MAQLMDKAKGFVAEKISGVQKPEADLSDMSVQHVXGRDGATLSGRLDVRNPYSHTIPICEISYSLKSXAGRDVASGTMPDPGXSLVASDTTSLDIPVKVPYDFLVSLMKDAGKDWDLDYEMRVGLTVDLPIVGNFTLPLTKAGELKLPTLSDLF

SEQ ID NO: 5103 - protein, 125 aa, Triticum aestivum
MMMGYFWAPRKSAAVERDQSLRAGLLVDGGSGEAAAVPKGYFAVYVGAEARRFVVPMGYLHQPAFRALMELAAEEFGFGQAGGLRIPCREEDFVAIVAALEATAESRQRRRSAAGRKSRSNATPW

SEQ ID NO: 5104 - protein, 137 aa, Triticum aestivum
MASADEEIAGDERLDLSRLSLAERISLKLRSDRELRGNLQAYDQHLSMYLEDLEDLVISVEIDDETYEEIVRTTRRAIPFLFVRVDGVILVAPPLRTAIARRFEGVSSLIGDYEVVCVWLADDMGCLSSACSITVGL

SEQ ID NO: 5105 - protein, 412 aa, Triticum aestivum
  misc_feature (81)..(81): Xaa can be any naturally occurring amino acid
  misc_feature (115)..(115): Xaa can be any naturally occurring amino acid
MSCLGWLKKRKGSGSGRRGSSASAPATTMTTMTTTTTTTTTTGSAVSTSRSDDSGAGRPTSKSTGSASSQRSISSLYEERXHGQLRAFEYDELRAATNDFGRSQKLGEGGFGGVXKGFPRVRDPRADRIAVAVKRLNTRGLQGHKQWLAEVQFLGVLEHPNLVKLLGYCAVDGERGAQRLLVYEYMPNKSLEDHLFSRIHPALSWNRRLQIILGAAEGLAYLHEGLELQVIYRDFKASNVLLDKDFQAKLSDFGLAREGPTEGNTHVSTAAVGTHGYAAPEYIEKGHLTAKSDVWGFGVVLYELLTGRRSLDRNRPQGEQKLIEWVVQFPPDSRNFRMIMDPKLRGEYSSKAAREIAKLAQSCLLKNPKERPAMSEIVEVLRRAVQTEQAYVDKAPVAGNGKRVNVAPPSRR

SEQ ID NO: 5106 - protein, 194 aa, Triticum aestivum
  misc_feature (76)..(76): Xaa can be any naturally occurring amino acid
  misc_feature (165)..(165): Xaa can be any naturally occurring amino acid
  misc_feature (176)..(176): Xaa can be any naturally occurring amino acid
GPGWCGGCCAHHQTRSLPRPSHQPHHSARRRERFDSETREWRRRRPSPPPASPPPPRRRSTTTRTTSSASAAPAAXAQRLVAMAGSGKFFVGGNWKCNGTKESITKLVSDLNAATLESDVDVVVAPPFIYIDQVKSSLTDRIEVSAQNTWIGKGGAFTGEISAEXLVDIGCQWVIXGHSERRHVIGEDDELLGR

SEQ ID NO: 5107 - protein, 301 aa, Triticum aestivum
  misc_feature (39)..(39): Xaa can be any naturally occurring amino acid
MAAPSSLASSHPPASPPPPRPRSTTTRTTSSASAAPAAXAQRLVAMAGSGKFFVGGNWKCNGTKESISKLVSDLNAATLESDVDVVVAPPFIYIDQVKSSLTDRIEVSAQNTWIGKGGAFTGEISAEQLVDIGCQWVILGHSERRHVIGEDDQFIGKKAAYALSQNLKVMACIGELLEEREAGKTFDVCFKQMKAFADNITDWKNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 5108 - protein, 148 aa, Triticum aestivum
  misc_feature (74)..(74): Xaa can be any naturally occurring amino acid
IGKKAAYALSQNLKVMACIGELLEEREAGKTFDVCFKQMKAFADNITDWTNVVIAYEPVWAIGTGKVASPEQAXQEVHAAVRDWLKTNVSADVASTVRIIYGGSVNAANCAELAKKEDIDGFLVGGASLKGPDFATICNSVTSKKVTA

SEQ ID NO: 5109 - protein, 102 aa, Triticum aestivum
  misc_feature (59)..(59): Xaa can be any naturally occurring amino acid
  misc_feature (74)..(74): Xaa can be any naturally occurring amino acid
  misc_feature (91)..(91): Xaa can be any naturally occurring amino acid
MASADEEVAVKEPLDLIRLSLDERIYVKLRSDRELRGKLHAYDQHLNMILGDVEEIVTXIEIDDETYEEIVRTXRRTIPYLFVRGDGVILXVSPPLRTVLMA

SEQ ID NO: 5110 - protein, 140 aa, Triticum aestivum
  misc_feature (45)..(45): Xaa can be any naturally occurring amino acid
  misc_feature (61)..(61): Xaa can be any naturally occurring amino acid
  misc_feature (73)..(73): Xaa can be any naturally occurring amino acid
  misc_feature (85)..(85): Xaa can be any naturally occurring amino acid
  misc_feature (120)..(120): Xaa can be any naturally occurring amino acid
  misc_feature (130)..(130): Xaa can be any naturally occurring amino acid
  misc_feature (136)..(136): Xaa can be any naturally occurring amino acid
LQYGFPIVQKFLEGASSIDNHFYSSSFEKNIPVLLGLLSVWNVSXFLGYPARAILPYSQAXLEKLAPHIQQLXSMESNGKGVSIXDGAQLPLETGEMIWVNLGTNGQHTSYQLIHPGRVXPCDLLVLVKXHTCLLXKGKL

SEQ ID NO: 5111 - protein, 176 aa, Triticum aestivum
  misc_feature (114)..(115): Xaa can be any naturally occurring amino acid
  misc_feature (128)..(128): Xaa can be any naturally occurring amino acid
  misc_feature (139)..(139): Xaa can be any naturally occurring amino acid
  misc_feature (146)..(146): Xaa can be any naturally occurring amino acid
  misc_feature (153)..(153): Xaa can be any naturally occurring amino acid
  misc_feature (167)..(167): Xaa can be any naturally occurring amino acid
NGTKESITKLVSDLNAATLESDVDVVVAPPFIYIDQVKSSLTDRIEVSAQNTWIGKGGAFTGEISAEQLVDIGCQWVILGHSERRHVIGEDDQFIGKKAAYALSPNLKVMGMHXXVWGKRRKAGKTFXVCFKQDEGFAXDNITDWXNVVIAYXLCGYGTGKVLPKAXQESCASVIG

SEQ ID NO: 5112 - protein, 181 aa, Triticum aestivum
MWWRAVARARRRIPGARPLSTAAAGKSGREVVVPRFGGPEVLQVRQGVPAPDLKPGEVLVRARAVSINPLDLRMRSGYGRCIFEPLLPLIIGRDISGEVAATGTSVSSFYIGQEVFGALHPTAIRGTCADYAVLSQDEPSADAWVILQEASAIPFAALTAWRALYGTAGISKGYVLLHTTV

SEQ ID NO: 5113 - protein, 245 aa, Triticum aestivum
HASETVEFKPFQDQKPGTSGLRKKVVVFQQPHYSEAFITSILLSIPEGVEGSNLVIGGDGRYFNPEAIQLIAKIGAAYGVKKLIIGQNGILSTPAASHVIRIRKATGGILLTASHNPGGPKNDFGIKYNLANGGPAPESVTNKIYEFSKTLTSYKIADIPDVDITTVGTQTYGALEVEVIDSTADYVAMLKDIFDFDLIKKFFSSHPDFKVLFDGLHGVTGPYGKAIFEQELGLSNSTQNCIPSP

SEQ ID NO: 5114 - protein, 129 aa, Triticum aestivum
SIVWSPTMISLFAGYGIAGFMFYTITPFVLEMSGATLLNLSLLTSDMWAVAIRVFFYQQQINWLYYLAFAVVAIGLIIYSLNESSSADATATSTEAAAHYEQLPGEDNSTGSGSILDRKERKQQEAHIC

SEQ ID NO: 5115 - protein, 384 aa, Triticum aestivum
MARPGHSTAWLPLLVLLFAAGAAAQSGCLSATFTGGRTFLKCNQLPVLGASLHWTYHAGNGTADIAFRAPSGADGWVGWGINPSGSGMAGSNVFVASQSGGAVSVLTTILRNTAPTLDNTALSFDVPVPASAEYAGGAYTIYATVALPGNTTSQNTVWQAGPISGGRVSQHSISGPNVQSLQRLDFLSGTSTGASNSRLHRRNLHGVLNGVGWGVLIPLGAMIARYLRVFEAADPAWFYLHIACQISGYALGVAGWGLGLKLGSESKGLTYTTHRSIGIAIFCLATLQVFALFLRPDKKNKYRVYWNAYHHSVGYSVIVLAAVNIFKGLNILKPATGWKTSYVVILATLAGVVLLLEAITWAVVLRRRKRNRAHAGANGTGVQL

SEQ ID NO: 5116 - protein, 141 aa, Triticum aestivum
  misc_feature (2)..(2): Xaa can be any naturally occurring amino acid
  misc_feature (7)..(7): Xaa can be any naturally occurring amino acid
VXYITAXKFDKDANTGYATDKDGIPDGWQGLDCGEESVKLYKEAIADAKTILWNGPAGVFEFEKFASGTKATLDAVVDAVQKDGKIVIIGGGDTATVAKKYGVEDKISHVSTGGGASLELLEGKELPGVTALSSWAGKASL

SEQ ID NO: 5117 - protein, 425 aa, Triticum aestivum
VQKSEEIFNAAKELMPGGVNSPVRAFKSVGGQPIVFDSVKGSHMWDVDGNEYIDYVGSWGPAIIGHADDKVNAALIETLKKGTSFGAPCALENVLAQMVISAVPSIEMVRFVNSGTEACMGALRLVRAFTGREKILKFEGCYHGHADSFLVKAGSGVATLGLPDSPGVPKGATVGTLTAPYNDAEAVKKLFEDNKGEIAAVFLEPVVGNAGFIPPQPAFLNALREVTKQDGALLVFDEVMTGFRLAYGGAQEYFGITPDVTTLGKIIGGGLPVGAYGGRKDIMEMVAPAGPMYQAGTLSGNPLAMTAGIHTLKRLMEPGTYEYLDKVTGELVQGILDAGAKTGHEMCGGHIRGMFGFFFAGGPVHNFDDAKKSDTAKFGRFHRGMLEEGVYLAPSQFEAGFTSLAHTTLDIEKTVEAAEKVLRRI

SEQ ID NO: 5118 - protein, 516 aa, Triticum aestivum
  misc_feature (209)..(209): Xaa can be any naturally occurring amino acid
  misc_feature (272)..(272): Xaa can be any naturally occurring amino acid
  misc_feature (397)..(397): Xaa can be any naturally occurring amino acid
MELPQLASFLGVVLATVLFLKAVLRRRRREYNLPPGPKPWPIIGNLNLIGTLPHRSIHALSKQYGPLMQLQFGSFPVVVGSSVEMAKFFLKTHDVVFTDRPKTAAGRYTTYNYSDITWSPYGAYWRQARKMCLTELFSAKRLESYEYIRREEVLALLGDLYRGGAGAGRVVVLKDYLSTVSLNVITRMVMGKKYLEKEVRDEAGAVITXPREFKWMIDELFLLNGVLNIGDSIPWLDWMDLQGYIKRMKKLSKMFDRFLEHVVDEHSERRGXEGESFVVKDMVDVLLQFASDPGLEVKLNREGVKAFTQDLIAGGTESSAVTVEWALSELLKKPEVLAKATEELDRVVGRGRWVTEKDMLNLPYVDAIVKETMRLHPVAPMLVPRLSREDTSINGYXIPAGTRVLVMVWSIGRDPELWKAPEEFMPERFLGSRLDVKGQDYELLPFGSGRRMCPGYSLGLKVIQVSLANLLHGFTWRLPDGVELSMEEIFGLSTPRKYPLEAVVEPKLPAHLYAEA

SEQ ID NO: 5119 - protein, 154 aa, Triticum aestivum
MDASKLKKVAGKKFGGPRKKSVTRSVKAGLQFPVGRIGRYLKKGRYAQRVGSGAPVYLAAVLEYLAAEVLELAGNAAKDNKKTRIVPRHLLLAIRNDQELGRLLSGVTIAHGGVIPNINPVLLPKKAAEKAEKAGTAAKSPKKATKSPKKATKA

SEQ ID NO: 5120 - protein, 559 aa, Triticum aestivum
HPNPTTAGARRGGSGGGREGASGGPDRASADPAPPRPPPLPRLPPRPRLRAPAARRGRARWLRPRGCAGEAHPTGRAGLRGHLLLPPPPAPPRPHPRRRPRRRGRPAGRARTAAGPRLAPPGAAAGHSGPRRRQQAPNVVYKGKLDAQRRIAVKRFNRSAWPDPRQFLEEAKSVGQLRSKRLANLLGCCCEGDERLLVAEYMPNDTLAKHLFHWETQAMKWPMRLRVVLYLAEALEYCTSKGRALYHDLNAYRVLFDDDCNPRLSCFGLMKNSRDGKSYSTNLAFTPPEYMRTGRITPESVIYSFGTLLLDVLSGKHIPPSHALDLIRDRNFSMLTDSCLEGQFSNEEGTELVRLASRCLHYEPRERPNVRSMVQALAPLQKDVETPSYELMDMPQAGASSVQSLPLSPLADACSRKDLTAIHEILEKTGYKDDEGTANELSFQMWTNQMQDTLTSKKKGDSAFRQKDFTTAIDCYSQFIEVGTMVSPTIYARRCLSYLMNGMAEQALSDAMQALVISPTWPTAFYLQAAALLSLDMENEAQDALKDGCAQETSSSSGR

SEQ ID NO: 5121 - protein, 201 aa, Triticum aestivum
  misc_feature (75)..(75): Xaa can be any naturally occurring amino acid
  misc_feature (88)..(88): Xaa can be any naturally occurring amino acid
  misc_feature (98)..(98): Xaa can be any naturally occurring amino acid
  misc_feature (187)..(188): Xaa can be any naturally occurring amino acid
MAPLGDTVASVASAAAPGLVVSFGEMLIDFVPDVAGVSLAESGGFVKAPGGAPANVACAISKLGGSSAFVGKFGXDEFGHMLVDILKXNGVNAEGCLXFDQHARTAPGLPSTLKSHAGREFMFYRNPSADMLLTEAELNLDLIRRARIFHYGSISLITEPCRSAHVAAMRAAKSAGILCSYDPNVRXXLWPSAQAARDGIM

SEQ ID NO: 5122 - protein, 203 aa, Triticum aestivum
  misc_feature (155)..(155): Xaa can be any naturally occurring amino acid
  misc_feature (171)..(171): Xaa can be any naturally occurring amino acid
MAETVCAPCLEGMKHVRSDSGVMLAKPFLDVCKQILPVLDKFGAPMAIVKSDIGGNITRLENKYSSDPTKYEHLYTMVQEEVEKKTAKGSSSCTNGLLWLTRAMDFLVELFRNLLDHPDWTMSQACTDSYTKTLKKWHGWLASSSFTVAMKLAPXKDKFMEVISGTGDIQXADIEKFCTTFYPFLKENHDFLASVGLDDMKAS

SEQ ID NO: 5123 - protein, 146 aa, Triticum aestivum
MIWRSNKYSSDPTKYEHLYTMVQEEVEKKTAKGSSSCTNGLLWLTRAMDFLVELFRNLLDHPDWTMSQACTDSYTKTLKKWHGWLASSSFTVAMKLAPNKDKFMEVISGTGDIKADIEKFCTTFYPFLKENHDFLASVGLDDMKAS

SEQ ID NO: 5124 - protein, 204 aa, Triticum aestivum
  misc_feature (48)..(48): Xaa can be any naturally occurring amino acid
GRDCQAGVPPGLKGMKHVRSDTGVMLPKPFLDVCKQILPVLDKFGAAXAIVKSDIGGNIRRWENKYSSDPSKYEHLYTMVQEEVEKKTAKGSSSCTNGLLWLTRAMDFLVELFRNLLDHPDWTMSQACTDSYTKTLKKWHGWLASSSFTVAMKLAPNKDKFMEVISGTGDIKADIEKFCTTFYPFLKENHDFLASVGLDDMKAS

SEQ ID NO: 5125 - protein, 146 aa, Triticum aestivum
MIWRSNKYSSDPTKYEHLYTMVQEEVEKKTAKGSSSCTNGLLWLTRAMDFLVELFRNLLDHPDWTMSQACIDSYPKTLKKWHGWLASSSFTVAMKLAPNKEKFMEVISGTGDIKADIEKFCTTFYPFLKENHDFLASVGLDDMKAS

SEQ ID NO: 5126 - protein, 373 aa, Triticum aestivum
MAAAAAEMVRGFAATARAARPAATVAAPPQPRRAVAARVLRTSASEKVAADLSVAGTNGSLSALSNTDVSTDATSQAVDATPRRKTKIVCTIGPSTNTREMIWKLAETGMNVARMNMSHGDHQSHQKVIDLVKEYNAQNTDGNTVAIMLDTKGPEVRSGDLPEPIMLAEGQEFNFTIKRGVSTEDTVSVNYDDFISDVEAGDILLVDGGMMSLAVKSKTADTVKCVVVDGGELKSRRHLNVRGKSATLPSITEKDWEDIKFGVENGVDFYAVSFVKDAKVIHELKAYLKSANADIHVIPKIESADSIPNLQSIIAASDGAMVARGDLGAELPIEEVPLLQEEIIRTCRSMQKPVIVATNMLESMIDHSTPTRA

SEQ ID NO: 5127 - protein, 155 aa, Triticum aestivum
MDASATVATGKGKKGAAGRKAGGPRKKSVSRSVKAGLQFPVSRIGRFLKKGRYAQRVGSGAPVYLAAVLEYLAAELLELAGNAAKDNKKSRIIPRHLLLAIRNDEELGKLLAGITIAHAGVIPNINPVLLPKKTAEKSPKEPKSPKKTAKSPKKA

SEQ ID NO: 5128 - protein, 212 aa, Triticum aestivum
  misc_feature (69)..(69): Xaa can be any naturally occurring amino acid
  misc_feature (76)..(76): Xaa can be any naturally occurring amino acid
  misc_feature (101)..(101): Xaa can be any naturally occurring amino acid
  misc_feature (121)..(121): Xaa can be any naturally occurring amino acid
  misc_feature (147)..(147): Xaa can be any naturally occurring amino acid
  misc_feature (151)..(151): Xaa can be any naturally occurring amino acid
  misc_feature (159)..(159): Xaa can be any naturally occurring amino acid
PLEANPDVMNQFIWGLGVTEGEAQFCDVYGLDDELLAMVPQPVLAVIFLYPLTSLDEKVEEYDASATSXTAGGKDXSEKVYFTKQTVGNACGTVGVIHAIXGNAASRHQTGEGFLFWISFXKQNTDMVPFKLLSFSKEDDEWRVLIXVAAXAGDTDVNXEVNEHLSFPCVEGELITLWTNQTDSKALTTELAQDVQNKADNLIVDTHGLMNR

SEQ ID NO: 5129 - protein, 284 aa, Triticum aestivum
  misc_feature (21)..(21): Xaa can be any naturally occurring amino acid
  misc_feature (105)..(105): Xaa can be any naturally occurring amino acid
  misc_feature (113)..(113): Xaa can be any naturally occurring amino acid
  misc_feature (208)..(208): Xaa can be any naturally occurring amino acid
  misc_feature (263)..(263): Xaa can be any naturally occurring amino acid
  misc_feature (274)..(274): Xaa can be any naturally occurring amino acid
GRVGGRVGHGVFNECNWRNKXKILGVMMNWLEWVLSQSLLRIAECNPYGMDDFWLQQGTSMLLSLVKSSQEDVQERAATTIATFVVIDDETANVDAARSEAVMRXGGIPLLLXDLARCSRVSAQSEAAKAIANLSVNAKVAKVVADEGGIAIFTNLAKSTNRLVAEEAAGGLWNLSVGEEHKAAIAAAGGIKALVDLIFRWPAGTDGXVLERAAGALANLAADDKCTWEVAKAGGGHALVTLARSCKLEGRPKTGGKGSTNLXSHGNNNNNNAXVGQETGLLRH

SEQ ID NO: 5130 - protein, 458 aa, Triticum aestivum
  misc_feature (215)..(215): Xaa can be any naturally occurring amino acid
MGSQGSEEKATGQEQEGLEGGGRIEERSQKMAPVKKPKKAKRKISDSGETKIDDSSEAKTKDASKVKRTKSGGSLALLPADLRGPDTEWWYVFLSKHAELHKEAESGGRAPVPSDDEEAFRYFFRTSRRTFEYICSIVREDLISRPPSGLINIEGRLLSVEKQVAIAMRRLASGDSQVSVGAAFGVGQSTVSQVTWRFIESMEERARHHLVWPGXQERMEEIKARLEAVSGLPNCCGAIDATHIIMTLPAVESSEDWCDPAKNYSMFLQGIVDNEMRFIDIVTGWPGSMTFSRLLKCSGFYKLCEAGKRLNGPVRTSGEDSEIREFIVGDMCYPLLPWLMTPYQGESLSTPMVNFNARQKTARMLGTRALARLKGSWKILHKVMWRPDKNKLPSIILVCCLLHNIILDCNDKLLLDIQLPDHHDNGYNEENCQQENPNGKVIREIITGYLPTYEATSN

SEQ ID NO: 5131 - protein, 198 aa, Triticum aestivum
  misc_feature (25)..(25): Xaa can be any naturally occurring amino acid
  misc_feature (75)..(75): Xaa can be any naturally occurring amino acid
EAWIHVDFMAGRFVPNITIGPLIVXALRPVTDLPLDVHLMIVEPEQRIPDLSKAGADIVSVHCEQTATIHLHRQXDQIKSLGAKAGVVLNPGTPLSAIVRAPAPAGLVLIMSVNPGFGGQSFIESQVKKIADLRKLCEEKGVNPWIEVDGGVSPKNAYKVIEAGANALVAGSAVFGAKDYAEAIKGIKTSKRPVAVAA

SEQ ID NO: 5132 - protein, 205 aa, Triticum aestivum
  misc_feature (105)..(105): Xaa can be any naturally occurring amino acid
  misc_feature (138)..(138): Xaa can be any naturally occurring amino acid
  misc_feature (146)..(146): Xaa can be any naturally occurring amino acid
  misc_feature (163)..(163): Xaa can be any naturally occurring amino acid
  misc_feature (171)..(171): Xaa can be any naturally occurring amino acid
  misc_feature (180)..(181): Xaa can be any naturally occurring amino acid
  misc_feature (188)..(188): Xaa can be any naturally occurring amino acid
  misc_feature (190)..(190): Xaa can be any naturally occurring amino acid
  misc_feature (195)..(195): Xaa can be any naturally occurring amino acid
  misc_feature (199)..(200): Xaa can be any naturally occurring amino acid
MASPSSSLCSSLGYPRAASLGARRRAGFSSSRKLFQVKASRVDSFSKSDIIVSPSILSANFAKLGEQVKAVEVAGCDWIHVDVMDGRFVPNITIGPLIVDALRPXTDLPLDVHLMIVEPEQRIPDFIKEGADIVTVHXEQTATIHXLHRTFIQIKILRSKTEXVFEPLGPXLNAIEYVLXXVYLVMIXHXPGLGXKVYXXQFKKC

SEQ ID NO: 5133 - protein, 212 aa, Triticum aestivum
  misc_feature (58)..(58): Xaa can be any naturally occurring amino acid
  misc_feature (72)..(72): Xaa can be any naturally occurring amino acid
  misc_feature (124)..(124): Xaa can be any naturally occurring amino acid
  misc_feature (194)..(194): Xaa can be any naturally occurring amino acid
MAALAASMATSTAFAAKPRLVRPPARLSVSCSASSGDNNTPSLSASIKTFSAALGALXSVLLSSAATSPPPXAADIAGLTPCKESKAFAKREKQSVKKLNSSLKKYAPDSAPALAIQANIEKTXRRFENYAISAALPSDGLPTHRQRGQRHWGEFITPGVLFLYIAGWIGWVGRSILIAVRGENNPGMREIIIXVELAARIIPRGFIWTVAA

SEQ ID NO: 5134 - protein, 208 aa, Triticum aestivum
  misc_feature (52)..(52): Xaa can be any naturally occurring amino acid
  misc_feature (55)..(55): Xaa can be any naturally occurring amino acid
  misc_feature (71)..(71): Xaa can be any naturally occurring amino acid
  misc_feature (90)..(90): Xaa can be any naturally occurring amino acid
  misc_feature (96)..(96): Xaa can be any naturally occurring amino acid
  misc_feature (195)..(195): Xaa can be any naturally occurring amino acid
  misc_feature (202)..(203): Xaa can be any naturally occurring amino acid
MAATAGGNKIRNAKLVLLGDVGAGKSSLVLRFVKGQFVEFQESTIGAAFFSXTLXVNDETVKFEIWDTAGXERYHSLAPMYYRGAAAAIXVYDITXRAASFTRAKKWVQELQAQGNPNTVVALAGNKADMLEARQVPVEEATTYAQENGLFFIETSAKTAINVNDVFYELAKRLLAGQQTQNPASGGWCSPKKPXAEKIVSXXSCCSS

SEQ ID NO: 5135 - protein, 169 aa, Triticum aestivum
  misc_feature (9)..(9): Xaa can be any naturally occurring amino acid
MAPTVMASXATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMCKLPMFGCTDATQVINEVEEVKKEYPDAYVRIIGFDNMRQVQCVSLIAYKPPGC

SEQ ID NO: 5136 - protein, 168 aa, Triticum aestivum
MAPTVMASSVTSVDPFQGLMSTAGLPVSRRSDGASLGSVSNGGRIRCMQVWPIEGIKKFETLSYLPPFSTEALLKQVDYLIRSKWVPCLEFSKVGFIFREHNASPGYYDGRYWTMWKLAMFGCTDATQVINEVEEVKKEYPDAYVRIIGFDNMRQVQCVSFIAFKPPG

SEQ ID NO: 5137 - protein, 210 aa, Triticum aestivum
TLPDWSTRTLTWTEAVKKLARVPPPEQAIYLHTTAVAPTVMASSGTSVAPFQGLKSTAGLPVSRRSNGASLGSVSNGGRIRCMQVWPIEGIKKCDTLSYLPPLSTEALLKQVDYLIRSKWVPCLEFSKVGFIFREHNASPGYYDGRNWTMWKLPMFGCTDAIQVINEVDEVKKEYPDAYVRIIGFDNMRQVQCVSFIAFKPPGCDESGKA

SEQ ID NO: 5138 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWNLPMFGCTDATQVINEVEEVKKEYPDAYVRIIGFDNMRQVQCVSFIAFKPPGCEESGKA

SEQ ID NO: 5139 - protein, 175 aa, Triticum aestivum
MAPTVMASSATSVVPFQGLKSTVGLPVSRRSNGASLGSVSNGGRIRCLQVWPIEGIKKFETLSYLPPISREALLKQVDYLIRSKWVPCLEYSKVGFIFREHNASPGYYDGRYWTMWKLPMFGCTDATQVINEVEEVTKEYPDAYVRIIGFDNMRQVQCVSFIAFKPPGCEESGKA

SEQ ID NO: 5140 - protein, 175 aa, Triticum aestivum
MGPTVMASSATSVAPFQGLKSTAGLPVSRRSNGASLGSVSNGGRIRCMQVWPIDVIKKWETLSYLPPLSTEALLKQVDYLIRSKWVPCLEFSKVGFIFREHNASPGYYDGRYWTMWKLPMFGCTDATQVINEVEEVKKEYPDAYVRIIGYDNMRQVQCVSFIAFKPPGCDESGKA

SEQ ID NO: 5141 - protein, 175 aa, Triticum aestivum
  misc_feature (90)..(90): Xaa can be any naturally occurring amino acid
MGPTVMASSVTSVAPFQGFKSTAGLPVSRRSNGASLGSVSNGGRIRCMQVWPIKGIKKFEILSYLPPVSTEALLKQVDYLIRSKWVPCLXFSKVGFIFREHNASPGYYDGRYWTMWKLPMFGCTDATQVINEVEEVKKEYPDAYVRIIGFDNMRQVQCVRFIAFKPPGCKESGKA

SEQ ID NO: 5142 - protein, 175 aa, Triticum aestivum
MAPTVMASSDTSVAPFQGLKSTAGLPVRRRSNGSSLGSVSNGGRIRCMQVWPIEGIKKCETLSYLPPISTEALLKQVDYLIRSKWVPCLKFSKVGFIFREHNASPGYYDGRYWTMWKLPMFGCTDATQVINEVEEVKKEYPDAYVRIIGFDNMRQVQCVRFIAFKPPGCEESGKA

SEQ ID NO: 5143 - protein, 175 aa, Triticum aestivum
MAPTVMASSATSVAPFQGLKSTAGLPVSRRSNGASLGSVSNGGRIRCMQVWPIEGIKKFESLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 5144 - protein, 175 aa, Triticum aestivum
MAPTVMASSATSVAPFQGLKSTAGLPVSRRSNGASLGSVSNGGRIRCMQVWPIEGIKKFETLSYLPPVSTEALLKQVDYLIRSKWVPCLEYSKVGFIFREHNASPGYYDGRYWTMWKLPMSGCTDATQVINEVEEVKKEYPDAYVRIIGYHNMRQVQCVSFIAFKPPGCEESGKA

SEQ ID NO: 5145 - protein, 177 aa, Triticum aestivum
  misc_feature (146)..(146): Xaa can be any naturally occurring amino acid
  misc_feature (170)..(170): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVXRIIGFDNMRQVQCVSFIAFKPPGXCEESGKA

SEQ ID NO: 5146 - protein, 149 aa, Triticum aestivum
  misc_feature (84)..(84): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSXKWVPLPRSSSKVGVHLPVEHNAIPPGVLRIGPGTGTMWESCLCFGMQPDAQRQVINKWREGQRKE

SEQ ID NO: 5147 - protein, 167 aa, Triticum aestivum
  misc_feature (105)..(105): Xaa can be any naturally occurring amino acid
MHDFCFTIPYGFVALAGGLLGYLRRGSTASLAGGAGVGGLLLLAGFVSLKAFEKRRNSYLALALESLCALALTFVMGQRYLEISKIMPAGVVAGLSALMSAFYLXQIATGGNHFSPKKDYARRGLAKPKDHVAYCVLHSNCNLTDVLCSACTFAQMSCMWTWKVFTM

SEQ ID NO: 5148 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQWVSFFAFKPPGCEESGKA

SEQ ID NO: 5149 - protein, 502 aa, Triticum aestivum
  misc_feature (121)..(121): Xaa can be any naturally occurring amino acid
  misc_feature (249)..(249): Xaa can be any naturally occurring amino acid
MVATAKIPQRQLFIDGDWRAPALGRRLPVINPTTEASIGEIPAGTSEDMDAAVAAARAALKRNRGRDWSRAPGAVRAKYLRAIAAKMIERKSDLARLEALDCGKPLDEAAWDMDDVAGCFXFFAGHAEALDKRQNAAVALPENFKCHLKKEPIGVVALITPWNYPLLMAVWKVAPALAAGCTAVLKPSELASVTCLELGDVCKEIGLPSGVLNIVTGLGNEAGAPLSSHPDVDKVAFTGSYATGQKIMXAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGEGGIDNYLSIKQVTEYTSDAPWGWYKAPA

SEQ ID NO: 5150 - protein, 216 aa, Triticum aestivum
GPVTVAAARCLILTPTVSSSSAALRLPRIARRRPLSCSASPLAVFATMDSPPEGYRTNVGICLADPSLTKIFSASRIDIPTAWQMPQGGIDQGEEPRAAAVRELREETGVRSAEIVAEAPNWLTYDFPADVKDKLNARWGTNWKGQAQKWFLFRLTGGDDEINLMGDGSEKPEFSEWAWMTPQQVIEKAVDFKKPVYEETLKHFAPYLQSDPTASS

SEQ ID NO: 5151 - protein, 107 aa, Triticum aestivum
LAWSRPRSEAPNWLTYDFPADVKDKLNARWGTNWKGQAQKWFLFRLTGGDDEINLMGDGSEKPEFSEWAWMTPQQVIEKAVDFKKPVYEETLKHFAPYLQSDPTASS

SEQ ID NO: 5152 - protein, 176 aa, Triticum aestivum
  misc_feature (132)..(132): Xaa can be any naturally occurring amino acid
  misc_feature (158)..(158): Xaa can be any naturally occurring amino acid
MAPTVMASSATSVGPFQGLKSTVGLPVSRRSNGASLGSVSNGGRIRCMHVWPIEGGGKVDTLSYLPPLRTEALLEQVDYLIRSKWVPCLEFSKVGFIFRDHNTSPGYYDGRYWTMWKLPMFGCTDATQVINXVEEVKKEYPDAYVRIIGFDNMRQVQXCVSFIAFKPPGCEESGKV

SEQ ID NO: 5153 - protein, 157 aa, Triticum aestivum
  misc_feature (83)..(83): Xaa can be any naturally occurring amino acid
  misc_feature (95)..(95): Xaa can be any naturally occurring amino acid
  misc_feature (98)..(98): Xaa can be any naturally occurring amino acid
  misc_feature (110)..(110): Xaa can be any naturally occurring amino acid
  misc_feature (116)..(116): Xaa can be any naturally occurring amino acid
  misc_feature (124)..(124): Xaa can be any naturally occurring amino acid
  misc_feature (127)..(127): Xaa can be any naturally occurring amino acid
MAPTVMASSATSVAPFQGLKSTAGLPVSRRSNGASLGSVSNGGRIRCMQVWPIEGIKKFETLSYLPPLKHGGLLKQVDYLIRXKWVPCLRFSKLXYLXVRQRTPGYYDGXYWDMWXCLVRCTDXPGXNEVEESRRIPDPIPHQVNIACLSHGLDPAK

SEQ ID NO: 5154 - protein, 184 aa, Triticum aestivum
PGIYLHSTTLAPPRDGLSATSVVPFPGLSPTAALPVSPAPNGASFGSVSNGGRIRCMQVWPIEGIKKFETLSYLPPLSTEALLKQVDYLIRSKWVPCLEFSKVGFIFREHNTSPGYYDGRYWTMWKLPMFGCTDATQVINEVEEVKKEYPDAYVRIIGFDNMRQVQCVSFIAFKPPACEESGKA

SEQ ID NO: 5155 - protein, 176 aa, Triticum aestivum
  misc_feature (164)..(164): Xaa can be any naturally occurring amino acid
MAPTVMASSATSVVPYQGLKSTAGLPVSRRSNGASLGSVSNGGRIRCMQVWPIEGIKKLETLSYLPPLSTEALLKQVEYLIRSKWVPCLEFSKVGFIFREHNTSPGYYDGRYWTMWKLPMYGCTDSTQVINEVEEVMKEYPDAYVRIIGFDNMRQVQCVSFIAXFKPPGCEESGKA

SEQ ID NO: 5156 - protein, 102 aa, Triticum aestivum
  misc_feature (33)..(33): Xaa can be any naturally occurring amino acid
  misc_feature (52)..(52): Xaa can be any naturally occurring amino acid
  misc_feature (70)..(70): Xaa can be any naturally occurring amino acid
  misc_feature (88)..(88): Xaa can be any naturally occurring amino acid
MAPTVMASSATSVAPFQGLKSTAGLPVSRRSNXLALGSVSNGGRIRCMQVWXPSRGIKKFETLSYLPPLXAREGLLKQVDYLIRSKWXCPCLQFNKVGFIFP

SEQ ID NO: 5157 - protein, 219 aa, Triticum aestivum
MAPRVPSSSLLLVGAALLLGLAAGAARASNEEGDALYALRMRLSDPNGVLQSWDPTLVNPCTWFHVTCDTASRVVRLDLGNSNVSGSIGPELSRLVNLQYLELYRNNLNGEIPKELGKLKNLISLDLYANKLTGRIPKSLSKLGSLRFMRLNNNKLAGSIPRELAKLSNLKVIDLSNNDLCGTIPVDGPFSSFPLRSFENNSRLNGPELQGLVSYDFGC

SEQ ID NO: 5158 - protein, 220 aa, Triticum aestivum
  misc_feature (105)..(105): Xaa can be any naturally occurring amino acid
  misc_feature (195)..(195): Xaa can be any naturally occurring amino acid
MAPRVPSSSLLLVGAALLLGLAAGAARASNEEGDALYALRMRLSDPNGVLQSWDPTLVNPCTWFHVTCDTASRVVRLDLGNSNVSGSIGPELSRLVNLQYLELYXNNLNGEIPKELGKLKNLISLDLYANKLTGRIPKSLSKLGSLRFMRLNNNKLAGSIPRELAKLSNLKVIDLSNNDLCGTIPVDGPFSSFPXLRSFENNSRLNGPELQGLVSYDFGC

SEQ ID NO: 5159 - protein, 276 aa, Triticum aestivum
MGNRLPAGCGFKKERLPHFHNRPSSSSSPSHATAEQQQQPRRSTPRSSPPQTRPLLAAMAPRVPSSLLLVGAALLLGLAAGAARASNEEGDALYALRMRLSDPNGVLQSWDPTLVNPCTWFHVTCDTASRVVRLDLGNSNVSGSIGPELSRLVNLQYLELYRNNLNGEIPKELGKLKNLISLDLYANKLTGRIPKSLSKLSSLRFMRLNNNKLAGSIPRELAKLSNLKVIDLSNNDLCGTIPVDGPFSSFPLRSFENNSRLNGPELQGLVSYDFGC

SEQ ID NO: 5160 - protein, 173 aa, Triticum aestivum
  misc_feature (123)..(123): Xaa can be any naturally occurring amino acid
  misc_feature (126)..(126): Xaa can be any naturally occurring amino acid
  misc_feature (130)..(130): Xaa can be any naturally occurring amino acid
  misc_feature (141)..(141): Xaa can be any naturally occurring amino acid
  misc_feature (148)..(148): Xaa can be any naturally occurring amino acid
  misc_feature (155)..(155): Xaa can be any naturally occurring amino acid
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLTAKLEGDDLDVFKKNVESATKYLLXQLXDLQXFVGESMHDDGXVVFAYYXEGAADPXFLYLAHGLKEASANRTGC

SEQ ID NO: 5161 - protein, 204 aa, Triticum aestivum
LRLRAASSRPSWWVLLGDLGAGKTSIVVRFVKGLYYECQESTIGAAFFSQALPVSRGGEDATVRFDIWDTAGQERYHSLAPMYYRGAAAAVVVYDITSMDSYIRAKRWVDELQRQGNPHLVMALVGNKVDLEKKRKVGTQEALEYAERNGLFFLETSAKTAQNVGELFYELAERLVKVRPNHPAGMVLHDGQRGVGGRWFCCSG

SEQ ID NO: 5162 - protein, 140 aa, Triticum aestivum
  misc_feature (69)..(69): Xaa can be any naturally occurring amino acid
  misc_feature (82)..(82): Xaa can be any naturally occurring amino acid
  misc_feature (92)..(92): Xaa can be any naturally occurring amino acid
  misc_feature (97)..(97): Xaa can be any naturally occurring amino acid
  misc_feature (118)..(118): Xaa can be any naturally occurring amino acid
  misc_feature (127)..(127): Xaa can be any naturally occurring amino acid
  misc_feature (130)..(130): Xaa can be any naturally occurring amino acid
MAPTVMASSATSVAPFQGLKSTAGLPVSRRSNGASLGSVSNGGRIRCMQVWPIEGIKNSETLSYLPPLXSTEASSKQVDYLXIRSKWVPCLXFSKLXHLPVSTTTPGYYDGRSGTMWXLPISGCTDXTMXNEVEESRRIP

SEQ ID NO: 5163 - protein, 175 aa, Triticum aestivum
MAPTVMASSVTSVAPFQGLKSTAGLPVSRRSNGASLGSVSNGGRIRCLQVWPIDGIKKVEILSYLPPLSTEALLKQVDYLIRSKWVPCLEYSKVGFIFREHNASPGYYDGRYWTMWKLPMFGCTDATQVINEVEEVNKEYPDAYVRIIGFDNMRQVQCVSFIAFKPPGCEESGKA

SEQ ID NO: 5164 - protein, 177 aa, Triticum aestivum
  misc_feature (27)..(27): Xaa can be any naturally occurring amino acid
  misc_feature (67)..(67): Xaa can be any naturally occurring amino acid
MAPTVMASSATSVAPFQGLKSTAGPPXSARRSNGASLGSVSNGGRIRCMQVWPIEGIKKFETLSYLXPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 5165 - protein, 190 aa, Triticum aestivum
  misc_feature (90)..(90): Xaa can be any naturally occurring amino acid
  misc_feature (106)..(106): Xaa can be any naturally occurring amino acid
  misc_feature (125)..(125): Xaa can be any naturally occurring amino acid
  misc_feature (139)..(139): Xaa can be any naturally occurring amino acid
  misc_feature (151)..(151): Xaa can be any naturally occurring amino acid
  misc_feature (156)..(156): Xaa can be any naturally occurring amino acid
  misc_feature (160)..(160): Xaa can be any naturally occurring amino acid
  misc_feature (163)..(163): Xaa can be any naturally occurring amino acid
  misc_feature (169)..(169): Xaa can be any naturally occurring amino acid
  misc_feature (174)..(174): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLXFNKVGFIFREHNASPXGTMMAGTGQCGNCLSSVQXRHTMINKVEEVKKXYPDPMSAIIGFXKMRKXKWVXFNXLKPPGXKDPGXAKKSPKGNKGIDFLNN

SEQ ID NO: 5166 - protein, 566 aa, Triticum aestivum
  misc_feature (152)..(152): Xaa can be any naturally occurring amino acid
MHSVSISASASASAIASGGARSKAAAGRRPGEIRFCGLRGDALACGSLRASHAAAATRRAVLRAAASANGAAGSGDGFDYDLVIIGAGVGGHGAALHAVEEGLKTAIIEGDVVGGTCVNRGCVPSKALLAVSGRMRELHDEHHMKSLGLQVXSTGYDRQAVADHANNLASKIRSNLTNSMKAMGVDILTGFGKIVGKQKVRYGKVGFPEKEITAKNIIIATGSVPFVPKGIEIDGKTVFTSDHALKLESVPDWIAIVGSGYIGLEFSDVYTALGSEVTFVEALDQLMPGFDPAIAKLAQRVLINPRKIDYHTGVFASKITPAKDGKPVLIELIDAKTKEHKETLEVDAALIATGRAPFTNGLGLENINVVTQRGFIPVDERMQVTDADGNVVPNLFCIGDANGKLMLAHAASAQGISVVEQISGRDHILNHLSIPAACFTHPEISMVGLTEPQAREKADNEGFEVSVVKTSFKANTKALAENEGDGIAKMIYRPDTGEILGVHILGLHAADLIHEASNAIALGTRLQELKLAVHAHPTLSEVLDELFKAAKVNSGVSHSVNEPVAA

SEQ ID NO: 5167 - protein, 253 aa, Triticum aestivum
DDTRIRASVPTIKFLLEKGAKVILASHLGRPKGVTPKYSLKPLVPRLSELLGVEVVMANDCIGEEVEKLVAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSTKIGVIESLLAKVDILILGGGMIYTFYKAQGYSVGKSLVEEDKLELATSLIEKAKAKGVSLLLPTDIVVADKFAADAESKIVPATA

SEQ ID NO: 5168 - protein, 248 aa, Triticum aestivum
  misc_feature (33)..(33): Xaa can be any naturally occurring amino acid
  misc_feature (66)..(66): Xaa can be any naturally occurring amino acid
  misc_feature (97)..(97): Xaa can be any naturally occurring amino acid
  misc_feature (116)..(116): Xaa can be any naturally occurring amino acid
  misc_feature (183)..(183): Xaa can be any naturally occurring amino acid
  misc_feature (209)..(210): Xaa can be any naturally occurring amino acid
  misc_feature (220)..(220): Xaa can be any naturally occurring amino acid
  misc_feature (224)..(224): Xaa can be any naturally occurring amino acid
MATKRSVGTLGEADLKGKKVFVRADLNVPLDDXKKITDDTRIRASVPTIKFLLEKGAKVILASHLXGRPKGVTPKYSLKPLVPRLSELLGVEVVMAXDCIGEEVEKLAAALPEGGXVLLLENVRFYKEEEKNEPEFAKKLASVADLYVNDAFGTAHRAHASTEGVTKYLKPAVAGFLMQKELXDYLVGSCCQPKEPFSALLGGFQGSNXXWCIDPLLAKXHILXLGGGMILHIFRHKISRLEIPWKKG

SEQ ID NO: 5169 - protein, 198 aa, Triticum aestivum
RLGIVAYTGILFGESATKGAHFIELCGQRGIPLLFLQNISGFMVGRQYESGGIAKDGAKMVMAVACANVPKLTVVMGGSFGAGNYGMCGRAYSPRFMWMWPNARISVMGGDQAAAVLSTIQRDNAEKAGKKFSAEAQAKFEAPIKAKYDKEGSAYFSSARLWDDGVIDPADTRRVLGQALSAALNAPAKPTKFGVFRM

SEQ ID NO: 5170 - protein, 175 aa, Triticum aestivum
MAPTVMGWSGTCAGPLQGLKSTVGLPVSRRYNGASLGSVSNGGRIRCMQVWPIEGIKKCETLSYLPPVSAEALLKQVDYLIRSKWVPWLEFSKVGFIFREHNASPGYYDGRYWTMGKLPMFGCTDATQVINEVEEVKKEYPDAYVRIIGFDNMRQVQCVSFIAFKPPGCEESGKA

SEQ ID NO: 5171 - protein, 125 aa, Triticum aestivum
  misc_feature (59)..(59): Xaa can be any naturally occurring amino acid
  misc_feature (65)..(65): Xaa can be any naturally occurring amino acid
  misc_feature (118)..(118): Xaa can be any naturally occurring amino acid
  misc_feature (120)..(120): Xaa can be any naturally occurring amino acid
  misc_feature (124)..(124): Xaa can be any naturally occurring amino acid
MAPTVMASSATSVAPFQGLKSTAGLPVSRRSNGASLGSVSNGGRIRCMQVWPIEGIKKXSKTLSXLPTLKQREGLLKARSELTLIRFKVGLPCLRSSTRVGFNFREQNATPGYYDGRXWXMWKXP

SEQ ID NO: 5172 - protein, 169 aa, Triticum aestivum
  misc_feature (6)..(6): Xaa can be any naturally occurring amino acid
  misc_feature (16)..(16): Xaa can be any naturally occurring amino acid
MLVYQXKLSGDELLSXDSFPYRELENGVLWEVDGHWVVQGAVDVDIGANPSAEGGGDDEGVDDQAVKVVDIVDTFRLQEQPAFDKKQFISHMKRYIKNLSAKLEGDDLDAFKKNVESATKYLLSKLKDLQFFVGESMHDDGGVVFAYYKEGAADPTFLYFAHGLKEVKC

SEQ ID NO: 5173 - protein, 175 aa, Triticum aestivum
MPPPVMAWSATSVAPLQGLESTGVLPVSRRSNGDSLDSVSNGGRIMCMQVWPIEGIKKFETLFYLRPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 5174 - protein, 241 aa, Triticum aestivum
MAANLEDVPSVDLITEVLRRAKCSSKPDKRIILVGPPGSGKGTQSPLIKDEYCLCHLATGDMLRAAVAAKTPLGIKAKEAMNKGELVSDDLVVGIIDEAMKKPSCQKGFILDGFPRTVVQAQKLDDMLAKQGAKVDKVLNFAIDDAILEERITGRWIHPSSGRSYHTKFAPPKTPGVDDVTGEPLIQRKDDTAVVLKSRLEAFHMQTEPVIDYYSKNGLVANLHAEKPPKEVTVEVQKALS

SEQ ID NO: 5175 - protein, 85 aa, Triticum aestivum
MAANLEDVPSVDLITEVLRRAKCSSKPDKRIILVGPPGSGKGTQSPLIKDEYCLCHLATGDMLRAAVAAKTPLGIQAKEAMNKGE

SEQ ID NO: 5176 - protein, 317 aa, Triticum aestivum
  misc_feature (135)..(135): Xaa can be any naturally occurring amino acid
LARSPCSAAYPYHTALGTGKTTLSTDHNRLLIGDDEHCWSDNGVSNIEGGCYAKCIDLSREKEPDIWNAIKFGTVLENVVFDEHTREVDYTDKSVTENTRAAYPIEYIPNAKIPCVGPHPKNVILLACDAFGVLXPPVSKLNLAQTLYHFISGYTALVAGTEDGIKEPQATFSACFGAAFIMLHPTKYAAMLAEKMQTYGATGWLVNTGWSGGRYGVGKRIKLPYTRKIIDAIHSGELLTANYQKPEVFGLEIPTAIEGVPSEILDPINTWTDKAAYKETLLKLAGLFGKNFEVFASYKIGEDSTLTEEILAAGPKV

SEQ ID NO: 5177 - protein, 168 aa, Triticum aestivum
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLTAKLEGDDLDVFKKNVESATKYLLSKLKDLQFFVGESMHDDGGVVFAYYKEGAADPTFLYFAHGLKEVKC

SEQ ID NO: 5178 - protein, 346 aa, Triticum aestivum
MGTRHLITGQNNCAPDGASSSNPFGALANTLFGQSNKAESLKGLPGASVNVPTTSDYSTAPLSTVPGSENEFKQDQRPFARGADFMRGGPANDWVESFRPPGHSAFGGPEANFAEFEQIYNNAGPTLGPALDGPPQRVLSGVLHSFLSSGRAGVPFQPVPVPALGLSEADKQCIRDRSCIMARHILADQPEEYIQAQVNTLLHSLDIDNSHRMKNPWHGPYPEMEEYWNQSQSALRSGPMHNAANNWISEFGKQNNNPEGWITEFGKQNNNPEGWAHSFEQQYGPNGWASEFEQHQSQMAMDQMGGANMANLAAMQQSRMLAETLSSNNDPKFQNSKLAKIGSRVP

SEQ ID NO: 5179 - protein, 288 aa, Triticum aestivum
  misc_feature (40)..(40): Xaa can be any naturally occurring amino acid
  misc_feature (99)..(99): Xaa can be any naturally occurring amino acid
  misc_feature (121)..(121): Xaa can be any naturally occurring amino acid
MGHHATARAAVYSARRRAPRIGGMGCGGTSVALGQRRPRXVLGEQGYARLTRGGKRERVVVPAGHCLPDPEGGFLNNAPRWPEVACTVWPPVFMTHHLXSPGESFLIHGGLDGIGTFAIQXIAKHLVVRVLVTAGSEEKLAACKGLGADVCINYKTEDFVARVKEETDGKGVDVILDNIGASYLQRNLNSLAVDGRLFIIGFMGGTTTEVNLQAMLARRLTIQAAGLRNRSLANKAQIVSEVEKNVWPAVVSGKVKPVIYKTFPLSEAAESHKLMETSSHIGKILLIP

SEQ ID NO: 5180 - protein, 327 aa, Triticum aestivum
MRAVAIASPGGPEALQVREVEDLPAPGEGEVLVAVAAAGVNRADTVQRQGRYPPPPGASPYSGLECSGTILALGANVPPRWAVGDQVCALLTGGGYAEKVVVPAGQLLPVPEGVSLADAAGLPEVACTVWSTVFMTSHLSPGESFLIHGGSSGIGTFAIQIAKHLGVKVFVTAGSEEKLAACKGLGADVCINYKTEDFVARVKEETNGKGVDVILDNIGGSYLQRNLNSLAVDGRLFIIGFMGGTTTEVNLQAMLARRLTIQAAGLRNRSLANKAQIVSEVEKNVWPAVASGKVKPVIYKTFPLSEAAESHKLMETSSHIGKILLIP

SEQ ID NO: 5181 - protein, 173 aa, Triticum aestivum
  misc_feature (34)..(34): Xaa can be any naturally occurring amino acid
FYKAQGYAVGKSLVEEDKLELATSLIEKAKAKGXSLLLPTDVVVADKFAADAESKTVAASAIPDGWMGLDVGPDAIKTSSEALDTCNTIIWNGPMGVFEFEKFAAGTDAIAKKLADLTTTKGATTIIGGGDSVAAVEKAGLADKMSHISTGGGASLELLEGKTLPGVLALDEA

SEQ ID NO: 5182 - protein, 174 aa, Triticum aestivum
  misc_feature (103)..(103): Xaa can be any naturally occurring amino acid
  misc_feature (108)..(108): Xaa can be any naturally occurring amino acid
  misc_feature (111)..(111): Xaa can be any naturally occurring amino acid
  misc_feature (128)..(128): Xaa can be any naturally occurring amino acid
  misc_feature (142)..(143): Xaa can be any naturally occurring amino acid
  misc_feature (145)..(146): Xaa can be any naturally occurring amino acid
  misc_feature (154)..(156): Xaa can be any naturally occurring amino acid
  misc_feature (162)..(162): Xaa can be any naturally occurring amino acid
  misc_feature (167)..(167): Xaa can be any naturally occurring amino acid
REQKLELHRGGGRSRTSGSPGLQEFGTSPNLRGRRSHPIIAPPPPPPAPPDPSLPRHPPGRDRRPPAAGGGGGGSPATGAMEADGAAPAEAKPLTPEEEALRXNTDCXYFXASPLTCKKGNQCDFRHXEGARMNPKNWYYWXXWXXLNPKCSFXXXPIDGMXGASTXGNNLECL

SEQ ID NO: 5183 - protein, 144 aa, Triticum aestivum
MPRAGLSAGSSKVDVAIDLGNPLLNRTVDGFLKIGAVGACRVAAEDAFDCLQSGSVSKRKLEKTLEKMCKEGAYWGAVAGVYVGMEYGVERVRGEYDWKNALIGGIASGTLISAASNNKGNKIAKDAITGGAIATAIEFINYLT

SEQ ID NO: 5184 - protein, 132 aa, Triticum aestivum
  misc_feature (58)..(58): Xaa can be any naturally occurring amino acid
MPRAGLSAGSSKVDVAIDLGNPLLNRTVDGFLKIGAVGAFRVAAEDAFDCLQSGSVSXRKLEKTLEKMCKEGAYWGAVAGVYVGMEYGVERVRREYGWMRQLKGKVDIFSRADGSALFEMGNTRVIAAVYGP

SEQ ID NO: 5185 - protein, 152 aa, Triticum aestivum
GKRFGVEQYEMRTFSRDREKLENLKLGEGVKGVYVSVDVDCLDPAFAPGVSHIEPGGLSFRDVLNILQNLQGDVVAGDVVEFNPQRDTVDGMTAMVAAKLVREAERPRSQNEQRQVRTEATKRIFNHKWSFDFNFCQINQFAKFGPDNPPIK

SEQ ID NO: 5186 - protein, 360 aa, Triticum aestivum
  misc_feature (160)..(160): Xaa can be any naturally occurring amino acid
  misc_feature (308)..(308): Xaa can be any naturally occurring amino acid
MEVTPKHTQAVSGWAAMEPSGEVVPFAFKRRENGVDDVTIKVHYCGMCHTDLHFINNDWGITMYPLVPGHEITGVVTRVGANVSGFRPGDRVGLGCIAASCLDCDHCRRSEENYRDKVALTYNGIFWDGSVTYGGYSSMLVAHKRFLVRIPDALPLDAAXAPLLCAGITVYSPMKQHGMLQAGRRLGVVGLGGLGHVAVKFGKAFGLKVTVISTSPAKEREARESLKADDFVLSTDERQMQGMARSLDYVIDTVSAQHSLGPILELLKVNGKLVLVAAPDKPVELPSFPLIFGKRTVSGSMTGGMKEXTQEMMDLCGEHGITADIELVSTDGINDALARLARNDVRYRFVVDVAETGSRL

SEQ ID NO: 5187 - protein, 443 aa, Triticum aestivum
ARGQANLVDENGEIELYAKNDGLREAELSLQEGGSLNYEEARALLAKVEYQQGHVEEALRVLDGINMAELIPMVKMSICRLARADPHSSYPPMSLHTVNLVMETIYLKTIALRDLGKFPTRPQECSTILDVVESALPMGLPAKFGDGSNLNATIHSAVELLPELWKLADFPPKVLSSYRGALLSNWNLDAKAIGRIQKEFAIFLLYSGCEACTPPLRSQLDGSFVPRNNLEEAILLLMILLMKFNLKRLERDPTVMHHLTFALAISRRVKPLAGQFEKLLPGVLHSREWLYNVALCYLAEEDDLAALNLLKMILRFGEHSSCLKELLLTSKICSENVAHAEEGASYARRALASLDGGCDQLEVVADLLLGISLSRQARYAPSGTERASQQREALKVLGVAEKKMEGKDLRVLYNLSLETAEQRKLHAAALNAKKLLNSENGSE

SEQ ID NO: 5188 - protein, 491 aa, Triticum aestivum
  misc_feature (416)..(416): Xaa can be any naturally occurring amino acid
  misc_feature (459)..(459): Xaa can be any naturally occurring amino acid
  misc_feature (482)..(482): Xaa can be any naturally occurring amino acid
MLVTLTTLLLSLIQQWELILLALVSVVTLLLLTRSRSRCSQKEMKLPPGPAPVPFLGNLHQLGRLPHRTLRDLARLHGPVMQLQLGKAPTVVLSSPDAAWEGLKVHDLDCCTRPVSPGPKRLTYDLKNVAFAPFGSYWRNIRKLLVVELLSGRRVKAAWYARQEQVDKLISTLMRAGGKPVALDEHILSLSDGIIGTVAFGNIYGSDKFTQNNNFQHALDEAAEVLSSSSAEDFFPKAIGWLIDRITGAFARRERIFKQLDAFFEMVIEQHLDPKRTKPDNGGDLVDVLITHWKEHRGKLNFTRDHVKALIFDTFIAGVDTSSVTILWAMSELIRSPRVLSKVQAEIWAVVGRNDRVRSEDVSKLEYLKLVVKETLRLHPPAPLLSAERNHAAHPRLGGYDVPAKTRIYVNAWAIXGRDPTSWPNHPEEFNPERFVGERIDFKGGHPQICRSGTGRRIXPSISMAFHCGFNTCPICYLFQWXFPMDGPLNR

SEQ ID NO: 5189 - protein, 469 aa, Triticum aestivum
  misc_feature (299)..(299): Xaa can be any naturally occurring amino acid
  misc_feature (309)..(309): Xaa can be any naturally occurring amino acid
MAAIISRRGAARALALAMARRGMCSAPAPAAALSSEELIRMEQDCSAHNYHPIPMVFSKGEGSHILDPEGNKYIDFLSAYSAVNQGHCHPKVLRALIEQAERLTLSSRAFYNDKFPVFAQYLTSMFGYDMMLPMNTGAEGVETAIKLARKWGYEKKNIPKNEALIVSCCGCFHGRTLGVISMSCDNDATRGFGPLVPGHLKVDFGDIDGLEKIFKEHGDRICGFLFEPIQGEAGVIIPPDGYLKAVRDLCSRHNILMIDDEIQTGIARTGKMLACDWEDVRPDMVILGKALGAGVVPVXSAVLADKEVXLCIKPGEHGSTFGGNPLASAVAVPSLRVVKDEGLVERAAELGQEFRDQLRKVQQKFPDIIREIRGRGLLNAVDLSSKALYPASAYDICIKLKERGILAKPTHDTIIRLAPPISISPEELTEASKALSDVLEHDLPQLQKQIKKPESEAKTPVCDRCGRDL

SEQ ID NO: 5190 - protein, 514 aa, Triticum aestivum
  misc_feature (362)..(362): Xaa can be any naturally occurring amino acid
MANLVQELMLETPPRAWFLFLLPLLLLSLHHWFTRKTGSTGQRLPPSPPALPIIGHLHLVGALPHVSLRDLARKHGPDVMLLRLGAVPTLVVSSPRAAEAVLRTHDHVLASRPRSVVSDVIMYGSSDIAFAPYGEYWRQARKLVTTHMLSVKKVQSFRSAGAEEVSMSMAKINEAATASGTVDMSELLNSFSNDMACRIVSGKFFLKDGRSKLFRELINDTSRLLGGFNLEEYFPALGRVGVLKRAVCAKAERVRNRWADLLDKVIDDRVSKRKSASDHKDGDFVDILLSVQQEYDLTREHMKALLTDVFFGATDTSANVLEFTLAELMRKPHFMRKLQDEVRSIIPRGQEIVSEADMNNMXYLRAVIKESLRLYPVAPLLAPHLAMADCTIHGYMVPAGTRVVVNAWAIGRDSSSWEDAEEFIPERFTDEGNATNVNFKGNDFQFLPFGAGRRICPGINLGIANVELMLANLVCHFDWQLPLGVERKDIDMTEVFGLTVRRKEKLLLIPKSRM

SEQ ID NO: 5191 - protein, 200 aa, Triticum aestivum
GGAHLVTPGPTKNKGGPLSKNFPAKKVGFKMGVNLGGELSNVKKAAGMDSDSLASCVSKLSAGVSKISDVLQLNQQLGSDERCKRFRASIGEFLQKAEAEITAVQAQEGLALSLVRETTEFFHGNSAKEEGHPLRIFMVVRDFLAVLDRVCKDVSRLNERTATGGFSTSRRVESAAVPPRFNPAAQSSSSEEESSSSSSQ

SEQ ID NO: 5192 - protein, 324 aa, Triticum aestivum
FRAVLPFRLGVLSLRTCRAGAGVAVSATRSPGLGNAGNLREGSNLAKNWDLSRQIGDEHGVLIECRDVHKSFGDKHVLQGVSFKIRHGEAVGIIGPSGTGKSTILKVMAGLLAPDTGEVFICGKKRQGLVSDEDISGLRIGLVFQSAALFDSLNVRENVGFLLYENSKLSEERIGELVTETLAAVGLKGVEERMPSELSGGMKKRVALARSIINDDTKETIEPEALLYDEPTAGLDPIASTVVEDLIRSMHVTGKDAMGKPGKIASYAVVTHQHSTIRRAVDRLLFLHEGKIVWEGMTEEFTTSTNPIVQQFASGSLDGPIRYF

SEQ ID NO: 5193 - protein, 108 aa, Triticum aestivum
NQSTYKIPLKKDAKEVKRSKVEIIKEKSNFLRYPLNEELVSEAPNVNETAVQLIKFHGSYQQSDREVRGQKNYSFMLRTKNPSGKVPNQTYLAMDTLADEFGIGTLRL

SEQ ID NO: 5194 - protein, 343 aa, Triticum aestivum
MTVGGEATATGNGQTVCVTGAGGYIGSWIVKLLLEKGYAVRGTVRNPDDAKNAHLRGLAGAAERLVLCKADLLDGDALRAAIAGCHGVFHTASPVTDDPEEMVEPAVRGTRYVIDAAAESGTVRRVVLTSSIGAVAMDPSRGPDAVVDESCWSDLEFCKKTKNWYCYGKTVAEREAWEAAAARGVDLVVVNPVLVQGPALQPAVNASLTHVLKYLDGSAKTYANAVQAYVHVRDTAAAHVLVFESPAAAGRYLCVADGAVLHREDVVTILRKFFPEYPIPSRCSDEVNPRKQPYKMSNQRLRELGLEFTPVAQCLYDTVVSFQEKGVLPAPPAPAQPATKEIN

SEQ ID NO: 5195 - protein, 256 aa, Triticum aestivum
  misc_feature (208)..(208): Xaa can be any naturally occurring amino acid
  misc_feature (214)..(214): Xaa can be any naturally occurring amino acid
  misc_feature (247)..(247): Xaa can be any naturally occurring amino acid
MSDNSIQRALLSDNPDANVLQRKPSQGAKRFRRCRSAPRSETDEKPQENGSSLPAKELFSVVRPSFRLVGFLLFLYLLAGVVVFYLVMDQLSGKRTNRVLDALYFCIVTMTSVGYGDLVPNTDTTKLLACVFVFTGMAIIALFVSKSADYLVEKQEVLFFKALHMNMKCGEAKMLRQIETNKTEYKFYTAALLLVTGIVVGTVFLWKXVEKLSXLVDSFLFVSGAKSLTLGLWGIKASRSQWGRTFXVFWDNYEPP

SEQ ID NO: 5196 - protein, 243 aa, Triticum aestivum
LNKFVQKSRLVPVRNSRDIVDPRVRRRLASAPIIPRAPAAAMELLRPAAVASSSSSLLLRSVGGARGMARRPGGGDGYSPARGGGGGGGDRAPTEMAPLFPGCDYEHWLIVMDKPGGEGASKHQMVDCYVHTLAKVLGSEEEVKRKIYNVSCERYFGFGCEIDEETSNKLEGIPGVLFVLPDSYVDPEHKDYGAELFVNGEIVQRSPERQRRVEPVPQRASDRPRYNDRTRYARRRENQQQQR

SEQ ID NO: 5197 - protein, 95 aa, Triticum aestivum
GFIYLVSVNGVTGPRENVNLRVKSLIQEIKKVTDKPVAVGFGISKPEHVKQIAGWGADGVIIGSAMVRQLGEAASPREGLKRLEAYARSMKNALP

SEQ ID NO: 5198 - protein, 293 aa, Triticum aestivum
  misc_feature (27)..(27): Xaa can be any naturally occurring amino acid
  misc_feature (72)..(72): Xaa can be any naturally occurring amino acid
  misc_feature (92)..(92): Xaa can be any naturally occurring amino acid
  misc_feature (235)..(235): Xaa can be any naturally occurring amino acid
MAKDEVMETGGGGDFAAKDYTDPPPAXPLIDAAELASWSLYRAVIAEFIATLLFLYITVATVIGYKHQDGTXAVNTAADAACGGVGVLGIAXGAFGGMIFVLVYCTAGISGGHINPAVTFGLFLARKVSLVRALLYMVAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGXINPARSLGAAVIYNKDKAWDDQWIFWVGPMIGAAIAAFYHQYILRAGAIKALGSFRSN

SEQ ID NO: 5199 - protein, 291 aa, Triticum aestivum
  misc_feature (210)..(210): Xaa can be any naturally occurring amino acid
MAKDEVMETGGGGDFAAKDYTDPPPAPLIDAAELASWSLYRAVIAEFIATLLFLYITVATVIGYKHQTDPAVNAAADAACGGVGVLGIAWAFGGMIFVLVYCTAGISGGHINPAVTFGLFLARKVSLVRALLYMIAQCLGAMCGVGLVKAFQSAYFVRYGGGANTLAAGYSKGTGLAAEIIGTFVLVYTVFSATDPKRSARDSHVPVLAXPLPIGFAVFMVHLATIPITGTGINPARSLGAAVIYNKDKAWDDQWIFWVGPMIGAAIAAFYHQYILRAGAIKALGSFRSNA

SEQ ID NO: 5200 - protein, 416 aa, Triticum aestivum
  misc_feature (99)..(99): Xaa can be any naturally occurring amino acid
  misc_feature (110)..(110): Xaa can be any naturally occurring amino acid
FEASLRVRFLCTRSALLLRGLLRFGREVSHDEPPYASSDFRPSARQLWRPPIGVLELGIVGCKGLLPMRTADGKGCTDAYAVAKYGPKWARTRTICDSXNPGWNEQYTWXRVQRATTRRTMTNDDELRRRLLRRPQDDDEADGHAAERGGGDKKGAGNGGKKGGGGNEIPVQIKGNGNNGGGKKDAGGKQQHQGGNGNGNGNGGGKNGGGGGQPNNVKGGGAPVQGKKGGGAGGPAPGMGGPMGGGMPPQQQAMFRPNMMGGAGFPGMGGPMGHPHAASGAQAGRAMQGMPPAGHYQGAGGGGGGMPSGAEMLQAAAAAGNPMAQQQYMQLIQQQQQQQQMAMLQQQQQQQQMMMMNGGHGGGAGGYPQMGYGPGYGRPPMGSYPMPTAYAMPPQPPAGEPYNYFSDEDPNSCSVM

SEQ ID NO: 5201 - protein, 162 aa, Triticum aestivum
  misc_feature (106)..(106): Xaa can be any naturally occurring amino acid
MSKEDVLKIQTCVLKVNIHCDGCQKKVKKILSKIDGVYQTSIDAEEGKVMVSGLVDPDTIIKKLNKGGKPAVLWGGSKPGGVANQFQKLHLDGNGGGGKGAAPKDXRGKGHPKDAGGKAHKGGGKDAKMAMPQPTPQQIQQMQQQMQMKGAPTPQQLQQLQQ

SEQ ID NO: 5202 - protein, 96 aa, Triticum aestivum
  misc_feature (86)..(86): Xaa can be any naturally occurring amino acid
  misc_feature (95)..(95): Xaa can be any naturally occurring amino acid
MGSEAEMTAPLLAGVSPAVEAVPPWREQLTVRAIVVSAILGVLFCLVTHKLNLTVGIVPSLNVAAGLLGYCLVRTWTAALGMFGVXSKPFTKQEXT

SEQ ID NO: 5203 - protein, 379 aa, Triticum aestivum
  misc_feature (238)..(238): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGAKMAGAARIIGVDLNPAKYEQAKKXGCTDFVNPKDHTKPVQEVLVEMTNGRIDRAVECTGHIDAMIAAFECVHDGWGVAVLVGVPHKEAVFKTSPMNLLNERTLKGTFFGNYKPRTDLPEVVEMYMRKELDVEKFITHSVPFSQINTAFDLMLKGEGLRCVMRMDE

SEQ ID NO: 5204 - protein, 248 aa, Triticum aestivum
  misc_feature (25)..(25): Xaa can be any naturally occurring amino acid
  misc_feature (179)..(179): Xaa can be any naturally occurring amino acid
  misc_feature (198)..(198): Xaa can be any naturally occurring amino acid
LAWSRPRCKVVIGMDVAASEFYNDXDKTYDLNFKEENNDGSQKISGDSLKNVYKSFVSEYPIVSIEDPFDQDDWMHYAKMNEECGVKVQIVGDDLLVTHQIRVAKAIQEKSRNGLLLKDNQIGSVNESIEAVKMSKHAGWGVMTSHRSGETEDTFIADLAVGLSTGKIKTGAPYRSERXLAKYNQLLRIEEEMADSTXTLASSSVHRWSHSRWDLHEFYVKMGVFNLRNELWLKLLGLNNNECRACFM

SEQ ID NO: 5205 - protein, 573 aa, Triticum aestivum
  misc_feature (343)..(343): Xaa can be any naturally occurring amino acid
TRSSPTPSHPHHHHRPSIGRLAATSRARPTPAAMAREELSTEIVNRGVEPSGPDAGSPTFSVRVRRRLPDFLQSVNLKYVRLGYHYLLSHGVYLATIPVIVLVCGAEVGSLSRDELWRKVWDEATYDLATVLAFLAVLAFTISVYIMSRPRPIYLIDFATYKPADELKVSKAEFIDLARKSGKFDEESLAFQARLLAKSGIGDESYMPRCVFQPDANCATMKEGRAEASAAMFAALDELFDKCRVRPKDVGVLVVNCSLFNPTPSLSAMIVNHYKMRGNILSYNLGGMGCSAGVISIDLARDMLQASGAGLAVVVSTEAVSFTWYAGKRRSMLIPNAFFRAGXAAVLLSNRRRDFRRAKYQLEHVVRTHKGADDRAFRSVYQEEDEQRIKGLSISRDLVEVGGHPLKTNITTLGPLVLPFSEQLLFFSGVLFRHLYPSKTSTPPPPAANGDTSAAAPYIPDFKRAFEHFCMHAASRDVLEHLQRNLGLRDADLEASRAALHRFGNTSSSSIWYELAYLEAKGRVRRGDRVWQLAFGSGFKCNSAVWRAVRRVRRPSRSPWLDCVDQYPARMDA

SEQ ID NO: 5206 - protein, 191 aa, Triticum aestivum
VAKPKKGSTVAIFGLGAVGLAAMEGAKMAGASRIIGVDLNPAKYEQAKKFGCTDFVNPKDHTKPVQEVLVEMTNGGVDRAVECTGHIDAMIAAFECVHDGWGVAVLVGVPHKEAVFKTSPMNLLNERTLKGTFFGNYKPRTDLPEVVEMYMRKELDVEKFITHSVPFSQINTAFDLMLKGEGLRCVMRMDE

SEQ ID NO: 5207 - protein, 64 aa, Triticum aestivum
  misc_feature (55)..(55): Xaa can be any naturally occurring amino acid
  misc_feature (58)..(58): Xaa can be any naturally occurring amino acid
MISSDTSSTEWDKAWSSLRKKGKKTLFSEFSPNKYVTCNPRRIEYPLSGRSRSIXRAXRSNLML

SEQ ID NO: 5208 - protein, 525 aa, Triticum aestivum
  misc_feature (519)..(519): Xaa can be any naturally occurring amino acid
MAAIKPPPPDRPPQAARLPSPSSSSSAVAAAKRGATGSRGLLMGRYELGRVLGKGTFAKVYHARHVQTGESVAIKVLDREKAVRSGLVSHIKREIAVLRCVRHPNIVHLFEVMATKTKIYFVMELVRGGELFSRVSKGRLKEDIARRYFQHLISAVGFCHTRGVFHRDLKPENLLVDEAGNLKVSDFGLSAVAEPFQPEGLLHTFCGTPAYVAPEVLARRGYEGAKADIWSCGVILFVLMAGYLPFHDQNLMAMYRKVYKGEFRCPRWFSKDLTSLIMRFLDTNPSTRITLPEVMESRWFKKGFRPVKFYIEDDQLYNVIDAENDMLDLGLPDPLPQPLLPPPSSPSPQEVDGDDSGSESDASVVSCPATSSFEERHRLRGPLPRPASLNAFDIISFSRGFNLSGLFEEKGDEVRFISSEPMSGIITKLEEIANVKSFAVRKKDWRVSLEGTREGVKGPLTICAEIFELTPSLVVVEVKKKAGDKEEYDDFCNKELKPGMQHLVHQMAPVPITPTISEXAERPSR

SEQ ID NO: 5209 - protein, 203 aa, Triticum aestivum
KHLTNAQGLAIITVMLVTTCLMSLVIVLCWNKSIVFSLVFLLFFGAIEVLYFSASLVKFREGAWVTIMLSLFFMIMMCVWHYGAIKKYEFDVENKVSISWLLNLGPSLGIVRVRGIGLIHTELMSGIPAIFSHFVTNLPAFHQVLVFLCIKSVPIPHIRPEERFWVGRVGPKQYRLYRVDVRYGYRDVPKDDIEFEKDLVCSI

SEQ ID NO: 5210 - protein, 329 aa, Triticum aestivum
  misc_feature (52)..(52): Xaa can be any naturally occurring amino acid
  misc_feature (61)..(61): Xaa can be any naturally occurring amino acid
  misc_feature (110)..(110): Xaa can be any naturally occurring amino acid
  misc_feature (119)..(119): Xaa can be any naturally occurring amino acid
  misc_feature (123)..(123): Xaa can be any naturally occurring amino acid
  misc_feature (183)..(183): Xaa can be any naturally occurring amino acid
  misc_feature (192)..(192): Xaa can be any naturally occurring amino acid
  misc_feature (262)..(262): Xaa can be any naturally occurring amino acid
  misc_feature (273)..(273): Xaa can be any naturally occurring amino acid
FRAAARAGGINAEPKANDQYLPPFVIVDESGKSVGPIVDGDAVVTFNFRADXMVMLCEALXFPDFDKWERVRVPKIKYAGMLQYDGELKLPSKYLVSLSLIDRTSGEYLXKNGVRTFAXVETXKCGHVTFFWNGNRLGYFDETREEYVELSTDFFFHPTDPPPLVGLFIAGENRDAILRGKVXRVRINLPKXGTMVGAHGGYVKRTGGCLQRRVDKDSRQHGLWMLCEQVWGDLVWATAVRGTAEGYWFARNRAGSADAVSXGSIQILTSHTXQPVSVTIGGPGLHTGKRFRSDIQTPGLANVAATVMNLHGFQAPADYETTLIEVVDT

SEQ ID NO: 5211 - protein, 152 aa, Triticum aestivum
MDASKLKKVAGKKFGGPRKKSVTRSVKAGLQFPVGRIGRFLKKGRYAQRVGSGAPVYLAAVLEYLAAEVLELAGNAAKDNKKTRIVPRHLLLAIRNDQELGRLLSGVTIAHGGVIPNINPVLLPKKTAEKAEKTAAKSPKKATKSPKKATKA

SEQ ID NO: 5212 - protein, 263 aa, Triticum aestivum
  misc_feature (141)..(141): Xaa can be any naturally occurring amino acid
HASGAKSVSICYYEQENNWWISKVIRKKHESSVTSVAWHPNNIHLATTSTDGKCRVFSTIIKGVDTRGPQAGASVDWKFGEQIAQLDLSPTWAFGVRWSPSGKTLAYAGHSSMIYFVDDVEGSPAAQNLALRDLPLRDVDXLFVSEKMAIGVGFDCNPLIFAADETGLWSFVRYLDERKVTPSTSKASQLSEALGKLYGQSRQGSSSDTVEPSKPRGGAHENCITCIVPLRKGSESVVKRFSTSGLDGKIVVWDLENHITIPK

SEQ ID NO: 5213 - protein, 290 aa, Triticum aestivum
MTKDEDFKLVKIQTHVLRVNIHCDGCKHKVKKLLQRIEGVYSVAIDVDNHKVTVTGSVDSETLIRKLTRGGKHAELWSHQKGGNGGNNNNQGHKGGGGGGNNNQQKQQQQQQQQKQAANVSKDGGGKGNGGQKEQGKLGGGGVGSLMQGLKAFKSQHSKHQLPELSSDDDDDDMYDDEDDEDDDEFDDEYEDDLRFLGDKMSQLGILRQRAEAAAAINAKNKNAANVGGKKGAPAGNNHHQSNQNQKMNMGAAAGNAKMGNGAPKNTGGIGGLMGLNHGGLGAAGAAPGI

SEQ ID NO: 5214 - protein, 168 aa, Triticum aestivum
  misc_feature (17)..(17): Xaa can be any naturally occurring amino acid
VQSKSLNEDHPFEAPRXPCPICSEKVSKDMLNHITMQHGYLFKNRRRLRRFAVPGSQSLSLLSRDLREAHLQVLLGGGGHRSSNNNATNISADPLLSSFGLSFPTLDAEETSKLSTPAQSDVPVLKETAARPWRSSIDSSLTREEREQASVRAMFVQDLLLSTLFRDQ

SEQ ID NO: 5215 - protein, 178 aa, Triticum aestivum
  misc_feature (44)..(44): Xaa can be any naturally occurring amino acid
MEYQGQQQHGRVDEYGNPVARHGVGTGMGTHGGVGTGAAAGGHXQPMRDEHQTGRGILHRSGSSSSSSSEDDGMGGRRKKGIKEKIKEKLPGGHGDQQHTGGTYGQQGTGMAGTGGTYGQQGHTGMAGTGGTYGQQGHTGMTGTGAHGTGGAYGQHGTDTGEKKGIMDKIKEKLPGQH

SEQ ID NO: 5216 - protein, 168 aa, Triticum aestivum
  misc_feature (110)..(110): Xaa can be any naturally occurring amino acid
  misc_feature (114)..(114): Xaa can be any naturally occurring amino acid
  misc_feature (125)..(125): Xaa can be any naturally occurring amino acid
  misc_feature (132)..(132): Xaa can be any naturally occurring amino acid
  misc_feature (136)..(136): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDXRYWXTMWKLPMFGCXDATQVIXQVEXVKKEYLTRIPHHRIHNMRKMRQLAKPAQDPEG

SEQ ID NO: 5217 - protein, 176 aa, Triticum aestivum
  misc_feature (90)..(90): Xaa can be any naturally occurring amino acid
  misc_feature (100)..(100): Xaa can be any naturally occurring amino acid
  misc_feature (115)..(115): Xaa can be any naturally occurring amino acid
  misc_feature (125)..(125): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLXFKQGWVYLPXEHNASPGYYDGRYWXTMWKLPMFGXCTDATQVINKWRSQEGVPDAYFAYRIDNIASEWLIASNGSRSARLNTHTAH

SEQ ID NO: 5218 - protein, 180 aa, Triticum aestivum
  misc_feature (100)..(100): Xaa can be any naturally occurring amino acid
  misc_feature (110)..(110): Xaa can be any naturally occurring amino acid
  misc_feature (114)..(114): Xaa can be any naturally occurring amino acid
  misc_feature (121)..(121): Xaa can be any naturally occurring amino acid
  misc_feature (127)..(127): Xaa can be any naturally occurring amino acid
  misc_feature (131)..(131): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKLGSSSRXHNASPGYYDXRYWXTMWKLPXFGCTDXTQVXNKWKSQEGLPDAYSASDRQHRKCMSSSPTTGCKIRKAKQSQRQIKCMRL

SEQ ID NO: 5219 - protein, 152 aa, Triticum aestivum
  misc_feature (136)..(136): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEXKKEYLTVFRIIGSTTS

SEQ ID NO: 5220 - protein, 212 aa, Triticum aestivum
  misc_feature (184)..(184): Xaa can be any naturally occurring amino acid
ASGMSIRSSSAHKISRVPDFRSQVRPTISICEKSYAVQKSEEIFNVAQELMPGGVNSTVCTFISVVGQPIVYDSVKVSNMWDVDGNEHIDYVASWGPAIMGHADDVVNHALIEPVKKGSSSGAPCALENVLHLMVISTVPSIEMVRFVNSASESSMGPLRLVSAFIGRENIIKFEGCSHGHADXFLVKAGSGVAALGLSVFPGVRKGIHRVP

SEQ ID NO: 5221 - protein, 172 aa, Triticum aestivum
  misc_feature (51)..(51): Xaa can be any naturally occurring amino acid
  misc_feature (62)..(62): Xaa can be any naturally occurring amino acid
  misc_feature (80)..(80): Xaa can be any naturally occurring amino acid
  misc_feature (89)..(89): Xaa can be any naturally occurring amino acid
  misc_feature (92)..(92): Xaa can be any naturally occurring amino acid
  misc_feature (104)..(104): Xaa can be any naturally occurring amino acid
  misc_feature (115)..(115): Xaa can be any naturally occurring amino acid
  misc_feature (117)..(118): Xaa can be any naturally occurring amino acid
  misc_feature (132)..(132): Xaa can be any naturally occurring amino acid
VIRKLFHKIDNDDSRNLSRAELHALIIGINFEEIDFDKNDAVDKIMDDFGXLQGNDTVEENXFCPRGMKIWFNEAKQKVXEVSGCYPNXFVXDYHAKTRKDQYXWATNFDQAVEXVXXPGWGIAQALGYCFXGLHFPIKPLVDPKFSAKKPSLPRRAETNASGFPQEKGLPP

SEQ ID NO: 5222 - protein, 734 aa, Triticum aestivum
GRHFVRLYFYPFIYQSYDLSTAKFTVSTQDVLLLSDFQQPDKTAPLFKEYSLNITRDQLVISFKPSNGIAFINAIEVVSVPDDLIADVANMVNPVQQYSGLTTQSLETVYRVNMGGPKVFPNNDTLSRTWQKDQKYILNPSVTKTAVYGKAIKYRKGGATPLTAPDIVYSTATELAASNTSNALFNMTWQFDVDAGFSYLIRFHFCDIVSKALNQLYFNAYVGGFFAQHDLDLSEQSVNQLATAIYVDVVLSSNDASSKLSISIGPSTLNNALPDGILNGLEIMKMGSGSGSAFTVGNNGSNKKLPIIIGSVLGVVGLLIIVLVVVLLCRRKKTDDKQHSKTWMPFSINGLTSLSTGSRTSYGTTLTSGLNGSYGYRFAFNVLQEATNNFDESWVIGVGGFGKVYKGALRDDTKVAVKRGNPKSQQGLNEFRTEIELLSRLRHRHLVSLIGYCDERNEMILVYEYMENGTVKSHLYGSDNPSLNWKQRLEICIGAARGLHYLHTGSAKAIIHRDVKSANILLDENLLAKVADFGLSKTGPELDQTHVSTAVKGSFGYLDPEYFRRQQLTEKSDVYSFGVVMLEVLCARPVIDPSLPREMVNLAEWGMKWQKRGELHQIVDQKLSGAIRPDSLRKFGETVEKCLADYGVERPSMGDVLWNLEYVLQLQDVDSSTVSDVNSMTRIVDLSSQVQHVGAMESISVTMAEDGALHEPDHDLSDVSMSRVFSQLIKAEGR

SEQ ID NO: 5223 - protein, 171 aa, Triticum aestivum
  misc_feature (146)..(146): Xaa can be any naturally occurring amino acid
  misc_feature (159)..(159): Xaa can be any naturally occurring amino acid
GRVGAAAVFTVASLYAAKPASIASSLSALPPILPRLLRTFLWHLASVISVLEPLCGLAAMSKSKQLLQGRTRTAAVLVFSYFAICGLITGMFRSAVVKARGEEGSLDMSLAGRIGVGALLVSVLVCVNLLGLLAQSVFYYACKAYXNQEIDRTALYEHXLGGYLGEYVPLK

SEQ ID NO: 5224 - protein, 389 aa, Triticum aestivum
  misc_feature (346)..(346): Xaa can be any naturally occurring amino acid
MDGGGEEGKQQPQLVLAHKLFLLSQPDVDDLAKVGLRDDVLAAVKSDDMAALYESLAADGMLEMDAALLAEMRGRIEEETKKFDEKIADAEENLGESEVREAHLAKSLYFIRVGEKEKALEQLKVTEGKTVAVGQKMDLVFYTLQIGLFHMDFDLISKSVDKAKILFEEGGDWERKNRLKVYEGLYCMATRNFKKATSLFLDSVSTFTTYELFPYDTFIFYTVLTSVITLDRVSLKQKVVDAPEILAVIGKVPHLSEFLNSLYNCQYKSFFVAFSGLTEQIKLDRYLQPHFRYFMREVRTVVYSQFLESYKSVTMEAMAASFGVTVDFIDQELSRFIAAGKLHCKXIDKVAGVLETNRPDARNAFYQSTIKQGDFLLNRIQKLSRVIDL

SEQ ID NO: 5225 - protein, 389 aa, Triticum aestivum
  misc_feature (255)..(255): Xaa can be any naturally occurring amino acid
MDGGGEEGNQQPQLVLAHKLFLLSQPDVDDLAKVGLRDDVLAAVKSDDMAALYESLAADGVLEMDAALLAEMRGRIEEETKKLDEKITDAEENLGESEVREAHLAKSLYFIRVGEKEKALEQLKVTEGKTVAVGQKMDLVFYTLQIGLFHMDFDLISKSVDKAKILFEEGGDWERKNRLKVYEGLYCMATRNFKKATSLFLDSVSTFTTYELFPYDTFIFYTVLTSVITLDRVSLKQKVVDAPEILAVISKVPHXLSEFLNSLYNCQYKSFFVAFSGLTEQIKLDRYLQPHFRYFMREVRTVVYSQFLESYKSVTMEAMAASFGVTVDFIDQELSRFIAAGKLHCKIDKVAGVLETNRPDARNAFYQSTIKQGDFLLNRIQKLSRVIDL

SEQ ID NO: 5226 - protein, 392 aa, Triticum aestivum
  misc_feature (250)..(250): Xaa can be any naturally occurring amino acid
  misc_feature (254)..(254): Xaa can be any naturally occurring amino acid
  misc_feature (259)..(260): Xaa can be any naturally occurring amino acid
  misc_feature (267)..(267): Xaa can be any naturally occurring amino acid
MDGGGEEGKQQPQLVLAHKLFLLSQPDVDDLAKVGLRDDVLAAVKSDDMAALYESLAADGVLEMDAALLAEMRGRIEEETKKFDEKIADAEENLGESEVREAHLAKSLYFIRVGEKEKALEQLKVTEGKTVAVGQKMDLVFYTLQIGLFHMDFDLISKSVDKAKILFEEGGDWERKNRLKVYEGLYCMAARNFKKATSLFLDSVSTFTTYELFPYDTFIFYTVLTSVITLGPRITGNKRLVDAPEFLGCXLGKXPPPPXXFLQSPPXDCQYKSFFVAFSGLTEQIKLDRYLQPHFRYFMREVRTVVYSQFLESYKSVTMEAMAASFGVTVDFIDQELSRFIAAGKLHCKIDKVAGVLETNRPDARNAFYQSTIKQGDFLLNRIQKLSRVIDL

SEQ ID NO: 5227 - protein, 357 aa, Triticum aestivum
  misc_feature (140)..(140): Xaa can be any naturally occurring amino acid
MAAESQTETGNCSAWAAKDPSGVLSPHSFNRRTVRHDDVSLRITHCGVCYADVIWTKNRHNDSVYPLVPGHEIAGVVTEVGSDVKGFKLGDHVAVGTYVNSCRDCDNCNSFLENHCSKFVFTFNGVDTDGTVTKGGYSTXHIVVHERYCYKIPDGYPLEKAAPLVCAGITVYTPMMRHNMNQPGKSLGVIGLGGLGHMAVKFGKAFGLKVTVLSTSESKRDEAISLLGADNFVVSSDKKQMESLKNSLDFIVDTASGDHPFDPYLALLKVGGIMALVGFPGEIRVHPATLNLGARTLSGSVTGGTKDTQEMINFCTANKIYPDIELIKIDYINEALERLVNRDVRYRFVIDIESSLK

SEQ ID NO: 5228 - protein, 571 aa, Triticum aestivum
MDGEEAHHRPSSSSSSGRPFLSGLCAAALRRKPISARASAAASGEGLVRQLGVLELVLLGIGASIGAGIFVITGTVARDAGPGVTISFALAGAACVLNALCYAELASRFPAVVGGAYLYTYAAFNELTAFLVFTQLMLDYHIGAASIARSLASYFIQFLELIPSVKGNVPSWIGHGEEFFGGVVSVNILAPILLLILTVILCRGVKESSAVNTFMTTLKIIIVIVVVFAGVFEVDVSNWSPFMPNGFKAVVTGSTVVFFAYVGFDAVANSAEEAKNPQRDLPIGILGSLLACVILYVAVCLVITGMLPYTLLGEDAPLAEAFSAKGLKFVTVLISIGAVAGLTTTLLVGLYVQSRLYLGLGRDGLLPSIFSKVHPTLHTPLHSQIWVGCVAAVLAGLFNVHALSHILSVGTLTGYSVVSACVITLRWSDKATNSRSLGKISIWQEGVFCLVIVALCGFIAGISYRFSYSIAFIIIAFLIATVGSFSLLYRQVYVPVDPPRFSCPGVPMVPIVSVFFNMFLFAQLHEEAWYRFVILSLIAVGVYAGYGQYNAVPSTSDHSSVAYHGVPSEAP

SEQ ID NO: 5229 - protein, 144 aa, Triticum aestivum
MPSAGLEAGSNKVDVAIDLGNPLLNRTVDGFLKIGAVGACRVVAEDAFDCIHRGDISKRQLEETLKKMCKEGAYWGAVAGVYVGMEYGVERARGDRDWKNALIGGIATGALVSAVSNNKGNKIAQDAITGGAIATAVEFINYLT

SEQ ID NO: 5230 - protein, 526 aa, Triticum aestivum
  misc_feature (148)..(148): Xaa can be any naturally occurring amino acid
  misc_feature (215)..(215): Xaa can be any naturally occurring amino acid
MAMAMRRAAALGARHILAASVSASSRVASRRHMGSVDAGAAMEKIRAAGLLRTRGLIGGKWVDAYDGKTIEVQNPATGEVLANVACMGNRETADAITSANTTFYTWSKLTASERSKALRKWHDLLMSHKEELALLMTLEQGKPMKEAXGEVNYGASFIEFFAEEAKRVYGDIIPPTLADRRLLVLKQPIGVVGAITPWNFPLAMITRKVGPALGXGCTVVVKPSEFTPLTALAAADLALQAGIPAGALNVVMGNAPEIGDELMQSMQVRKITFTGSTAVGKKLMAGSANTVKKVSLELGGNAPCIVFDDADIDVAVKGSLAAKFRNSGQTCVCANRILVQEGIYEKFASAFVKAVQSLQVGNGLEESTSQGPLINEAAVQKVEKFVGDATSKGANIMLGGKRHSLGMSFYEPTVVGNVSNDMLLFSEEVFGPVAPLIPFKTEEEAIHLANDTNAGLAAYMFTKNIARSWRVSEALEYGLVGVNEGLISTEVAPFGGVKQSGLGREGSKYGMDDYLEIKYVCMGNLG

SEQ ID NO: 5231 - protein, 330 aa, Triticum aestivum
  misc_feature (208)..(208): Xaa can be any naturally occurring amino acid
  misc_feature (241)..(241): Xaa can be any naturally occurring amino acid
  misc_feature (292)..(292): Xaa can be any naturally occurring amino acid
  misc_feature (305)..(305): Xaa can be any naturally occurring amino acid
MGSLDAGAAMEKIRAAGLLRTRGLIGGQWVDAYDGKTIEVQNPATGEVLANVACMGNRETADAITSANTTFYTWSKLTASERSKALRKWHDLLMSHKEELALLMTLEQGKPMKEALGEVNYGASFIEFFAEEAKRVYGDIIPPTLADRRLLVLKQPIGVVGAITPWNFPLAMITRKVGPALACGCTVVVKPSEFTPLTALAAADLALXAGIPAGALNVVMGNAPEIGDELMQSTQVRKIAXTGSTAVGKKLMAGSANTVKKVSLELGGNAPCIVFDDADIDVARKGSLAAQXRTGEQTFVCSTRXLVQKGILQKIRKVFWQSVVQNLKFG

SEQ ID NO: 5232 - protein, 526 aa, Triticum aestivum
  misc_feature (346)..(346): Xaa can be any naturally occurring amino acid
MAMAMRRAAALGARHILAASASASSRVASRRHMGSVDAGAAMDKIRAAGLLRTRGLIGGQWVDAYDGKTTEVQNPATGEVLANVACMGNRETADAITSANTTFYTWSKLTASERSKALRKWHDLLMSHKEELALLMTLEQGKPMKEALGEVNYGASFIEFFAEEAKRVYGDIIPPTLADRRLLVLKQPIGVVGAITPWNFPLAMITRKVGPALACGCTVVVKPSEFTPLTALAAADLALQAGIPAGALNVVMGNAPEIGGELMQSTQVRKITFTGSTAVGKKLMAGSANTVKKVSLELGGNAPCIVFDDADIDVAVKGSLAAKFRNSGQTCVCANRILVQEGIYEXFASAFVKAVQSLQVGNGLEESTSQGPLINEAAVQKVEKFVGDATSKGANIMLGGKRHSLGMSFYEPTVVGNVSNDMLLFSEEVFGPVAPLIPFKTEEEAIHLANDTNAGLAAYMFTKNIARSWRVSEALEYGLVGVNEGLISTEVAPFGGVKQSGLGREGSKYGMDDYLEIKYVCMGNLG

SEQ ID NO: 5233 - protein, 353 aa, Triticum aestivum
  misc_feature (126)..(126): Xaa can be any naturally occurring amino acid
  misc_feature (180)..(180): Xaa can be any naturally occurring amino acid
  misc_feature (232)..(232): Xaa can be any naturally occurring amino acid
  misc_feature (263)..(263): Xaa can be any naturally occurring amino acid
  misc_feature (280)..(280): Xaa can be any naturally occurring amino acid
  misc_feature (305)..(305): Xaa can be any naturally occurring amino acid
FRAAARAGSGINAEPKANDQYLPPFVIVDESGKSVGPIVDGDAVVTFNFRADRMAMRAKALELPDFDKSDRVRVPKIKYAEMLQYDGELKLPSKYLVSPPLMERTSGEYLGQNGVRTFPGRETEKXGHGTFTWNGNRPGYFDETRQEYVEVPRGRDLTFNEPPKTKAREIAERNREANLXVGSLTRGRITLPNRGPGEPHRGTWRPQPVVAQVLTNRAPRRSGMPVDHAGGXYLVTPEHGNAQRRWLRGNNPGPPGRDKSGSXRSLTSHTLQPVPVAIGXPGLHPGVRFRSDIQTPRVANVAATXDELHGSKSLPDYQTTSSNPLDKKKKLPLLNPISTIFPIFGGGQGTMDI

SEQ ID NO: 5234 - protein, 185 aa, Triticum aestivum
  misc_feature (32)..(32): Xaa can be any naturally occurring amino acid
  misc_feature (59)..(59): Xaa can be any naturally occurring amino acid
  misc_feature (93)..(93): Xaa can be any naturally occurring amino acid
  misc_feature (99)..(99): Xaa can be any naturally occurring amino acid
MARKGVSYVTAAQLVSMARDPRVAIIDVRDEXERICDAHIAGSHHYASDGSPDRLPEIXEATPGQGDLLSHCALNQVRRPSCAKCSLGLYLSXGKEDQXVKDITSSSGGFNGWDFQGNRFPLQGSPSKVYLLNLHIQTNMIILNSKERSQVSQDVTSGYPRIITYSNIKWIPIVTKPCVNTHHHG

SEQ ID NO: 5235 - protein, 137 aa, Triticum aestivum
LLGIASTNLRKPLPIREVIARIVDGSHFSEFKRDYGTTLVTGFASIYGHRVGIIANDGILFGTSSQKGAHFIELCSQRGIPLVFLQNISGFMVGKDSERDGIAKHGAKLVTAFACADVPKFTVVVGGSYGAGNYGMC

SEQ ID NO: 5236 - protein, 59 aa, Triticum aestivum
NQGLYEDSIRYYVRAVAMNPKADNAWQYLRISFSNASRADMIAAWDARNLDAFQKEFPL

SEQ ID NO: 5237 - protein, 494 aa, Triticum aestivum
MSATCAADLGPLLGAAAANATDYLCNRFADTTSAVDSTYLLFSAYLVFAMQLGFAMLCAGSVRAKNTMNIMLTNVLDAAAGALFYYLFGFAFAFGTPSNGFIGKHFFGLKDMPQTGFDYSFFLFQWAFAIAAAGITSGSIAERTQFVAYLIYSAFLTGFVYPVVSHWIWSVDGWASAARTSGPLLFKSGVIDFAGSGVVHMVGGIAGFWGALIEGPRIGRFDHAGRSVALKGHSASLVVLGTFLLWFGWYGFNPGSFVTILKSYGPPGSINGQWSGVGRTAVTTTLAGSVAALTTLFGKRLQTGHWNVVDVCNGLLGGFAAITAGCSVVDPWAAVICGFVSAWVLIGLNALAGRLKYDDPLEAAQLHGGCGAWGIIFTALFAKKQYVEEIYGAGRPYGLFLGGGGRLLAAHIVQILVIAGFVSCTMGPLFLALKKLGLLRISAEDEMAGMDLTRHGGFAYVYHDDDEHDKSVGGFMLRSAQTRVEPAAAANSQV

SEQ ID NO: 5238 - protein, 482 aa, Triticum aestivum
  misc_feature (368)..(368): Xaa can be any naturally occurring amino acid
MAASAAAVMEELRGSFREGRTRPAEWRTAQLRALVRMIEEKEDDISDALHADLAKPRMEAYLHEISLAKGACMFALKGLKNWMKPDKVPSAITTFPSTAQIVPEPLGVVLVISAWNYPFLLSIEPVIGAIAAGNAVVLKPSELAPATSSLFAKLLPEYVDSSCIKVVEGGVTETGALLQQKWDKIFYTGNGNVARVVLAAAAKHLTPVALELGGKCPVIVDSNVDLHVAAKRIAVGKWGCNNGQACIAPDYIITTKAFVTELVDSLKRVLERFYGEDPLQSADLSRIVSISHFERLTKLIEDKEVATKIQLGGQTDQEQLKIAPTVLVDVPLDTELMTGEIFGPMLPIITVDKIEESIAHINAGGKAXLAAYLFTKDKKLQQDFVSNVSAGGMLVNDVALHLTNPHLPFGGVGDSGTGSYHGKFSFDCFTHRKAVLIRGFGGEANARYPPYTAEKQRILRGLIKGSFFALILALLGFPREKR

SEQ ID NO: 5239 - protein, 481 aa, Triticum aestivum
  misc_feature (267)..(267): Xaa can be any naturally occurring amino acid
  misc_feature (286)..(286): Xaa can be any naturally occurring amino acid
  misc_feature (298)..(298): Xaa can be any naturally occurring amino acid
  misc_feature (316)..(316): Xaa can be any naturally occurring amino acid
MAASAAAVMEELRGSFREGRTRPAEWRTAQLRALVRMIEEKEDDISDALHADLAKPRMEAYLHEISLAKGACMFALKGLKNWMKPDKVPSAITTFPSTAQIVPEPLGVVLVISAWNYPFLLSIEPVIGAIAAGNAVVLKPSEIAPATSSLFAKLLPEYVDSSCIKVVEGGVTETGALLGQRWDKIFYTGNGNVARVVLAAAAKHLTPVALELGGKCPVIVDSNVDLHVAAKRIAVGKWGCNNGQACIAPDYIITTKAFVNRAGSTLXKDLGKVYGEDPLQSADLSXRIVSINHFERLXELIEDKELPPRSLGGQTXKEQLKIPPTVLVDVPLDTELMTGEIFGPMLPIITVDKIEESITHINAGAKPLAAYLFTKDKKLQQDFVSNVSAGGMLVNDVALHLTNPHLPFGGVGDSGTGSYHGKFSFDCFTHRKAVLIRGFGGEANARYPPYTAEKQRILRGLIKGSFFALILALLGFPREKR

SEQ ID NO: 5240 - protein, 170 aa, Triticum aestivum
  misc_feature (129)..(130): Xaa can be any naturally occurring amino acid
MAIRRQRRAFPLVPFLVSLLAVAAYGRLISDGMPATPSSSVLASPLSSAALRLNSSSPATAAAPEECEQTYGFLPCTTTVFGNMFLVLTYGFLMFKAATFLSAGSELLLEIMGPGLVGGLLLPILGALXXDALLVLVSGLSGTKEMTKVSSDGCCCSLSSLTAWECVCGK

SEQ ID NO: 5241 - protein, 391 aa, Triticum aestivum
  misc_feature (44)..(44): Xaa can be any naturally occurring amino acid
SVVSFVACSPAAMGNCFGSRIGSDSPYKSAGGSASPSSSSGGRXRRKGKGGASVSSSRVSSSPPTTVPPTPRSEGEILQSANVKSFAFNELKTATRNFRPDSVLGEGGFGSVFKGWVDETTFAPARPGTGMVIAVKKLNQEGFQGHREWLAEVNYLGQLSHPNLVRLVGYCLEDEQRLLVYEFMPRGSLENHLFRRGSHFQPLSWNLRMKVALGAARGLAFLHSDMAKVIYRDFKTSNVLLDSSYNAKLSDFGLAKDGPTGDKSHVSTRVMGTHGYAAPEYLATGHLTAKSDVYSFGVVLLEMLSGRRALDKNRPSGEHNLVEWARPYLTSKRRVFHILDARLGGQYSLSGAQKTAALAMRCLSGDARARPGMAEVVTALEQLQDAKEAAA

SEQ ID NO: 5242 - protein, 204 aa, Triticum aestivum
MAFALKASASPALAAASSAAAASSPSFSASASAAPRGRAAAARRVALRGAARPVPAIRASASAAAPAAPAVAGDKRTISGTFTNLKAQGKIAFIPFIVAGDPDLATTAKALKVLDACGSDVIELGVPYSDPLADGPVIQASATRALTKGTTFEDVISMVKDVVPELSCPLALFTYYNPILKRGVANFMSVVKETGVHGLVVPDV

SEQ ID NO: 5243 - protein, 285 aa, Triticum aestivum
  misc_feature (196)..(196): Xaa can be any naturally occurring amino acid
  misc_feature (204)..(204): Xaa can be any naturally occurring amino acid
  misc_feature (232)..(232): Xaa can be any naturally occurring amino acid
  misc_feature (239)..(239): Xaa can be any naturally occurring amino acid
  misc_feature (256)..(256): Xaa can be any naturally occurring amino acid
MAAATSHNVIVSAQSHRWNSKNSRLDRRGVYVRLVSVGSCCSGNRKLGLVCASGSQSSVIDPVHLPSNGKGDHSPKKSSESSLILIRHGESMWNEKNLFTGCVDVPLTPKGVDEAIEAGKRICNIPIDVIFTSAMIRSQMTAMLAMMQHRRKKVPIITHKESEQAQSWSKIYSEDTKEQPIPVITVWKLNERMYGXWNGLIKQXTDNRFGKDKVLKGAGITNIPPPNGETLXMCANRAXSYLKDQGCPHLHGWKDXMVVGIAKSLRTNIMALKKLLPRKVNGFNC

SEQ ID NO: 5244 - protein, 182 aa, Triticum aestivum
  misc_feature (114)..(114): Xaa can be any naturally occurring amino acid
  misc_feature (136)..(136): Xaa can be any naturally occurring amino acid
  misc_feature (142)..(142): Xaa can be any naturally occurring amino acid
  misc_feature (146)..(146): Xaa can be any naturally occurring amino acid
  misc_feature (156)..(156): Xaa can be any naturally occurring amino acid
  misc_feature (161)..(161): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWXTMWKLPMFGCTDATQVINEVEXVKKEYXDAYXRIIGFTTSQXQCVSXSPSNGLQESGQTATHTGIYKC

SEQ ID NO: 5245 - protein, 93 aa, Triticum aestivum
  misc_feature (18)..(18): Xaa can be any naturally occurring amino acid
  misc_feature (35)..(35): Xaa can be any naturally occurring amino acid
  misc_feature (69)..(69): Xaa can be any naturally occurring amino acid
ADPDGRKRALLIGGGIAXFTDVAATFSGIIRALRXKESKLKAARVNIYVRRGGSKLPNWDSAKMPALGXELWLPIEVLWDQEATMDWICKATI

SEQ ID NO: 5246 - protein, 124 aa, Triticum aestivum
  misc_feature (26)..(26): Xaa can be any naturally occurring amino acid
  misc_feature (34)..(34): Xaa can be any naturally occurring amino acid
  misc_feature (101)..(101): Xaa can be any naturally occurring amino acid
MAPTVMSSTSVAPFQGLKSTAGLPVXSRRSNGAXSLGSVSNGGRIRCMQVWPIEGIKKFETLSYLPTLSTEALLKQVDYLIRSKWVPCLEFSKVGFIFREXHNASPGYYDRYLDNVESCPMFRH

SEQ ID NO: 5247 - protein, 106 aa, Triticum aestivum
  misc_feature (82)..(82): Xaa can be any naturally occurring amino acid
  misc_feature (93)..(93): Xaa can be any naturally occurring amino acid
MAPTVMASSATSVAPFQGLKSTAGLPVSRRSNGASLGSVSNGGRIRCMQVWPIEGIKKFETLSYLPTLSKEALLKAGRLPYXLKWVPCLQFNXVGVHLPRQKRNLG

SEQ ID NO: 5248 - protein, 156 aa, Triticum aestivum
  misc_feature (58)..(58): Xaa can be any naturally occurring amino acid
  misc_feature (72)..(72): Xaa can be any naturally occurring amino acid
  misc_feature (76)..(76): Xaa can be any naturally occurring amino acid
  misc_feature (80)..(80): Xaa can be any naturally occurring amino acid
  misc_feature (100)..(100): Xaa can be any naturally occurring amino acid
  misc_feature (113)..(113): Xaa can be any naturally occurring amino acid
  misc_feature (126)..(126): Xaa can be any naturally occurring amino acid
  misc_feature (128)..(128): Xaa can be any naturally occurring amino acid
  misc_feature (131)..(131): Xaa can be any naturally occurring amino acid
  misc_feature (133)..(133): Xaa can be any naturally occurring amino acid
  misc_feature (137)..(137): Xaa can be any naturally occurring amino acid
  misc_feature (142)..(142): Xaa can be any naturally occurring amino acid
MAPTVMASSATSVAPFQGLKSTAGLPVSRRSNGASLGSVSNGGRIRCMQVWPIEGIKXFETLSYLPPLSTEXLLKXVDYXIRSKWVPCLEFNKVGFIFRXHKHLLGYYDGRYXWTMWKLPKFRCNXAXQVXNXVEEXKKDYXTLFPINRIKSSGHG

SEQ ID NO: 5249 - protein, 205 aa, Triticum aestivum
  misc_feature (28)..(28): Xaa can be any naturally occurring amino acid
  misc_feature (100)..(100): Xaa can be any naturally occurring amino acid
PGIYLHSTPLAPPVMACSATSVGPFQGXLKSTAGLPVTRRSNGASLASVSHGGRIRCMQVWPIEGIKKFETLSYLPPLSTEALLKQIDYLIRSKCVPCLXEFSKVGFIFREHNASPGYYDGRYWTMWKLPMFGCTDATQVINEVEEVKKEYPDAYVRIIGFDNMRQVQCTSFIAFKPPPPEEKAPPSPAHSRQAIYKVPLQFCQL

SEQ ID NO: 5250 - protein, 195 aa, Triticum aestivum
  misc_feature (110)..(110): Xaa can be any naturally occurring amino acid
  misc_feature (130)..(130): Xaa can be any naturally occurring amino acid
  misc_feature (132)..(132): Xaa can be any naturally occurring amino acid
  misc_feature (143)..(143): Xaa can be any naturally occurring amino acid
  misc_feature (145)..(145): Xaa can be any naturally occurring amino acid
  misc_feature (156)..(156): Xaa can be any naturally occurring amino acid
  misc_feature (161)..(161): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDXRYWTMWKLPMFGCTDATQVXNXVEESRKDYPDXYXRIIGFKTCSSXCVNFXANLQDPERLKIITQHNAIFKAWFLHYFNFQKKSS

SEQ ID NO: 5251 - protein, 176 aa, Triticum aestivum
  misc_feature (108)..(109): Xaa can be any naturally occurring amino acid
  misc_feature (123)..(123): Xaa can be any naturally occurring amino acid
  misc_feature (127)..(127): Xaa can be any naturally occurring amino acid
  misc_feature (130)..(130): Xaa can be any naturally occurring amino acid
  misc_feature (132)..(132): Xaa can be any naturally occurring amino acid
  misc_feature (146)..(146): Xaa can be any naturally occurring amino acid
  misc_feature (151)..(151): Xaa can be any naturally occurring amino acid
  misc_feature (159)..(160): Xaa can be any naturally occurring amino acid
  misc_feature (164)..(164): Xaa can be any naturally occurring amino acid
  misc_feature (166)..(166): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYXXAGNWAMWKLPKFGXCTDXTQXVXTKWKEVKKEYPDAXVRIIXFDNMRQVXXVSFXAXKPTGCEVRKG

SEQ ID NO: 5252 - protein, 113 aa, Triticum aestivum
MAPTVMASSATSVAPFQGLKSTAGLPVSRRSNGASLGSVSNGGRIRCMQVWPIEGIKKFETLSYLPPLSTEALLKQVDYLDPLQSGLPLPLSSKVRFNPSVEAKMRPRVNRAA

SEQ ID NO: 5253 - protein, 431 aa, Triticum aestivum
MEMKLTIKRVPTVLSNYQEEGGGGCGRNCLGDCCLPASKLPLYAFKADPKKPAQDDELPTEFFLNSLLLAQWEDTVPRGLFRYDVTACETKVIPGELGFVAQLNEGRHLKKRPTEFRVDRVLQPFDSAKFNFTKVGQEEVLFRFEKGGGDSSYFLENAPSTEGDHAPSVVAINVSPIEYGHVLLIPRVLDRLPQQIDPESFLLALHMAAEAASPYFRLGYNSLGAFATINHLHFQAYYLSVPFPVEKAPTKKIPLAKCALNSGVKVSKLTNFPVRGLVFERGNTLKDLADVVTNACIWLQENNVPFNVLISDSGRRIFVFPQCYAEKQALGEVSQDLLDTQVNPAVWEISGHIVLKRRTDFEEASEASAWRLLAEVSLSEERFEEVKACIFEATGLTESDEEEESSESPYASSSSVPRASSHMSEGCLVLQ

SEQ ID NO: 5254 - protein, 328 aa, Triticum aestivum
  misc_feature (114)..(114): Xaa can be any naturally occurring amino acid
MVTPLPRFRARAFRGAARGAPAEIPLAVRRTWQQPMLVAAAESEPAVPTHFLCPISLDMMRDPVTAPTGITYDRESVEGWLERGHATCPVTGRPLRLEELVPNHATRRVIQEWXCVANRGPGVERVPTPRVPISAFDASELLAAVSAAARRGDGPRCRELVARARALGKESERNRRCFVSASAARALSSTYCHLAGQRVVPSTALEEILAAMVVFLPLDVESRGHIASPTSLGSVVSILSHSEPLARVSAVVVLARLAPHPTGRARGDVKTTGIYRGRKALKKPSRQATGGAGTGFTSHARGAAGPNRNLGGVAPLNAGDPKGPKKRR

SEQ ID NO: 5255 - protein, 530 aa, Triticum aestivum
  misc_feature (374)..(374): Xaa can be any naturally occurring amino acid
  misc_feature (490)..(490): Xaa can be any naturally occurring amino acid
MSMQQQQQQPARANLLGAMPAASMISLAFTAAVATAALWVAVAVARYNRKYRGLRLPPGPHGWPIVGNLFQVAFSGKLFIHYIRDLRREYGPILTLRMGVRTLVVISSAELVHEALVEKGTEFASRPAENTTRNIFSSNKFTVNSAVYGAEWRSLRLNMVSGMLSTSRLRESRPERLRAMDRFVARMRAEAAASADGASVWVLRNARFAVSSILLDMTFGLLDLDEEHIVHIDAVLKRVLLAVGVRMDDYLPFLRPFFWRKQRRALAVRREQVDTLLPLINRRRAILRDMQSSPPDPNVAAPFSYLDSLLDLHIEGREGADDELVTLCAELINGGTDTTATAIEWAMARIVDNPSIQARLHEEIMQQVGDARPXDDKDIESMPYLQAFVKELLRKHPPTYFSLTHAAVKPGSKLAGYDVPTDANLDIFLPTISEDPKLWDRPTEFDPDRFLTGGETAGIRMIPFGAGRRICPGLAMGTTHIALMVARMLXEFEWRAHPSQPAVDFKDKVEFTVVMNQPLLATVKPRKMSL

SEQ ID NO: 5256 - protein, 180 aa, Triticum aestivum
MVGSGMHAQRGDPLVVGRVIGDVVDPFVRRVALRVGYASRDVANGCELRPSAIADPPRVEVGGPDMRTFYTLVMVDPDAPSPSDPSLREYLHWLVTDIPATTGVSFGTEVVCYEGPRPVLGIHRLVFLLFQQMGRQTVYAPGWRQNFSTRDFAELYNLGLPVAAVYFNCQRETGTGGRRM

SEQ ID NO: 5257 - protein, 161 aa, Triticum aestivum
MDGLVGLLKVRVVRGINLAYRDARGSDPYVVLRLGKQKLKTSVKKRSVNPIWHEELTLSITNPNAPIKLAVFDKDTFSKDDPMGNADIEVLPFTEVLELDTEGIRNGTVVRSVAPSSGNCLAEESRVCWKNGKFVQDMILRLRNVESGEIMLKLEWVNMKK

SEQ ID NO: 5258 - protein, 225 aa, Triticum aestivum
  misc_feature (214)..(214): Xaa can be any naturally occurring amino acid
TGSGQTHRCFHPLPPFPTRVRAATHTNRVQIRRRISPWRPEPWAVLVAALAVALAGANSEGDALSALRRSLRDPGGVLQSWDPTLVNPCTWFHVTCDRDNRVTRLDLGNLNLSGHLVPELGKLEHLQYLELYKNNIEGTIPSELGDLKNLISLDLYKNNVSGTIPPTLGKLKSLVFLRLNGNRLTGPIPRELAGISSLKVVDISGNNLCGTIPXTGPFEHIPLSK

SEQ ID NO: 5259 - protein, 446 aa, Triticum aestivum
  misc_feature (89)..(89): Xaa can be any naturally occurring amino acid
  misc_feature (102)..(102): Xaa can be any naturally occurring amino acid
  misc_feature (135)..(135): Xaa can be any naturally occurring amino acid
  misc_feature (334)..(334): Xaa can be any naturally occurring amino acid
MHGGRPTTAFAGESGLYAPSRAWRPTSTSISLAKGACMFALKGLKNWMKPDKVPSAITTFPSTAQIVPEPLGVVLVISAWNYPFLLSIXPVIGAIAAGNAVXLKPSEVAPATSSLFAKLLPEYVDSSCIKVVEGXVTEPGALLQQKWDKIFYTGNGNVARVVLAAAAKHLTPVALELGGKWAVIVDSNVDLHVAAKRIAVGKWGWNNGQACIAPNYIITTKAFVTELVDSLKRVLERFYGEDPLQSADLSRIVSISHFERLTKLIEDKEVATKIQLGGQTDQEQLKIAPTVLVDVPIDTELMTGEILDTKAGAKPLDGLEESHHTQQRRGVRLXVSAVTKDKKLQQDFVSNVSAGGMLVNDVALHLTNPHLPFGGVGDSGTGSYHGKFSFDCFTHRKAVLIRGFGGEANARYPPYTAEKQRILRGLIKGSFFALILALLGFPREKR

SEQ ID NO: 5260 - protein, 206 aa, Triticum aestivum
ARGQNPRKFGPSPGRSIHRSPVPSPPPVPMDSAPPAAGAGYPESTDSSPRSRGGDSWDEPFPSSAAAAAAGGGGGRLRLMCSFGGRIVPRPTDKSLCYLGGETRIVAVDRNASLADVHGRLSRSLLAGQPFTLKYQLPNEDLDSLISVSTDEDLDNLVDEYDRVAATSSSGGASSRTSRIRLFLFPAKPESSSSLGSLLDDSSKSE

SEQ ID NO: 5261 - protein, 122 aa, Triticum aestivum
  misc_feature (23)..(23): Xaa can be any naturally occurring amino acid
  misc_feature (39)..(39): Xaa can be any naturally occurring amino acid
  misc_feature (57)..(57): Xaa can be any naturally occurring amino acid
  misc_feature (62)..(62): Xaa can be any naturally occurring amino acid
AEIKVTDVAAKAGKAIDWDGLAXMLVSDEARKEFANLRXATSEDVNHQLQNKFSQRXQKPIXWEILKKGKVQNFGYQRVNYNNIPKVCFTLSLPVKTKLCLILKWKGKRHLLKESEGRKGIA

SEQ ID NO: 5262 - protein, 225 aa, Triticum aestivum
GAQIPWEQVPSIQPRIVKMCRQLNKPVMVASQLLESMIEYPIPTRAEVADVSEAVHQRADALMLSGESAMGRYPDKALIVLSSVSLRIERWWREEKHHEPLELEDVSSSFSDKISEEICISAAKMANKLEVDAVFVYTKGGHMASLLSRCRPDCPIFAFTNSTSVRRRLNLQWGLIPFRLTFSDDMESNLNRTFSLLKARGMIKSGDLVIALSDMLQSIQVMNVP

SEQ ID NO: 5263 - protein, 145 aa, Triticum aestivum
PKPAEIRPPGRSTDPSIPRPLPFPAPMDSAPPAAGGGGPGAGYPESTDSSPRSRGGDSWDEPFPSSAAAAAAGAGGRLRLMCSFGGRIVPRPTDKSLCYLGGETRIVAVDRNASLADVHARLSRSLLAGQPFTLKYQLPNEDLDS

SEQ ID NO: 5264 - protein, 148 aa, Triticum aestivum
SKSPPKTRGESAPREIHRSPSPPPSHPLSPMDSAPPAAGGGPGAGYPESTDSSPRSRGGDSWDEPFPSSAAAAAAGGGGRLRLMCSFGGRIVPRPTDKSLCYLGGETRIVAVDRNASLADVHARLSRSLLAGQPFTLKYQLPNEDLDS

SEQ ID NO: 5265 - protein, 191 aa, Triticum aestivum
  misc_feature (92)..(92): Xaa can be any naturally occurring amino acid
  misc_feature (122)..(122): Xaa can be any naturally occurring amino acid
  misc_feature (141)..(141): Xaa can be any naturally occurring amino acid
  misc_feature (151)..(151): Xaa can be any naturally occurring amino acid
  misc_feature (166)..(166): Xaa can be any naturally occurring amino acid
  misc_feature (174)..(174): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFREHNASPWGTTMAGYWDNVEAAXVSGWHRRQRKVINEVGGRXKKEYPDAYVXRIIRFDNMRQVQCVXSFIPFKPXPGCEESGKAKQLITRAI

SEQ ID NO: 5266 - protein, 100 aa, Triticum aestivum
  misc_feature (43)..(43): Xaa can be any naturally occurring amino acid
  misc_feature (55)..(55): Xaa can be any naturally occurring amino acid
  misc_feature (69)..(69): Xaa can be any naturally occurring amino acid
  misc_feature (77)..(77): Xaa can be any naturally occurring amino acid
  misc_feature (82)..(82): Xaa can be any naturally occurring amino acid
LIPHKTFQGNRPSLSFLLSSLSAYEIGQLLSIYEHRIAVQGFXWGINPFDQWGVXELGQSLVPTVKETXHAPRMEGXPVPGXQPQARFAPHVSLNHPTPL

SEQ ID NO: 5267 - protein, 280 aa, Triticum aestivum
TRPAHASRTRGRTRGPEDFATWQRIIRLDAIRANAEWISFSRDQAEVPKEKALQSAASVGLKDFDHLEPHMIYHAARLVGLLEAYAIYDPEIGYCQGMSDLLSPIIAVMEEDDAAFWCFVGFMRKARHNFRLDEVGIKRQLKIVSQIIKRKDSHLYRHLQKLQAEDCFFVYRMVVVLFRRELTFEQTVCLWEVMWADPAAIRAGIGRTPWGKIRLHAPPTDDLLLYAIAACVLQRRKLIIEKYSSMDEILRECNSMAGQLDVWRLLDDAHDLVVNLHDKI

SEQ ID NO: 5268 - protein, 209 aa, Triticum aestivum
ARADPYIDGPIIQASVARALASGTTMDAVLEMLREVTPELSCPVVLLSYYKPIMSRSLAEMKEAGVHGLIVPDLPYVAAHSLWSEAKNNNLELVLLTTPAIPEDRMKEITKASEGFVYLVSVNGVTGPRANVNPRVESLIQEVKKVTNKPVAVGFGISKPEHVKQIAQWGADGVIIGSAMVRQLGEAASPKQGLRRLEEYARGMKNALP

SEQ ID NO: 5269 - protein, 225 aa, Triticum aestivum
  misc_feature (194)..(194): Xaa can be any naturally occurring amino acid
VAPTAPLAAKPRLARPPARLSVSCSASSGDNTTPSLSASIKTFSAALALSSVLLSSAATSPPPAAADIAGLTPCKESKAFAKREKQSVKKLNSSLKKYAPDSAPALAIQATIEKTKRRFENYGKFGLLCGSDGLPHLIVSGDQRHWGEFITPGVLFLYIAGWIGWVGRSYLIAVSGEKKPAMREIIIDVELAAXRIIPRGFIWPVAAYRELINGDLVVDDADIGY

SEQ ID NO: 5270 - protein, 137 aa, Triticum aestivum
  misc_feature (88)..(88): Xaa can be any naturally occurring amino acid
  misc_feature (98)..(98): Xaa can be any naturally occurring amino acid
  misc_feature (104)..(104): Xaa can be any naturally occurring amino acid
  misc_feature (111)..(111): Xaa can be any naturally occurring amino acid
MEVFGKSVIAEPSNVIFLSAILNTEGSNPSHKCDKRCQSERILGNMYRCKLTETTHICDKNCNQRILYDNHNSLCRVSGQLFPLSPLXEQQAVKGIRXKHEVDXSEGCCFXRRRGAKLHPSPSGLLGCVPIRAKLME

SEQ ID NO: 5271 - protein, 218 aa, Triticum aestivum
  misc_feature (212)..(212): Xaa can be any naturally occurring amino acid
EEFGRGTIDEDLAKEIREFRSPTDGETRMFYEIVVAPGYTEKGLEVLKGKSKTLRILEAKRSGKNMLSLRQVSGGWLAQQSDDLAPEDITFTTGSERAPTDSELSDAKFAWLCVKHVKSNAIVIAKDNCMLGRGGGQPNRVDSLRIAFRKAGEAAKGAALASDAFFPFAWKDAVEEACENGIGTIAQPGGSMRDKDAVDCCNKYGVSLLFTXVRHFRH

SEQ ID NO: 5272 - protein, 599 aa, Triticum aestivum
  misc_feature (173)..(173): Xaa can be any naturally occurring amino acid
MVCAAVSLAGGSATATATSLSRRPALGLRSRRLLWARAMSHVAPRLSSATVGAPTPDHDQRPGRARAVAAQAGPRQALISLSDKTDLANLGNGLESLGFSIISTGGTASSLEAAGVNVTKAEQITHCPEMLDGRVKTLHPSIHGGILARRDQEHHLEALNEHGIGTFDVGCGXNLYPFYDKVTSGTITFEDGIENIDIGGPTLIRAAAKNHKDVLVVVDHHDYPALLKYLQENQVDPQFRRMLAWKAFQHVASYDSAVSEWLWKQSSGGDIFPPSFTVPLSMKSTLRYGENPHQKAAFYGDRSLSLVNAGGIATSFQHHGKEMSYNNYLDADAAWNCVSEFENPTCVVVKHTNPCGVASRQDVLEAYRLAVRADPVSAFGGIVAFNTTIDEDLAKEIREFRSPTDGETRMFYEIVVAPGYTEKGLEVLKGKSKTLRILEAKRSGKNMLSLRQVSGGWLAQESDDLTPEDITFTTGSERAPTDSELSDAKFAWLCVKHVKSNAIVIAKDNCMLGMGSGQPNRVDSLRIAFRKAGEAAKGAALASDAFFPFAWKDAVEEACENGIGTIAQPGGSMRDKDAVDCCNKYGVSLLFTGVRHFRH

SEQ ID NO: 5273 - protein, 474 aa, Triticum aestivum
  misc_feature (24)..(24): Xaa can be any naturally occurring amino acid
  misc_feature (34)..(34): Xaa can be any naturally occurring amino acid
  misc_feature (331)..(331): Xaa can be any naturally occurring amino acid
LWLFCLDGRVVPLHPGLQGGCLAXIDQEHNLKAXHEHGVYKILCGLWINLCLFYVKVTSGTIAFEDGIENIDIGGPTLIRAAAKNHKDVLVVVDHHDYPALLKYLQEKQVDPQFRRMLAWKAFQHVASYDSAVSEWLWKQSSGGDIFPPSFTVPLSMKSTLRYGENPHQKAAFYGDRSLSLVNAGGIATSFQHHGKEMSYNNYLDADAAWNCVSEFENPTCVVVKHTNPCGVASRQDVLEAYRLAVRADPVSAFGGIVAFNTTVDEDLAKEIREFRSPTDGETRMFYEIVVAPGYTEKGLEVLKGKSKTLRILEAKRSGENMLSLRQVNGXWLAQESDDLTPEDITFTTGSERAPTDSELSDAKFAWLCVKHVKSNAIVIAKDNCMLGMGSGQPNRVDSLRIAFRKAGEAAKGAALASDAFFPFAWKDAVEEACENGIGTIAQPGGSMRDKDAVDCCNKYGVSLLFTGVRHFRH

SEQ ID NO: 5274 - protein, 94 aa, Triticum aestivum
AQYHCMLGLGSGQPNRVDSLRIAFRKAGEAAKGAALASDAFFPFAWKDAVEEACENGIGTIAQPGGSMRDKDAVDCCNKYGVSLLFTGVRHFRH

SEQ ID NO: 5275 - protein, 246 aa, Triticum aestivum
  misc_feature (199)..(199): Xaa can be any naturally occurring amino acid
  misc_feature (227)..(227): Xaa can be any naturally occurring amino acid
MANIDMAAVLADMDRDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPAHVILCADGTISLSVLSCDPAAGTVRCRCENTAMLGERKNCNLPGIVVDLSTLTEKEXEDILGWGVPKGLDMNGLELVRKGIKLVXTVRHFFGQHAKGLKLMSKG

SEQ ID NO: 5276 - protein, 132 aa, Triticum aestivum
MATAARAVAAAARPVHPVFLSRRLPCPSARPARPRVGRAVRCMARRPDASYSPLRPGQGGDRAPTEMAPLFPGCDYEHWLIVMDKPGGEGATKQQMIDCYIQTLAKVVGSEEDAKKRIYNVSCERYFGFGCE

SEQ ID NO: 5277 - protein, 284 aa, Triticum aestivum
  misc_feature (141)..(141): Xaa can be any naturally occurring amino acid
  misc_feature (271)..(271): Xaa can be any naturally occurring amino acid
MPAAHSLLHLAAPKSVAPTSTLSLAGAAHLRLLPSRRPQRLVASCSSAHPDLAAFPNPNGLLVAEPAAAAPIDIDVATEAELRENGSRSTRRTKLVCTVGPATCGPSELEALAVGGMNVARLNMCHGDREWHQKVISSVRXLNEEKGYAVAVMMDTEGSEIHMGDLGGAPAAKAEDGEIWTFSVRSFEAPLPELTVHVNYEGFAEDVRVGDDLLVDGGMARFEVVEKLGPDVKCRCTDPGLLLPRANLTFWRDGSVVRAKNAMLPTITSKXDWLDIALWHCRQV

SEQ ID NO: 5278 - protein, 135 aa, Triticum aestivum
MASTACFVIVSKNDIPIYEAEVGSAPKKEDLAYHHQFILHAALDVVQDLAWTTNAMFLRSVDRFNDLVVSVYVTAGHTRFMLLHDSRSEDGIKSFFQEVHELYIKIFLNPLYLPGSRIASSHFDTKVRAPPRKYL

SEQ ID NO: 5279 - protein, 246 aa, Triticum aestivum
  misc_feature (149)..(149): Xaa can be any naturally occurring amino acid
  misc_feature (212)..(212): Xaa can be any naturally occurring amino acid
MGNGLSPCVSMPAAAEAPAGARLVYWGGRTRALRVAGDEEGEGEGNGGVPCTDADVTAELLPADHVVCPADSFFVGLPVPVALPGERLLPGRTYFVLPRRLLSSPSPGGKAAVLTAGTLASLSAAPGGRKTVQLAGPGQCPFEYVKGGXDGAAALIRVLPQVIEKVITWDGGNGKADAARRGGPCNVGPTGTDLCSTPDLNRDYAQLVGPRXRPGSPRLETISEPNRRGFFSPGENCFVPRKRNNS

SEQ ID NO: 5280 - protein, 214 aa, Triticum aestivum
  misc_feature (80)..(80): Xaa can be any naturally occurring amino acid
  misc_feature (167)..(167): Xaa can be any naturally occurring amino acid
MGGAAAAAGAARWIQRLSAARISTEALERGQSRVIDASLTLIRERAKLKGELLRAMGGVKASATLLGVPLGPTTQSFLQXGPAFAPPRIREAIWCGSTNSSTEEGKELNDPRVLTDVGDVPIQEIRDCGVEDDRLMHVISESVKTVMDEDPLRPLVLGGDHSISYPXVVRAVSEKLGGPVDILHLDAHPDIYDCFEGNTYSHASSFARIMEGGY

SEQ ID NO: 5281 - protein, 354 aa, Triticum aestivum
  misc_feature (195)..(195): Xaa can be any naturally occurring amino acid
LSGALAAGNAVVLKPSELAPATAAFLAANIPRYLDAEAVKVVLGAAEIGQELMEHRWDKVLFTGGARVGRIIMTKAAKYLTPVALELGSKCPCIVDWLDSKRDSQVAVNRIIGAKWSTCAGQACIAIDYILVEEQFAPILIELLKSTLERLFTKPEDMARILNERQFNRLCGLLEDHKVSRSIVHGGDVDPKDLXASKPTILLNPPLDSDVMTEEIFGPLLPIITVKKIEDSIEFVSSRPKPLAIYAFTTSEALKQRIVRETSSGSVTFNDAIVQYGLESIPFGGVGQSGFGQYHGKYSFEMFSHKKAVFRRSFLLEFMFRYPPWNDDSKLALLRHVFRYDYVSLFLALLGLRR

SEQ ID NO: 5282 - protein, 296 aa, Triticum aestivum
DAVGLKRHSARDPDEIEEEQRDRARRKKINGQFELFVKRVVSVWSQPRFQQLGLHFERPSQKLGFNGVHGRTTCFIVPTPSCLVQLVESPFLVTSLREVEIVCLERVALGQKSFDMVFVFQDLKRDVVRIEVIPMASLDKIKDWLNDSNLKYYESKLNLNWRMVLKKLDEPGCDTNDRWEFLNPDATDSDSEDSETDDDKYEPSDAESASDSDDEDSDSESVVDSGEDEAVSAGSDDDDDAAESWDEMERKARDADMEMGSESDSEDERQRRREKAKRQLNPQQSKGVPQKRQRVN

SEQ ID NO: 5283 - protein, 213 aa, Triticum aestivum
MVNTTAAMVSGGVLPLASLNHISIVCRSVEESLDFYMNVLGFTPIRRPGSFDFDGAWLFNYGIGIHLLQSEHPESLPAKKEINPKDNHISFQCESMVAVERRLKELGIPYIQRCVEEGGIYVDQIFFHDPDGFMIEICNCDKLPVVPLAGQNFAMAACKRVASVKQQQLPMPVAQVAQATPAPAAAAASQCVPAPNPALQRVGGEEAAHISCA

SEQ ID NO: 5284 - protein, 549 aa, Triticum aestivum
MAAAATRRAASSLASRCLLARPAASPAAVPSALRRADGARGLLPGLLQRFGTAAAAEEPISPSVQVGETQLLINGKFVDAASGKTFPTVDPRTGEVIARVAEGDAEDVDRAVVAARKAFDEGPWPRMTAYERSRILLRFADLIEKHNDDIAALETWDNGKPYEQAAHIEVPMLARLMRYYAGWTDKIHGLIVPADGPHHVQVLHEPIGVVGQIIPWNFPLLMYGWKVGPALACGNTIVLKTAEQTPLSALYVSKLLHEAGLPEGVLNIVSGFGPTAGAALASHMDVDKIAFTGSTDTGKVILELSARSNLKPVTLELGGKSPFIVMDDADIDQAVELAHFALFFNQGQCCCAGSRTFVHERVYDEFVEKSKARALKRVVGDPFRKGVEQGPQIDDEQFKKILRYIKSGVDSGATLVTGGDKLGDKGYYIQPTIFSDVQDGMKIAQEEIFGPVQSIFKFNDLNEVIKRANASQYGLAAGVFTNNLDTANTLTRALRAGTVWVNCFDIFDAAIPFGGYKMSGIGREKGIDSLKNYLQVKAVVTALKNPAWL

SEQ ID NO: 5285 - protein, 139 aa, Triticum aestivum
  misc_feature (15)..(15): Xaa can be any naturally occurring amino acid
  misc_feature (32)..(32): Xaa can be any naturally occurring amino acid
  misc_feature (51)..(51): Xaa can be any naturally occurring amino acid
APWKTFKFLDNLRPXLCGLYEKNSIFCKFECXLEGECYFFVTGSSKNLFGXFGCTPGNTEATTLEASRNPMRRQVANPTRPTRTLTSLTRAVRRGGENAGADGNGNSNDFSTKLLHLAWHPTENSIACAAGNSLYMYYA

SEQ ID NO: 5286 - protein, 479 aa, Triticum aestivum
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFAEWNKGELLSFLVEITADIFSIKDDQGEGYLVDKVLDKTGMKGTGKWTVQQAAELSVAAPTIEASLDSRFLSGLKDERVAASKIFQGDYSSGETVDKAQLIEDVRKALYASKICSYAQGMNIIKAKSMEKGWGLNLGELARIWKGGCIIRASFLDRIKKAYDRNGELANLLIDPEFAQEIMDRQAAWRRVVCLAINNGVSTPGMSASLAYFDSYRRDRLPANLVQAQRDYFGAHTYERVDMPGSFHTEWYKIANSKI

SEQ ID NO: 5287 - protein, 446 aa, Triticum aestivum
  misc_feature (201)..(201): Xaa can be any naturally occurring amino acid
  misc_feature (277)..(277): Xaa can be any naturally occurring amino acid
  misc_feature (284)..(284): Xaa can be any naturally occurring amino acid
MDEFELEDNLEFILQSIQELIEDQGENNPFGEVNQNELLANLVNYDQDNLMPDVSVEDVVNGKDVQGIPWEKMLFPRDQYREMKMKGYKNYQNLSYAREDALQDCKQVERDGPYYDFQYNTRRARPSIVHFQLRNLVWATTKHDVYTVHNQSMTHWSSLNQISTELINGDDCIIPKQRGHGSQSVSMVQFTTMAVDNDFLXVVGGFHGELICKRLEDDGIVFSTRVTDDENAITNSLEIYQDPNGSRRLVVANNDCSVRIFDTKYFDLLNHYVFPWXSVNSVSXNPDATLFAVLGDHEDGLVVDPKCGKPIGKVRGHLDYSFSSAWHPDGNILATGSQDTTCRLWDIRNLSQSLAVLGGRLGSIRCIKFSSDGRFLATAEPIDFVHIYDCFADYGKSHEIDFFGEIAGLSFSPDTEAFYIGVADQTYGGLMEFKRRHQHHYLNCLW

SEQ ID NO: 5288 - protein, 536 aa, Triticum aestivum
  misc_feature (206)..(206): Xaa can be any naturally occurring amino acid
MTKHAGGAQGGVKQALISLSDKTDLANLGNGLQNLGFSIISTHGTASSLEAAGVNVTKVEQITNFPEMLDGRVKTLHPSIHGGILARRDQEHHLKALNEHGIGTFDVVVVNLYPFYDKVTSGTISFEDGIENIDIGGPTLIRAAAKNHKDVLVVVDHHDYPALLKYLQEKQADPQFRRMLAWKAFQHVASYDSAVSEWLWKQSSGXDIFPPSFTVPLSMKSTLRYGENPHQKAAFYGDRSLSLVNAGGIATSFQHHGKEMSYNNYLDADAAWNCVSEFENPTCVVVKHTNPCGVASRQDVLEAYRLAVRADPVSAFGGIVAFNTTVDEDLAKEIREFRSPTDGETRMFYEIVVAPGYTEKGLEVLKGKSKTLRILEAKRSGENMLSLRQVSGGWLAQESDDLTPEDITFTTGSERAPTDSELSDAKFAWLCVKHVKSNAIVIAKDNCMLGMGSGQPNRVDSLRIAFRKAGEAAKGAALASDAFFPFPWKDAVEEACENGIGTIAQPGGSMRDKDAVDCCNKYGVSLLFTGVRHFRH

SEQ ID NO: 5289 - protein, 155 aa, Triticum aestivum
LRNFPSLPCSLTNSCPCGFLAQNRRYLVYANGLCAAYSLVSAFYTAVPRPATLSRSWIVFLLDQVFTYLILAAGAASAELLYLAYNGDKEVTWSEACGVFGGFCRQARTSVAITFGSVVCYILLSLISSYRLFSAYDAPMPSLGNKGVEIAAFPR

SEQ ID NO: 5290 - protein, 314 aa, Triticum aestivum
  misc_feature (198)..(198): Xaa can be any naturally occurring amino acid
  misc_feature (211)..(211): Xaa can be any naturally occurring amino acid
  misc_feature (235)..(235): Xaa can be any naturally occurring amino acid
  misc_feature (244)..(245): Xaa can be any naturally occurring amino acid
  misc_feature (252)..(252): Xaa can be any naturally occurring amino acid
YNKFVQKSRLVPVRNSRDIVDPRVRGRGEPGRGRGGGRYGQNRDFGSENSNGYQGGYGGVGSGDGAVAGGGDGERDPRPYRGGGGRRGSYRNGEFGDDSERPPRRNYERHSGTGRGQGMKRDGAGRGNWGSSTDEGLAQETDEALKIEDNAPIAEKQGEQDDAPPTTVENKDHKDGAAKEEEENEEDKEMTLEEFEKXREGQREALLAFEXGRKKGVKLTRASCSSLQPLSTKTXSDEVFIKWXXSDREKKXECTERDERRQEVFLASTSSSRPAEGRGDRGGFRGGFGGGYQRGQAAAPSIEDRSQFPTLGGK

SEQ ID NO: 5291 - protein, 367 aa, Triticum aestivum
NPSPPPHPKPLPPSTSSSNGITAHQAAPAGKAAQTAASAKLTTKSAPPAQAGRDARSGGPPSRGGFGRGEPGRGRGGGRYGQNRDFGSENSNGYQGGYGGVGSGDGAVAGGGDGERDPRPYRGGGGRRGSYRNGEFGDDSERPPRRNYERHSGTGRGQGMKRDGAGRGNWGSSTDEGLAQETDEALKIEDNAPIAEKQGEQDDAPPTTVETKDHKDGAAKEEEENEEDKKMTLEEFEKIREEQRKALLALKTEERKVEVDKDLQSLQPLSTKKANDEVFIKLGSDKEKKKESTERDERAKKSLSINEFLKPAEGERYYGGRGRGRGRGEGRGDRGGFRGGFGGGYQRGQAAAPSIEDRSQFPTLGGK

SEQ ID NO: 5292 - protein, 235 aa, Triticum aestivum
  misc_feature (63)..(63): Xaa can be any naturally occurring amino acid
  misc_feature (96)..(96): Xaa can be any naturally occurring amino acid
  misc_feature (197)..(197): Xaa can be any naturally occurring amino acid
MITPRYFCDTIEYSSYASNALGALPYGRPAGGRTSDSSGRPGRYGNRSGYFDETREEYVEIPXSDSGITFNEQPKMKALETAERTRDAILSGKFDXQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGARXRSDIQTPGLANVAATVMNLHGFQAPADYETTLIEVVDK

SEQ ID NO: 5293 - protein, 272 aa, Triticum aestivum
  misc_feature (100)..(100): Xaa can be any naturally occurring amino acid
  misc_feature (119)..(119): Xaa can be any naturally occurring amino acid
MHPTRWELSHMVDLQAAALVISSGRPGRSGILQYDGELKLPSKYLVSPPLIERTSGEYLVKNGVRTFACSETVKFGHVTFFWNGNRSGYFDETREEYVEXPSDSGITFNEQPKMKALEXAERTRDAILSGKFGQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 5294 - protein, 165 aa, Triticum aestivum
MEVQAGTHGDTATSKFTLPVDSEHKAKSIRLFSFANPHMRTFHLSWISFFTCFVSTFAAAPLVPIIRDNLNLAKADIGNAGVASVSGSIFSRLAMGAVCDLLGPRYGCAFLVMLSAPTVFCMAVIDDASGYIAVRFLIGFSLATFVSCQYWMSTMFNSKIIGTVN

SEQ ID NO: 5295 - protein, 276 aa, Triticum aestivum
  misc_feature (158)..(158): Xaa can be any naturally occurring amino acid
  misc_feature (224)..(224): Xaa can be any naturally occurring amino acid
  misc_feature (234)..(234): Xaa can be any naturally occurring amino acid
MHPTRWELSHMVDLQAAALVISVVAAEVPPNPISSPPLPSARPNPIRSPPSSSVAMGRKFFVGGNWKCVESIVNTLNAGQIASTDVVEVVVSPPYVFLPTVKGKLRPEIQVAAQNCWVKKGGAFTGEVSAEMLVNLGVPWVILGHSERRSLMGESSEXVGEKVAYALAQGLKVIACVGETLEQREVGSTMAVVAEQTKAIADKIKDWTNVVVAYEPVWAIGTGXVASPAQAQEXHGHLRDWLRTNVSPDVAESTRIIYGGSVTCASCKELAGQPDL

SEQ ID NO: 5296 - protein, 258 aa, Triticum aestivum
  misc_feature (10)..(10): Xaa can be any naturally occurring amino acid
KLHAEAGKGXFEVALKYVLCTLAADNLIYAREIIKSVARKHGLIATFLPKPDLNDIGSGSHVHLSLWKNDQNVFMGSNEYSHYGMSNVGEQFLAGVYHHLPSILAFTAPHPNSYDRIQPNTWSGAYLCWGKENREAPLRTACPPGVPLDMVSNFEIKSFDGCANPHLGLAAIVAAGIDGLRKGLKLPEPIESNPADYATKLKRLPQDLLESVESLAADKTLHELIGDKLITAIIAVRKAEIDHYSKNPGAFGDLIHRY

SEQ ID NO: 5297 - protein, 197 aa, Triticum aestivum
AAFPLLLASPRLLLHFLQNSLRRRVDWTDDQWKQVAQNLSGTKFTGGDRVEVSSDEEGFNGAWFQGTVVKSVGHKFLVEYDALKDDDEITPLKETIGEEHIRPSPPAIPVTNGFKVLDEIDAYTNDGWWVGVISEVLDDQKYKVYFKAYKEQNDFELEQLRRHCDWVGGRWMQASPARGMRQLNGHTHLCTGAWDSP

SEQ ID NO: 5298 - protein, 147 aa, Triticum aestivum
MASNGLVVFAVLLAAAFLVATAEQTQAKKEETKAGVQGYHGGGGGGGGYHGGGGGGGYPGHGGGGGGGYPGHGGGGGGGYPGHGGGGGGGYPGHGGGGGGGYPGHGGGGGGGSGCRYQCCGHGRGGCRCCASPNEIPEPMYRAEVRN

SEQ ID NO: 5299 - protein, 145 aa, Triticum aestivum
MRVSSMASKGLVVFAVLLAAAFLVATAEQTQAKKEETKAGVQGYHGGGSGGGGYHGGGGGGGYPGHGGGGGGGGYPGGGGGGGFGGYPGHGGGGGGGGYPGHGGGGGGGGSGCRYQCCGHGHGGCRCCASPNEIPEPMYRAEVRN

SEQ ID NO: 5300 - protein, 522 aa, Triticum aestivum
  misc_feature (428)..(428): Xaa can be any naturally occurring amino acid
RPPTRPDGYAFPETYYLGSRRARDVVYRVLSAASEDGDLSIQEAIDAVEDIFRRNASDLYKLNVANGSIHQKTIADNRIASSCVEQDVLFVRIVWNDASGQHRCRVVPAGRFYEIARNKGVGLTFASMGMTSFCDGPADGTNLTGVGEIRLMPDMSTLLRLPWSTREEMVIADMQIRPGEAWEYCPRYALRKVTKVLLDEFNVTMKAGFENEFYLRRKLVSEGHERWVPYDNSSYCSTSSFDGASSILQEVYSSLKVANIVVEQLHAEAGKGQFEVALKYVLCTLAADNLIYAREIIKSVARKHGLIATFLPKPDLNDIGSGSHVHLSLWKNDQNVFMGSNEYSHYGMSNVGEQFLAGVYHHLPSILAFTAPHPNSYDRIQPNTWSGAYLCWGKENREAPLRTACPPGVPLDMVSNFEIKSFDGCANXPHLGLAAIVAAGIDGLRKGLKLPEPIESNPADYATKLKRLPQDLLESVESLAADKTLHELIGDKLITAIIAVRKAEIDHYSKNPGAFGDLIHRY

SEQ ID NO: 5301 - protein, 218 aa, Triticum aestivum
MTCGPGAAAAVSRFIKCVAVGDGAVGKTCMLICYTCNKFPTDYIPTVFDNFSANVSVDGSIVNLGLWDTARQEDYSRLRPLSYRGADVFILSFSLTSRASYENVHKKWMPELRRYAPGIPVLLVGTKLDLREDRAYLADHAADSIITTEQGEELRRQIGAVAYIECSSKTQRNIKAVFDTAIKAVLQPQRHKEVARKEIRTRSSRSVRRYFCGSVCLA

SEQ ID NO: 5302 - protein, 393 aa, Triticum aestivum
  misc_feature (299)..(299): Xaa can be any naturally occurring amino acid
  misc_feature (327)..(327): Xaa can be any naturally occurring amino acid
PAGSEYPHPLISLLLPPSPLIDQEKLQPSAMEPIPLLTPYKMGQFDLAHRVVLAPLTRRRSYANMPQPHAAVYYSQRATAGGLLIAEATVVSNTGRGYTDTPGIWTAEHVEAWKPIVAAVHAKGALFFCQIWHVGRVSTFELQPGGAAPLSSTEKGVGPQMSFDGRLEEFSPPRRLTVEEIPALVDDFRKAARNAIDAGFDGVEIHGANGYIIEQFLKDSANDRTDEYGGSLENRCRFALEVVDAVVKEVGGHRVGIRLSPFADYMDCHDSDPHSLALYMSTKLNDHDILYIHMIEPRXMPLWMARRVVPKRLLPYREAFKGTFVRXGGYDREEGGKVVAEGYTDLVAFGRLFLANPDLPNRFEVGADLNKYDRMTFYTPDPVIGYTDYPFLE

SEQ ID NO: 5303 - protein, 145 aa, Triticum aestivum
  misc_feature (47)..(47): Xaa can be any naturally occurring amino acid
  misc_feature (83)..(83): Xaa can be any naturally occurring amino acid
MLVYQDLLSGDELLSDSFTYKELENGVLWEVEGKWVTQGPVDVDIGXANPSAEGGEDESVDDTAVKVVDIVDTFRLQEQPPFXDKKSFVSLTLKKYIKESHCCVWSQEKADDSKKGVQGCNQILPNKLKDLKFLLGENMKDETPW

SEQ ID NO: 5304 - protein, 493 aa, Triticum aestivum
MITPRYLGDTIEYSSYASNALGALPYGRPAGGRTSDLVAAEVIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVIDK

SEQ ID NO: 5305 - protein, 232 aa, Triticum aestivum
  misc_feature (49)..(49): Xaa can be any naturally occurring amino acid
  misc_feature (197)..(197): Xaa can be any naturally occurring amino acid
  misc_feature (225)..(225): Xaa can be any naturally occurring amino acid
NKFVQKSRLVPVRNSRDIVDPRVRGFNYIKESFDKGTLHLIGLLSDGGXHSRLDQVQLIVKGASERGAKRIRLHILTDGRDVLDGSSVGFVETIEKDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRXADRMVMLAKALEFPDFDKFDRVRVPKIXYAGDASI

SEQ ID NO: 5306 - protein, 209 aa, Triticum aestivum
  misc_feature (176)..(176): Xaa can be any naturally occurring amino acid
  misc_feature (199)..(199): Xaa can be any naturally occurring amino acid
MGSGNLMVKKVVRPSSFDLDIHLDKSWKEDVTCPICLDYPHNAVLLRCTSYEKGCRPFVCDTDQSRSNCLERFKGAYELPANVKVSSIAVAPLDSIHVGSSHAYDRPSCPLCRGDVIGWIVISEARLHLNQKKRCCEEDCCSFTGNFNELQKHTQQKHPDSRPSEIDPARQVDWDXFQQSSDIVDVLSTIHAQVPNGIXLGDYVIEYGG

SEQ ID NO: 5307 - protein, 249 aa, Triticum aestivum
  misc_feature (172)..(172): Xaa can be any naturally occurring amino acid
  misc_feature (224)..(224): Xaa can be any naturally occurring amino acid
MGSGNLMVKKVVRPSSFDLDIHLDKSWKEDVTCPICLDYPHNAVLLRCTSYEKGCRPFVCDTDQTRSNCLERFKGAYELPANVKVSSIAVAPLDSIHIVSSHANNRPSCPLCRGDVIGWIVISEARLHLNQKKRCCEEDCCSFTGNFNELQKHTQQKHPDSRPSEIDPARQXDWDNFQQSSDIVDVLSTIHAQVPNGIVLGDYVIEYGDDDTGDDYEVLRRVRXEWWSFICCKAFVDIQEPKKRERKGQ

SEQ ID NO: 5308 - protein, 257 aa, Triticum aestivum
DPGMKGVLATRVSGSADLYQVNQRKPHHGVNFIIAHDGFTLCDLVSYNLKHNDANGEGGRDGCNDNFSWNCGVEGETNDSNVLALRSRQMKNFHVALMISQGTPMMLMGDEYGHTRYGNNNSYGHDTCINNFQWGQLAERRYGHFRFFSEMIKFRQNHPILKRDRFLSKNDVTWHEDCWDNLESKFLAFTIHDHNSGGDIYLAFNAHDYSVDAVIPPAPQQKHWNRVVDTNLESPNDIAPLLINALVCNSICIFVTL

SEQ ID NO: 5309 - protein, 203 aa, Triticum aestivum
  misc_feature (181)..(181): Xaa can be any naturally occurring amino acid
FIIAHDGFTLCDLVSYNLKHNDANGEGGRDGCNDNFSWNCGVEGETNDSNVLALRSRQMKNFHVALMISQGTPMMLMGDEYGHTRYGNNNSYGHDTCINNFQWGQLAERRYGHFRFFSEMIKFRQNHPILKRDRFLSKNDVTWHEDCWDNLESKFLAFTIHDHNSGGDIYLAFKAPRLFWXDLGNPPPPQHKHWNQGWGYQPW

SEQ ID NO: 5310 - protein, 129 aa, Triticum aestivum
  misc_feature (22)..(22): Xaa can be any naturally occurring amino acid
  misc_feature (92)..(92): Xaa can be any naturally occurring amino acid
  misc_feature (115)..(115): Xaa can be any naturally occurring amino acid
MAPTVMAFTATTISLLGGLKAXAGLPFSLLSNGSLFRVSNGGRIRCMQVWPIEGIKKFETLSYLPPLSTEALLKQVDYLIRSKWVPCLEFRXVSFIFREHNNSPGYYYGRYWTMXNLPMFGCTYSIQVL

SEQ ID NO: 5311 - protein, 369 aa, Triticum aestivum
MEPHAESKPIPLMTPYKMGSSLDLAHRVVLAPLTRQRSYGNVPQPHAAVYYGQRATPGGMLITEATGVSDTAQGYTDTPGVWTAEQAEAWRPVVDAVHAKGALFFCQLWHVGRVSSYGFQPGGAAPVSSTQRMVGPQVRHDGTTEEFSPPRRLAVEEIPMIVDDFRKAARNAINAGFDGVEIHGGNGYLIEQFLKDSANDRDDGYGGSLENRCRFALEVVDAVAKEVGAHRVGIRLSPFMDYMDCHDSDPHALGLHMATKLNDHGILYLHMIEPRMALVDGRRVVPHRLLPYREAFKGTFIANGGYDREDGDKAVASGYADLVSFGRLFLANPDLPKRLELNAPLNKYNRMTFYISDPVVGYTDYPFLP

SEQ ID NO: 5312 - protein, 369 aa, Triticum aestivum
MEPQAEPKPIPLMTPYKMGASLDLAHRVVLAPLTRQRSYGNVPQPHAAVYYGQRATPGGMLITEATGVSDTAQGYTDTPGVWTAEQAEAWRPVVDAVHAKGALFFCQLWHVGRVSKYGFQPGGAAPVSSTERMVGPQVRHDGSTEEFSPPRRLAAEEIPMIVDDFRKAARNAINAGFDGVEIHGGNGYLIEQFLKDSANDRDDGYGGNLENRCRFALEVVDAVAKEVGAHRVGIRLSPFMDYMDCHDSDPHALGLHMATKLNDHGILYLHMIEPRMALVDGRRVVPHRLLPYRESFKGTFIGNGGYDREEGDKAVASGYADLVLFGGLFLGNPDLPKRLELNAPLNKYNRLTFYISDPVVGYTDYPFFP

SEQ ID NO: 5313 - protein, 208 aa, Triticum aestivum
MDQEVKESKPSGEPNLFLQWGSRKRLRCVKSREDGSPSPARSDALRRTIPRVNRPLLGGNVAQFRSPRRPSTLHRRKSEAQASEARQSISLSPEKDRYYSTRGSPFPFEGNGFDFSGGVEEKGTAALPRFFISLSNKEKEEDFLAMKGCKLPQRPKKRPKLTQKCLLTVCPGAWLSDLSHERYEVREKKSSKKRARGLKALCMESDSE

SEQ ID NO: 5314 - protein, 270 aa, Triticum aestivum
  misc_feature (53)..(53): Xaa can be any naturally occurring amino acid
MATISSCSRLCGGGGGSSTAFHRRRSRPARAAVVTCRRFSAVVRAAAAASATXAAPVSVVPQSKEVKLPTWAEFELGKAPVYWKTTNGLPPAPGEGLKIFYNPGTTKLTPNEQVGIAFNGGFNQPIMCGGEPRQMTLQERGKACPPIYTIRIRVPQHAMTLVFSFTNGNEWDGAYTLKFKVPKPWLDKPLSFFNEGLADELNMEGACDRAIFPDENIVITSCDIGGFYEEGGDRCKLDIVSGCMDPTSHMFDPLATIDDGSCPLDSDTEE

SEQ ID NO: 5315 - protein, 268 aa, Triticum aestivum
  misc_feature (51)..(51): Xaa can be any naturally occurring amino acid
MATISSCSRLCGGGSSTAFHRRRSRPARAAVVTCRRFSAVVRAAAAASATXAAPVSVVPQSKEVKLPTWAEFELGKAPVYWKTTNGLPPAPGEGLKIFYNPGTSKLTPNEQFGIAFNGGFNQPIMCGGEPRQMTLQERGKACPPIYTIRIRVPQHAMTLVFSFTNGNTGPGAYTLKFKVPKPWLDKPLSFFNEGLADELNMEGACDRAIFPDENIVITSCDIGGFYEEGGDRCKLDIVSGCMDPTSHMFDPLATIDDGSCPLDSDTEE

SEQ ID NO: 5316 - protein, 370 aa, Triticum aestivum
  misc_feature (230)..(230): Xaa can be any naturally occurring amino acid
  misc_feature (245)..(245): Xaa can be any naturally occurring amino acid
  misc_feature (261)..(261): Xaa can be any naturally occurring amino acid
TTLTLVISPLSPSPFPVSALLHSTVHHTRAAAAGKEHGEMSSGTGKVVCVTGASGYIASWLVKFLLQRGYTVRATVRDTADPKKTLHLQALDGAKDRLHLFKASLLEEGSFDDAVAGCDCVFHTASPFYHNVKDPKAELLDPAVNGTLNALRSCKKASIKRVIVTSSMAAVAYNGKPRTPDVVVDETWFSSAEVCEKNKQWYVLSKTLAEEAAWKYADDNGLEIITIKPXQWVIGPLLQPTLNTXTEAILKFINGSSSTYXNFCFGWINVKDVALAHILAYEVPSANGRYCMVERVIHHSDLVKIIHEMYPEFPVPDKCADDAPFATIYQVSKNKIRSLGMELTPLETSLKETIESLREKGFVTSESSHL

SEQ ID NO: 5317 - protein, 372 aa, Triticum aestivum
PTTRTLLCTQAASFPFLFCLPSPLSAPTPQSTQPRPEEQEDGMSSGTGKVVCVTGASGYIASWLVKFLLQRGYTVRATVRDTADPKKTLHLQALDGAKDRLHLFKASLLEEGTFDDAVAGCDCVFHTASPFYHNVKDPKAELLDPAVNGTLNVLRSCKKASIKRVIVTSSMAAVAYNGKPRTPDVVVDETWFSSAEVCEKNKQWYVLSKTLAEEAAWKYANDNGLEIITINPTMVIGPLLQPTLNTSTEAILKFINGSSSTYANFCFGWINVKDVALAHILAYEVPSANGRYCMVERVIHHSDLVKIIHEMYPEFPVPDKCADDAPFAPIYQVSKDRIRSLGMELTPLETSLKETIESLREKGFVTSESSHL

SEQ ID NO: 5318 - protein, 81 aa, Triticum aestivum
MGGEGASSSGGGFRARIDHYLYSGEKKHVVAGIAIFAAIFGVPWYLMTRGAKHDSHQDYVERANKARSDRLSSGQPSSLKE

SEQ ID NO: 5319 - protein, 212 aa, Triticum aestivum
  misc_feature (86)..(86): Xaa can be any naturally occurring amino acid
MSVTKFIKCVTVGDGAVGKTCMLICYTSNRFPSDYIPTVFDNFSANVSVDGNIVNLGLWDTAGQEDYSRLRPLSYRGADVFVLAFXLISSASYENVLTSGMPELRRFAPNVPIVLVGTKLDLRDHRAYLADHPGASAITTAQGEELRKQIGAAAYIECSSKTQQNVKAVFDTAIKVVLQPPRRREVMAARKKTRRSSGCSIMHLMCGSTCAA

SEQ ID NO: 5320 - protein, 375 aa, Triticum aestivum
  misc_feature (187)..(187): Xaa can be any naturally occurring amino acid
  misc_feature (207)..(207): Xaa can be any naturally occurring amino acid
  misc_feature (286)..(286): Xaa can be any naturally occurring amino acid
MSNAASTTPLLAHYKMGKFDLSHRVVLAPLTRERSFGNVPQPHAILYYQQRATKGGLLIAEATGVSDTAQGYKDTPGIWTKKQVEAWKPIVDGVHAKGGIFFCQIWHVGRVSNHTFQPNGQAPISSTDKPIKPATRADGIGLAKVSTPRRLTTDEIPLVIDDFRVAARNAIEAGFDGVEMHGVHGYXLIDQVLREELKDQVNDRTDXYGGSLENRCRFALEVVQAVVDEVGADKVGIRLSPFANYSEASDSNPEALGLYMAHALNKFGILYCHMVEPRMVNIGEKXETPHSLRPIRDAFKGTFIVAGGYDRDDGNKAIADDYADLVAYGRLFLSNPDLPRRFEIGAPLNKYIRDTFYLSDPVIGYTDYPFLPSDV

SEQ ID NO: 5321 - protein, 329 aa, Triticum aestivum
  misc_feature (73)..(73): Xaa can be any naturally occurring amino acid
MMGGFVSRILLLVFGYAYPAYECYKTVELNKPEIEQLIFWCQYWILVALMTVMERFGDLTISWLPFYSEAKLXFFIYLWYPRTKGTTYIYGTFFKPYISQHENEIDRNLLELRARASDVVVVYVQKVAAVGQNTFFDVLKYVASQSPSQKSKQQRPQEPQQPQQQQSQPQPQVQQQQPQRQAQPVMRRAASIAARQAAMAQQAQETKPVSPKIKRQASAKGGPAASVKPAAAAASTAKPDEKTKKSEAKPAAELVPAPATEAVVPRPEPKAQPAPEAEVSDDMAIDEADVAVEGAEEVDPALEEETVMEETIRVTRAKLRRRAAAEGPA

SEQ ID NO: 5322 - protein, 152 aa, Triticum aestivum
  misc_feature (52)..(52): Xaa can be any naturally occurring amino acid
  misc_feature (59)..(59): Xaa can be any naturally occurring amino acid
  misc_feature (61)..(61): Xaa can be any naturally occurring amino acid
  misc_feature (67)..(67): Xaa can be any naturally occurring amino acid
  misc_feature (72)..(72): Xaa can be any naturally occurring amino acid
  misc_feature (81)..(81): Xaa can be any naturally occurring amino acid
  misc_feature (87)..(88): Xaa can be any naturally occurring amino acid
  misc_feature (95)..(96): Xaa can be any naturally occurring amino acid
  misc_feature (104)..(104): Xaa can be any naturally occurring amino acid
  misc_feature (110)..(110): Xaa can be any naturally occurring amino acid
  misc_feature (115)..(115): Xaa can be any naturally occurring amino acid
  misc_feature (117)..(117): Xaa can be any naturally occurring amino acid
  misc_feature (119)..(120): Xaa can be any naturally occurring amino acid
  misc_feature (126)..(126): Xaa can be any naturally occurring amino acid
ELVSDDLVVGIIDEAMKKPSCQKGFILDGFPRTVVQAQKLDDMLAKQGAKVXDKVLNFXAXDDAILXERITXGRWVHPSSXNSLPYXXAPPENPXXNNVTGNPXIPKERXTLRFXAXVXXFPNANXPVIDYNPMWGKGNHQITLRSKTFKQP

SEQ ID NO: 5323 - protein, 382 aa, Triticum aestivum
  misc_feature (320)..(321): Xaa can be any naturally occurring amino acid
  misc_feature (350)..(350): Xaa can be any naturally occurring amino acid
RSFFSFPLLRRARGADMSSAAPLLEPADGKGGEAKRPCGCPPAWLRRLINTEEAWAQLQFAVPMVLTNMSYYGIPLVSVMFSGHLGDVHLAGATLGNSWATVTGYAFVTGMSGALETLCGQAYGARLYRMLGLYLQSSLIMSAVVSMAIAVLWLFTEPLLLCLRQEPEVSRAAAVFIRYQIPGLFAFSFLQCLLRYLQTQSVVLPLVVCSVVPFVLHVPLNHLLVNVLGFGLAGASAAISTTFWFSCLMLLGYVMWSKEFSETWKGFSTDAFNYVLPTIKLATPSAIMVCLEYWAFELLVLLAGLLPNSTVSTSLIAICXXTQAVSYMITYGFSAAVSTRVSNEVGVVTXGQGKNAVTVTMKLSVFLALSFICPYGMALGEL

SEQ ID NO: 5324 - protein, 847 aa, Triticum aestivum
  misc_feature (694)..(694): Xaa can be any naturally occurring amino acid
MADIEAGGKRATESDTATLIPNSGNLEGSNRATKTCRFKDDDELVEITLDVQRDSASVQAVRPVAAEAAVAAARKRYDRSKSTAAVALKGLQFVTAKVGTDGWAAVEKRFNHLQVDGVLLRSRFGKCIGMDGSDEFAVQMFDALARKRGIVKEVLTKPELKEFWEQLSDQGFDNRLQTFIDMVDKNADGRITVEEVKEIIALSASANKLSKIKERADEYAALIMEELDPKNLGYIELESLESLLLQTPSEAVARSTITHSSKLSKALSMRLAPSKDTSPLRHYWLQFTFFVQENWKRIWVAGLWLSICIALFIWKFIQYRNRAVFNIMGYCVATAKGAAETLKFNMALVLLPVCRNTITWIRSKTKIGAVVPFNDNINFHKVIAAGVAVGVALHAGAHLTCDFPLLLHASDAKYEPMKPFFGDKRPPNYWWFVKGTAGWTGIVMVVLMSIAFVLAQPWFRRNKLKDTNPLKKMTGFNAFWFTHHLFAIVYALLIVHGTSLYLTKEWYKKSTWMYIAYPVFLYSCERIVRLFRRHDSVKIQKVAVYPGNVLALYMSKPPGFKYRSGQYIFINCGAVSPYEWHPFSVTSAPGDNYLSVHIRTRGDWTSRLRTVFSEACRPPTEGESGLLRADLSVGITDSNARFPKLLIDGPYGAPAQDYREYDVLLLIGLGIGATPLISIVKDVLNHIQPGGSVXEQSRGAPGKAKKRQFMTKRAYFYWVTREEGSFEWFRGVMNEVAEKDKDQVIELHNHCSSVYQEGDARSALIVMLQELQHAKKGVDILSGTSVKTHFARPNWRSVFKRVAVNHENQRVGVFYCGEPVLVPQLRQLSADFTHKTNTKFEFHKENF

SEQ ID NO: 5325 - protein, 332 aa, Triticum aestivum
  misc_feature (309)..(309): Xaa can be any naturally occurring amino acid
VKEIIALSASANKLSKIKERADEYAALIMEELDPKNLGYIELESLESLLLQTPSEAVARSTITHSSKLSKALSMRLAPSKDTSPLRHYWLQFTFFVEENWKRIWVAALWISICIALFVWKFIQYRNRAVFNIMGYCVATAKGAAETLKFNMALVLFPVCRNTITWIRSKTKIGAVVPFNDNINFHKVIAAGVAVGVVLHAGAHLTCDFPLLLHASDAKYEPMKPFFGETRPPNYWWFVKGTAGWTGIVMVVLMSISFVLAQPWFRRNKLKDSNPLKKMTGFNAFWFTHHLFAIVYALLIVHGTSLYLTXEWVQKTTWMYIAYPVFYIMRAHR

SEQ ID NO: 5326 - protein, 361 aa, Triticum aestivum
MGLDYYKILGVDKAASDDDLKKAYRKLAMKWHPDKNPTNKKEAESKFKQISEAYEVLSDSQKRAVYDQYGEEGLKGQVPPPGAGGGAGGPAGATFFSTGADGPTAFRFNPRNAEDIFAEFFGSSSPFGGMGGMGGGGHGMPSGGIRFSPSMFGGGGDHTFTQTFGGGGQGYPGMFGGGAPVKAAPIERKLPCSLEELYKGTTKKMKISREIADASGKTIPVEEILTIDVKPGWKKGTKITFPEKGNEQPHTIAADLVFIIDEKPHPVYTRDGNDLVATQKIPLAEALTGYTVHLTTLDGRSLTVPISSVIHPGYEEVVRGEGMPIPKDPSRKGNLRVKFDIKFPARLTADQKSGVKRLLGQ

SEQ ID NO: 5327 - protein, 87 aa, Triticum aestivum
ILQAISHVIALFLLPMHFRTHIALLFIEAVWTANIHDCIHGKIWPVMGAGYHTIHHTTYRHNYGHYTVWMDWLFGTLREPEDLLKKD

SEQ ID NO: 5328 - protein, 278 aa, Triticum aestivum
MAAAAAEQDYWGLFREETGWYNEIFLSAVVPGGGGWWRALPHPLRSWLRNCIGGYLLYFATGFLWCFVIYYWKRNAYIPKDAVPTVEAMKKQIIVASKAMPFYCALPSVSEHMIESGWTRCFFHISEVGWPMYIIYVSLYLIFVEFGIYWMHRELHDIKPLYKHLHATHHIYNKENTLSPFAGLAFHPLDGILQAISHVIALFLLPMHFRTHIALLFIEAVWTANIHDCIHGKIWPVMGAGYHTIHHTTYRHNYGHYTVWMDWLFGTLREPEDLLKKD

SEQ ID NO: 5329 - protein, 155 aa, Triticum aestivum
GDDSTITVDDNCVDPLYKHVFPIEVAPDLSFIGVPWKVIPFPLVELQSKWVAGILSGRIKLPSKDEMMEDVKAIYSRLETRGWPKRYTHNFSGGYQFEYDDWLAEQCGHPPVEEWRKLMYAANAKNKAARPERYRDEWDDDGLVALANEDFKKYF

SEQ ID NO: 5330 - protein, 124 aa, Triticum aestivum
  misc_feature (24)..(24): Xaa can be any naturally occurring amino acid
  misc_feature (50)..(50): Xaa can be any naturally occurring amino acid
PWKDLPLLQLVELQGKWVDGISIXGGIKLPSEDEMMEDGQSTYTRRLETXDWPKRYTHNFSGGYQFEYVDWLAEQCGHPPIEEWRKLMYAGNAKNKAARPERYRDEWDDDGLVALANEDFKKYF

SEQ ID NO: 5331 - protein, 124 aa, Triticum aestivum
MEVTGKVCIYQLLGYKSKWVAGILSGRIKLPSKDEMMEDVKAIYSRLETRGWPKRYTHNFSGGYQFEYDDWLAEQCGHPPVEEWRKLMYAANAKNKAARPERYRDEWDDDGLVALANEDFKKYF

SEQ ID NO: 5332 - protein, 172 aa, Triticum aestivum
LADRLSRHYPDSARIMCAQFSAFMGIPFSWILLTVIPQSTDYWLAYAITLFLMGITISWCATSANNPMFAEVVPPKHRTMIYAFDRAFEGSFASLAAPAVGLVTEKIYGYDAKTVNIANGSAQGAYALSRGLLTMMILPFGICVLFYSPLYLVFKHDRDNAKVARFKGQELT

SEQ ID NO: 5333 - protein, 270 aa, Triticum aestivum
  misc_feature (97)..(97): Xaa can be any naturally occurring amino acid
  misc_feature (109)..(109): Xaa can be any naturally occurring amino acid
MWNFGDDDTHERSRLVGNSVFPPLSIWKDSWITARSVMKVRTFQIIVLQGIVGSLPWTAVVFFTMWFELIGFDNKSSAGLNSLFAIGCASGSFLGGXIADRVSRHYPDXGRIMCAQFSAFMGIPFTWILLTVIPQSVDYWYSYAVTLFLMGLTISWCATCANNPMFAEVVPPKHRTMIYAFDRAFEGSFSSLAAPAVGMVTEKVYGYNSKTVNLADGSVAGAYALSRGLLTMMIVPFGLCCLFYTPLYFVFKRDRENARLAASAKDLELM

SEQ ID NO: 5334 - protein, 133 aa, Triticum aestivum
  misc_feature (40)..(40): Xaa can be any naturally occurring amino acid
  misc_feature (56)..(56): Xaa can be any naturally occurring amino acid
GKNSVHLFLRGLPKRWGPTWRNKPEVEEGVLPSHRTIIYXLDGGFEGSFLSLAAPXVGIVTKEVYGYNRKTVTWRTGQWQGHTHSQEGSCRIGTRMIVPFGLCCLFYTPLYFVFKRDRENARLAASAKDLELM

SEQ ID NO: 5335 - protein, 317 aa, Triticum aestivum
  misc_feature (32)..(32): Xaa can be any naturally occurring amino acid
  misc_feature (179)..(179): Xaa can be any naturally occurring amino acid
MELRTLGGTGLRVSPVGFGASPLGSVRRDVPXDVARATVRRALDLGINFFDTSPYYGGTVSESVLGDCLRFAGVPRDSFVVATKCGRYKEGFDFSAARVTRSIDESLARLGLDYVDILHCHDIEFTSLDQIVNETIPALQKIKESGKARFIGITGLPLSIFTYVLDRVPPGSVDLVLSXYCHYGINDTALVDLLPYLKSKGVGVISASPLAMGLLTDNGPPEWHPAPEELKLACRTAADHCRKKGKHITKLAMKYSLMNNEISTVLVGMNSPEQVEENVAAAVELSTLGIDEELLHEVEAILKPVKNLTWPSGIQQA

SEQ ID NO: 5336 - protein, 259 aa, Triticum aestivum
TSFCDGPADGTNLTGVRGSRLRPAGSTLLRLPWSTREEMVIADMQIRPGEAWEYCPRYALRKVTKVLLDEFNVTMKAGFENEFYLRRKLVSEGHERWVPYDNSSYCSTSSFDGASSILQEVYSSLKVANIVVEQLHAEAGKGQFEVALKYVLCTLAADNLIYAREIIKSVARKHGLIATFLPKPDLNDIGSGSHVHLSLWKNDQNVFMGSNEYSHYGMSNVGEQFLAGVYHHLPSILAFTAPHPNSYDRIQPNTWSGSL

SEQ ID NO: 5337 - protein, 177 aa, Triticum aestivum
MDSGSDSDGAPEELTAVQGVEKHEEISKVEKDSAVRATQEEKDRRKRWAQRKTSSKPNKKKPLKVEDKDTEVDEETHAMPGTLPKSVIEMLAAREKQTFSSDSEEENVNQNVQKKKKRLKTATTGPETILLKDVRSTEHIKKALEFLSRRKNQVPRSNAVLKNPNAMRLFNKHNFTS

SEQ ID NO: 5338 - protein, 169 aa, Triticum aestivum
  misc_feature (16)..(16): Xaa can be any naturally occurring amino acid
SGITSNEQPKMKALKXAEKTRDAILSGKLNQVRINLPNVTMVGHTGDIEATVVACKAADEAVKMVLDAVEQVGGIYLVTADHGNAEDMVKRNKAGEPMLDKSGSIQILTSHTLQPVPVAIGGPGLHPGVRFRSEIQTPGLAKVAATVMNLHGFQAPADYETTLIEVVDK

SEQ ID NO: 5339 - protein, 212 aa, Triticum aestivum
MALVGQAAMVAQFAGVDAYGLIKMIADAAQTVRRNRATCLQLARRAKMIGDLLHQLHAAQLMQQPETRNPIEQLEETLRRALLLVRSCQGRGYLYRCFMGARHADELREVQGEITFYLQLFPLVSYVDTTLTWVRLLNKAAAPQPPSCKEAPVVRPYFVPDEWFLLVSYSGSIPWHCIHMVYILLFFLISINHPSGKIYPGMYLQELKLLCN

SEQ ID NO: 5340 - protein, 157 aa, Triticum aestivum
  misc_feature (30)..(30): Xaa can be any naturally occurring amino acid
  misc_feature (60)..(60): Xaa can be any naturally occurring amino acid
  misc_feature (77)..(77): Xaa can be any naturally occurring amino acid
  misc_feature (104)..(104): Xaa can be any naturally occurring amino acid
  misc_feature (112)..(112): Xaa can be any naturally occurring amino acid
RPLKLLGELGINPHWKFNQVLINLPNGNMXGHTGDIEATVGAAKPADEPVKMVLDAVEQXGGIYLVTADHGNAEDMXKRNKAGQPMLDKSGSIQILTSHTLQPXPVAIGGPXLHPGVRFRSDIQTPGLANVAATVMNLHGFQAPADYETTLIEVIDK

SEQ ID NO: 5341 - protein, 183 aa, Triticum aestivum
  misc_feature (8)..(8): Xaa can be any naturally occurring amino acid
  misc_feature (56)..(56): Xaa can be any naturally occurring amino acid
  misc_feature (69)..(69): Xaa can be any naturally occurring amino acid
  misc_feature (92)..(92): Xaa can be any naturally occurring amino acid
FDQTREEXVEIPSDSGITFHEQPKMEALEMLKKTRDAILSGKFDQVRINLPNGDMXGHTGDIEPTVLLXKPADEAVKMVLDAVEQVGGIYLXTADHGNAEDMVKRNKAGEPMLDKSGSIQILTSHTLQPVPVAIGGPGLHPGVRFRSDIQTPGLANVAATVMNLHGFQAPADYETTLIEVVDK

SEQ ID NO: 5342 - protein, 481 aa, Triticum aestivum
MASTAAPPAAIVARRAASASVAAAPLRRAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGKELPGVVALDEGVMTRSVSV

SEQ ID NO: 5343 - protein, 560 aa, Triticum aestivum
  misc_feature (415)..(415): Xaa can be any naturally occurring amino acid
  misc_feature (423)..(423): Xaa can be any naturally occurring amino acid
  misc_feature (446)..(446): Xaa can be any naturally occurring amino acid
  misc_feature (456)..(457): Xaa can be any naturally occurring amino acid
  misc_feature (528)..(528): Xaa can be any naturally occurring amino acid
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERRGKIIRLHILTDGRDVLDGSSVGFVETIENDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSXGKFDQVRXNLPNGNMVGHTGDIEATVVACKXAADEAVKMAXXNAVEHVGGIYLVTADHGNAEDMVKRNKAGQPMLDKSGSIQILTSHTLQPVPVAIGGPGLHPGVRFRSEIQXPGLAKVAATVMNLHGFQAPADYETTLIEVVEK

SEQ ID NO: 5344 - protein, 190 aa, Triticum aestivum
  misc_feature (12)..(12): Xaa can be any naturally occurring amino acid
  misc_feature (23)..(23): Xaa can be any naturally occurring amino acid
  misc_feature (35)..(35): Xaa can be any naturally occurring amino acid
  misc_feature (49)..(49): Xaa can be any naturally occurring amino acid
  misc_feature (66)..(66): Xaa can be any naturally occurring amino acid
SSGYFDETRGEXVEFPSDSGITXNDQPKMKALEIXAERPRDAILSGEVXDRVRINLPNGDMVGHTXGDIEATGVACKAADEAVKMVLDAVEQVGGIYLVTADHGNAEDMVKRNKAGQPMLDKSGNIQILTSHTLQPVPVAIGGPGLHPGVRFRSDIQTPGLANVAATVMNLHGFQAPADYETTLIEVIDK

SEQ ID NO: 5345 - protein, 171 aa, Triticum aestivum
  misc_feature (18)..(18): Xaa can be any naturally occurring amino acid
  misc_feature (30)..(30): Xaa can be any naturally occurring amino acid
SDSGITFNEQPKMKALEXAERTRDAILSGXLTRVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 5346 - protein, 410 aa, Triticum aestivum
MATVNPFDLLGDDEGDDPTQLLAKAAALAQKAEAKKAAAPPAAGKGGARTVANLPTKPPPPGQAANESRGGGPLSRGGYGRGERGSGRGGRGGYGQNRDYASEDTNGYRGGYGARTGGEEGAHDRERAPRQPYQGGGRRGGYREGEFGDDSARPPRRNYERQSGTGRGYEIKREGAGRGNWGTTSDEFVARETEALKQDEKAPAPEKQGAPEDAPQADENKATKDGAAVVEEEKEEDNEMTLDEFEKVMEEKRKALAALKKSEERKVEIDKDLQAMQLLSTKKGNDEVFIKLGADKEALKKKENAEREERAKKSVSINEFLKPAEGERFYGGRGRGGRGRGDRGGFRGGFGGGGYHGPPPAPAIQDQNQFPTPRWEVRLLYHLKCHLYQYRRRCQVKIFLSPYISARILY

SEQ ID NO: 5347 - protein, 553 aa, Triticum aestivum
  misc_feature (335)..(335): Xaa can be any naturally occurring amino acid
  misc_feature (406)..(406): Xaa can be any naturally occurring amino acid
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIENDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKHLVSPRXLSGHLVEYSSYAANACPAPLPYGRPAGGRTSDSNTTHYRARAAARAGSDSGITFNEQPKMRALEIAERTRXAILSGKVDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 5348 - protein, 522 aa, Triticum aestivum
  misc_feature (160)..(160): Xaa can be any naturally occurring amino acid
  misc_feature (326)..(326): Xaa can be any naturally occurring amino acid
  misc_feature (410)..(410): Xaa can be any naturally occurring amino acid
MVDLQAAALVISVVAAEVGGASPDQYNCIHLAQTPVTDSLKNGAPDKWRLVKAHGTAVGLPNDDDMGYSEFGHNALGAGRIFAQGAKLVDAALASGKIWEDEGFNYIKESFDKGTLHLIGLLSDGGVHSRLDQVQLIVKGASERGAKRIRLHILTDGRDXLDGSSVGFVETIENDLAQLREQGVDARIASGGGRMYVTMDRYENDWSVVKRRGRDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPXLERTSGEYWVKNGVRTFACSETVKFGHVTFFWNGNRSGYFDETREEYVEIPSDSGITFNEQPKMKALEIAERTRDAILSGKFDXVRINLPNGDMVGHTGDIEATVVACKAADEAVKMVLDAVEQVGGIYLVTADHGNAEDPLKRNKAGQPMLDKSGSIQILTSHTLQPVPVAIGGPGLHPGVRFRSDIQTPRPRPR

SEQ ID NO: 5349 - protein, 557 aa, Triticum aestivum
  misc_feature (290)..(290): Xaa can be any naturally occurring amino acid
  misc_feature (327)..(327): Xaa can be any naturally occurring amino acid
  misc_feature (333)..(333): Xaa can be any naturally occurring amino acid
  misc_feature (418)..(418): Xaa can be any naturally occurring amino acid
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIENDLAQLREQGVDARIASGGGRMYVTMDRYENDWSVVKRGWDAQVLGEAPHNFQNALILEQVCTKKQAWYRSGIPGISSTHASAHASGDAVVTFNFRADRMVMLAKAXSGFLNFDKFARGSCTQKLSTLGWLQYDGEVKLPSKYXLVSPPXLKRTSGEYLVKNGVRTFACSETVKFGHVTFFWNGNRSGYFDETREEYVEIPSDSGITFNEQPKMKALEIAERTRDAILSGKFDQXVRINLPNGDMVGHTGDIEGYSCCFARPADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 5350 - protein, 577 aa, Triticum aestivum
  misc_feature (327)..(327): Xaa can be any naturally occurring amino acid
  misc_feature (335)..(335): Xaa can be any naturally occurring amino acid
  misc_feature (366)..(366): Xaa can be any naturally occurring amino acid
  misc_feature (379)..(379): Xaa can be any naturally occurring amino acid
MATTNWTLPDHPTLPKGKTVAVVVLDGWGEASPDQYNCIHVAQTPVTDSLKNGAPEKWRLVKAHGTAVGLPSDDDMGNSEVGHNALGAGRIFAQGAKLVDAALASGKIWEDEGFNYIRESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGEAPYKFPNALEAVKTLRAEPKANDQYLPPFVIVDESGKSVGPIVDGDAVVTFNFRADRMVMLAKALEFPDFDKFDRVRVPKIKYAGMPQYDGELKLPXKYLVSPPXLRRTSGEYLVKNGVRTFACSETVKFGHVTFXFWGGRQGVFQLKXVYKTGGAGVFLSHSLLGGFGAEGGMFPAPIGAGFFLRLIIGPLDLLGGLGGVSSVGSFFRGGFNLPNGEMVGDTGDIEGTVFVSKASDEAVKMVLDAVEQVGGIYLVAADHGNAEDMVKRNKAGQPMLDKTGSIQILTSHTLQPVPVAIGGPGLHPGVRFRSDIQTPGLANVAATVMNLPGFQAPADYETTLIEVVDK

SEQ ID NO: 5351 - protein, 118 aa, Triticum aestivum
  misc_feature (83)..(83): Xaa can be any naturally occurring amino acid
  misc_feature (95)..(96): Xaa can be any naturally occurring amino acid
  misc_feature (100)..(100): Xaa can be any naturally occurring amino acid
  misc_feature (103)..(103): Xaa can be any naturally occurring amino acid
  misc_feature (115)..(115): Xaa can be any naturally occurring amino acid
YWASEGIGNKDMVVLPYKDSLLLLSRYLQQLVMESLGKEFDLDGNRVNQGLSVYGNKGSTDQHAYIQAAGEKVYTTLCYFYPXPCRYRPAGHDWXXEPGXTCXGDICLGCLPGTXPVL

SEQ ID NO: 5352 - protein, 595 aa, Triticum aestivum
MVDLQAAALVISVVAAEVPLSEKFFLFRKPHEEKKAKEMATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGEAPYKFPNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVIDK

SEQ ID NO: 5353 - protein, 167 aa, Triticum aestivum
MEYQGQQHGQATNRVDEYGNPVAGHGAGTGMGAHGGVGTGTGAAAGGHFEPTREEHKAGGILQRSGSSSSSSSEDDGMGGRRKKGIKDKIKEKLPGGHGDQQHADGTYGQQGTGMAGTGAHGTTATGGTYGQPGQTGMTGTGTHGTDGTGEKKGIMDKIKEKLPGQH

SEQ ID NO: 5354 - protein, 139 aa, Triticum aestivum
KLVKSLYEGDYKTFFGALGEVETNFLSQDRYMYEHRGWYVREMRLRGYQQLLQSYRVVGLESMAKDFGVTVDFLDKDLARFIAADRIPCTIDRVKGIIETNRPDDKNKQYADVVKQGDQLITKLQKYGQAVRLRGSERG

SEQ ID NO: 5355 - protein, 301 aa, Triticum aestivum
MLPYATAGEAEAALGRALTWAEAAWLRYSASVPDRYLHWPNIAITLVVYTLAPLPLALFDLAAPAAAAPYKLQPKVQHPPATFFRCYMDAVRVSLLIIGPYQLISYPAAKIMDIRTGLPLPSMGEIMAQLTVYFLVEDYLNYWLHRLLHTKWGYEKIHHVHHEFTAPMAYAAWYGHWAEMLILAVPSLAGPALVPCHVTTLWIWFAARLVESLNIHSGFKLPFNAEKYIPFYGGAEHHDYHHYIGGQSKSNFAPVFTYCDYIYGTDKGYRYHKATLAKLKELAGSDVQKGADNGFNGGKQD

SEQ ID NO: 5356 - protein, 417 aa, Triticum aestivum
WPFLLGVYSLNSSEAEREAIKAHNRKGYLLWCFRCLRRTCKVSVDDHITSEEENPCVISEQEMQDKTGKAIPENQADESLCSSSSRDEDESEKSDVTDVEASRDDVASVDQSSVEDEEESMPLPKYSNTGGNIETETKLSKVARPVKSARTVEDFETWQRIIRLDAVRANNEWVSYSPSQAAVTREKAIESASSVCLKDYEHLEAHRIHHASRLVAILEAYATYDPEIGYCQGMSDLLAPLLAVLEEDDEAFWCFAGFMRKARHNFRLDEVGIRRQLNMVSKIIKTKDFHLYVRLEMLEAADCFFVYRMVVVMFRRELTFEQTLSLWEAMWADQAARRAGITRSSWRKLQLGAPPTDDLLLYAIAASVLEKRKLIIESYSSMDEIIRDCNSMAGQLDIWKLLDDAHDLVVTVQDRIE

SEQ ID NO: 5357 - protein, 73 aa, Triticum aestivum
MIEVVLNDRLGKKVRVKCNEDDTIGDLKKLVAAQTGTRPEKIRIQKWYTIYKDHITLGDYEIHDGMGLELYYN

SEQ ID NO: 5358 - protein, 100 aa, Triticum aestivum
  misc_feature (69)..(69): Xaa can be any naturally occurring amino acid
MIEVVLNDRLGKKVRVKCNEDDTIGDLKKLVAAQTGTRAEKIRIQKWYTIYKDHITLGDYEDSTTDGLXLYYNLITPALQFRQLTLPVITVSNPNFKQFG

SEQ ID NO: 5359 - protein, 97 aa, Triticum aestivum
  misc_feature (10)..(10): Xaa can be any naturally occurring amino acid
  misc_feature (18)..(18): Xaa can be any naturally occurring amino acid
  misc_feature (32)..(32): Xaa can be any naturally occurring amino acid
  misc_feature (36)..(36): Xaa can be any naturally occurring amino acid
  misc_feature (62)..(62): Xaa can be any naturally occurring amino acid
VTQVADFTCXHWPFYNYXQLRSHSHVHLLDDXKELXWSNTSECTTETTAIIIGKDLPFDAYXKVIVDIEVFYRSKAKVETFNNLTRDCKDGINTCNL

SEQ ID NO: 5360 - protein, 509 aa, Triticum aestivum
MDTAALLPVALALMAIPVTALLLSRLRFGRLPPGPRPWPVLGNLFQIQPVRCRCFAEWAARYGPIMTVWFGSTPMVVVSTPELAQEVLRTHDQHLADRSRNRSSERFSRGGMDLIWADYGPHYIKVRKLCNLELFTPRRLEALRPVREDEVTAMVESVHAAGKGGRPVAVREFLAMVGFNNITRLAFGKRFLTAAGELDEQGREFKEIVNNGIKIGASLSIAEHIRWLRWLTPVDEVAYQAHGDRRDRLTVKIMEEHASALERSGASKQHFVDALFTLRDKYDLSDDTVIGLLWDMITAGTDTTVITVEWAVAELVRNPTVQHKVQEELDRVVGRDRVLSETDFPNLPYLQAIVKESLRLHPPTPLMLPHRASAAVKVAGYDIPKGASVTVNVWAIARDPEAWDSPLEFRPERFLHDNIDIKGCDYRVLPFGAGRRVCPGAQLGINLVASMIGHLLHHFTWALPDGTRPEDIDMMESPGLITFMRTPLQVVATPRLEKEELYKRVAAEM

SEQ ID NO: 5361 - protein, 559 aa, Triticum aestivum
MGNACGGSLRSKYLHSFKHPASQRHDPDRDYDHNTAADSPKKPGSQPTAAAAAAAKTDGHAAPAQPAAAMRRGGAGAPADLGSVLGHPTPNLRDLYALGRKLGQGQFGTTYLCTELATGADYACKSISKRKLITKEDIDDVRREIQIMHHLSGHPNVVAIKGAYEDQLYVHIVMELCAGGELFDRIIQRGHYSERKAAELTRIIVGVVEACHSLGVMHRDLKPENFLLANKDDDLSLKAIDFGLSVFFKPGQIFTDVVGSPYYVAPEVLCKKYGPEADVWTAGVILYILLSGVPPFWAETQQGIFDAVLKGVIDFDSEPWPVISDSAKDLITRMLNPRPAERLTAHEVLCHPWIRDQGVAPDRPLDTAVLSRIKQFSAMNKLKKMALRVIAESLSEEEIAGLKEMFQTMDADNSGAITYDELKEGLRKYGSTLKDTEIRDLMDAADVDNSGTIDYIEFIAATLHLNKLEREEHLVAAFSYFDKDGSGYITVDELQQACQEHNMPDAFLDDVIKEADQDNDGRIDYGEFVAMMTKGNMGVGRRTMRNSLNISMRDAPGAI

SEQ ID NO: 5362 - protein, 439 aa, Triticum aestivum
  misc_feature (198)..(198): Xaa can be any naturally occurring amino acid
MVEQVCTKKQAGTGPEFPGYRRPTRPTNLRAEQSRSRVAAATMDVASLLPFAIALVAIPISLALLDRLRLGRLPPGPRPWPVVGNLRQIKPVRCRCFHEWAARYGPIISVWFGSSLTVVVSTSELAKEVLKEHDQQLADRPRNRSTQRFSRNGQDLIWADYGPLYIKVRKLCNLELFTLNRLEALRPIREDEVTAMVXSVHRAGAGPGNEGKPLVVRNHLAMVSFNNITRLAFGKRFMNADGDIDEEGQEFKLIVNNGIKIGASLSVAEYIWYLRWLCPLNEELYNTHNERRDRLTKKIIEEHAQALRESGAKQHFVDALFTLREKYDLSDDTVFGLLWDMITAGMDTTVISVEWAMAELVRNPRVQKKLQEELDSVVGRDRVMSETDFQNLPYLMAVVKESLRLHPPTPFMLPHKASASVKVGGYSIPKGANLMGCVW

SEQ ID NO: 5363 - protein, 339 aa, Triticum aestivum
TRPSLFYKEVDLLQPIPFDKVFDFTKFNARCHGFARLARYSEVSNHTEPYKLQKGSGRRWTVERDLDQLQQSKTGEADGYQVIHVTGKHPFLWPDHWPVKNYAKVFDCLALAPDIEAEVVKVISKIKDAGEKARHEAAISHKKKSIDDGSLNLPVQYIAVHMRIEKDWMIHCKKWEKRSNLKEICSSKGEIIHKVSQITDLRRPVVVYLAVADSLLEDDSVTSGWRVGMIAYEKKKLGVTDIYKRQPYLIKSAIDFEVCARADVFVGNSFSTFSNLVVLSRTERMFKLGVESSCGEDVGLSSYAYNVIGDDGGPQRWMTDMLDTSLQRISYGTNNISCH

SEQ ID NO: 5364 - protein, 173 aa, Triticum aestivum
MANDSLTRAQIVGDVLDPFVSSVPLTVMYDGRPVFNGMEFRSPAVSLKPSVEIGGDDFRVAYTLVMVDPDAPNPSNPTLREYLHWMVTDVPSSTNDSFGKEIVPYESPSPTMGIHRMVLVLYQQLGRGTVFAPQARQSFNSRSFARRFNLGKPVAAVYFNCQRPTGTGGRRFT

SEQ ID NO: 5365 - protein, 80 aa, Triticum aestivum
LLTAACGQQCRMRFAGWYLKIAVGGAAIGAAMELFMIHTGFYEKVTVLESEKRAWESSPEAQAMREALNPWHKRDEQEKK

SEQ ID NO: 5366 - protein, 306 aa, Triticum aestivum
TRRPRVAQRRPRVGTPSDLGGGKGRAGSDEDEDSDDDEWAPPPELYTGGERSGMVVRDRSKRKNVADEVFKQAKRKGAKQGPARRQSSSSRSFPGTSRLLTGETVQPDAPQPPEEIVHNIYFWSDGFTVDDGPLRSFNDPEHASFLESIMKSECPTELAPADGMSKVNVNLIRKEEKCPESVKRPAPFQGGGRILAAPSENSAPSGITPAAAASSTATTTAPKTITVDDSLPSTSLQIRFADGSRVVGRFNTSHTISDVRAFIDTTRPGETSDYTLQVGFPPKPLDDATKTIEEAGVANSVIIQRV

SEQ ID NO: 5367 - protein, 60 aa, Triticum aestivum
  misc_feature (55)..(55): Xaa can be any naturally occurring amino acid
MYLVKDIGGAICLMAAALVLLGTWPVVLAVLERRGRLPQHTYLDYSITNFLAAVXIALTF

SEQ ID NO: 5368 - protein, 52 aa, Triticum aestivum
  misc_feature (29)..(30): Xaa can be any naturally occurring amino acid
  misc_feature (33)..(33): Xaa can be any naturally occurring amino acid
  misc_feature (39)..(39): Xaa can be any naturally occurring amino acid
MYLVKDIGGAIGLMAAALVLLGTWPVVLXXLEXRGRLPXHTYLDYSITNFLA

SEQ ID NO: 5369 - protein, 113 aa, Triticum aestivum
MYLVKDIGGAIGLMAAALVLLGTWPVVLAVLERRGRLPQHTYLDYSITNFLAAVLIALTFGQIGGDTPETPNFLTQLTRPQDYWPSIMFALAGGVVITLGTVDTQYGWAYVGL

SEQ ID NO: 5370 - protein, 127 aa, Triticum aestivum
MRVLPHPSTEAQTGEKKKKRRRRKMPCLNVSTNVNLEGVDTSAVLADASSTVATIIGKPENYVMVVLKGSVPMAFGGTQEPAAYGELVSILESKLSIPKSRFYLKFHDSKAHPAQEHAQCLHALHQE

SEQ ID NO: 5371 - protein, 120 aa, Triticum aestivum
  misc_feature (97)..(97): Xaa can be any naturally occurring amino acid
  misc_feature (107)..(107): Xaa can be any naturally occurring amino acid
IIFSSFQPDAAQLMRKLQSTYPVSAILLPDRASTWNLYPFHTMSVTDRHRYDVCQVYFLTNGGTEVYADVRRNSLEEAVKLCLASGMQGIVSEARAXFKFPTAIPKXKGGRLSLLTYGTL

SEQ ID NO: 5372 - protein, 214 aa, Triticum aestivum
  misc_feature (33)..(33): Xaa can be any naturally occurring amino acid
  misc_feature (111)..(111): Xaa can be any naturally occurring amino acid
  misc_feature (142)..(142): Xaa can be any naturally occurring amino acid
  misc_feature (159)..(159): Xaa can be any naturally occurring amino acid
  misc_feature (178)..(178): Xaa can be any naturally occurring amino acid
  misc_feature (203)..(203): Xaa can be any naturally occurring amino acid
AEPGKLSHPDLAASLLLEDDDDVPPLPSYSSKXSAGSTTAACLHYLVSELRMPLYLQRRLTIPDIAAHRWSRPCAVAFAALAPVLLATAWTSHNPAKSSSHHAATTTATAXAILLVDGVLGLLLAALTAATTDTASPPNGRXVPWLAVEFLMSVLWGSXAYTLARELVALLVAIGYRXMVGMKASMLGVTVLACGDSLGDLVXNVAMATHRGPD

SEQ ID NO: 5373 - protein, 283 aa, Triticum aestivum
  misc_feature (86)..(86): Xaa can be any naturally occurring amino acid
MSVVSLLGVNVLQNPARFGDPYEFEITFECLETLQKDLEWKLTYVGSATSNDHDQELDSLLVGPIPVGVNKFIFVADPPDTNKIPXAEILGVTVILLTCAYDGREFFRVGYYVNNEYDSDELNTDPPAKPILEKVRRNILAEKPRVTRFAIKWDSDDSAPPLYPPEQPEADLVADGEEYGAEEAEDEDEEESADGPEVPADPDVMIDDSEAAGAMVETVKATEEESDAGSEDLEAESSGSEEDEIEEDEEREDEPEEAMDLDGAGKRNAAISSSNNTDTTMAH

SEQ ID NO: 5374 - protein, 442 aa, Triticum aestivum
MAIAVSGHWTRLRTLGCGASGAVVSLAADGASGELFAVKSVRAADAAQLSREQGILSGLSSPHVVACIGGGGARDGSYHLFLEFAPGGSLADEAARNGGRLEERAVRAHATDVLRGLAYIHGKSLVHGDVKSRNVVIGADGRAKIADFGCARALGEARPIGGTPAFMAPEVARGEEQGPAADVWALGCTVVEMATGRAPWGEMDNVLAAVHRIGYTDAVPEVPTWLSAEAKSFLAMCFARDARERCTAAELLEHPFVALQAGEAKARWVSPKSTLDAAFWESETDEEEEEVSESPCERIKSLSCSVLPDWDSDEGWIDVLGEQCEEACDSPAATKGPADVSSRAPSKVLGSPAAPAEDAAVVGTLSSDELDAEDEPFGDDIILAADPLVDRQIQVCWSSDRYVLSSSLVPCNNRIDAIEKFRFPQKKKKKKKKKKKKKKKKK

SEQ ID NO: 5375 - protein, 236 aa, Triticum aestivum
HPFRFHLLLVRSSPSASGHSRHGHRSARRRRRRAPGAAGPLAETPVPLRLPRAAPLGSAAPSAAWRGGPSPPALPGAPRAAGDRAPTEMAPLFPGCDYEHWLIVMDKPGGEGATKQQMIDCYIQTLAKVVGSEEEAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQAYQR

SEQ ID NO: 5376 - protein, 163 aa, Triticum aestivum
  misc_feature (40)..(40): Xaa can be any naturally occurring amino acid
TRRHDRGCPEHPAPRLAPLFPGWTKKHWLIVMDKPGGEGXPKHQMIDCYIQTLPKVLGTEEDAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQAYQR

SEQ ID NO: 5377 - protein, 498 aa, Triticum aestivum
MGQRLLLLVTTCLWALSCAVPHHASSLDGLLRINLNKRSLTYESLAAAKAARQHGALRLKSSDLDSDIVPLVDYLNTQYYGVIGLGTPPQNFTVIFDTGSSNLWVPSSKCYFSIACYLHAKYKSSKSSTYKADGETCKITYGSGAISGFFSNDNVLVGDLVVKNQKFIETTRETSVSFIVGKFDGILGLGYPDISVGEAPPVWLSMQEQKLLADDVFSFWLNRDSDALSGGELVFGGMDPDHYKENHTYVPVSRKGYWQFNMGDLLIDGHSTGFCAKGCAAIVDSGTSLLAGPTAIVAQVNHAIGAEGIISMECKEVVSQYGEIILELLIAQTQPQKVCSQIGLCLFDGTHSVSNGIESVVGKENVGSDVMCTACEMAVVWIENQLRENKTKELILQYANQLCERLPSPNGESTVSCHEMSKMPNLAFTIANKTFVLTPEQYVVKLEQSGQTVCISGFMAFDIPPPRGPLWILGDVFMGTYHTVFDFGKDRIGFAESA

SEQ ID NO: 5378 - protein, 139 aa, Triticum aestivum
  misc_feature (28)..(28): Xaa can be any naturally occurring amino acid
  misc_feature (38)..(38): Xaa can be any naturally occurring amino acid
  misc_feature (66)..(66): Xaa can be any naturally occurring amino acid
  misc_feature (83)..(83): Xaa can be any naturally occurring amino acid
  misc_feature (97)..(97): Xaa can be any naturally occurring amino acid
NCKTFTAVEPIPGLLEWRIIYVGSAKNXEYDQVLEEFXIGPVQEEATMKFTVECPPPDFTRIPRDXLICVTAIIITVSYRAQXFIRVGYYVHNVLNXTLPEEERPNAEPATLIAHTRRTILTDKPRITKFRINWGEHRE

SEQ ID NO: 5379 - protein, 345 aa, Triticum aestivum
MEATAPSVGAGANGSLAAAARAQVGPPTNPMATALLTDQYQFSMAYAYWKAGKHADHAVFDLYFRKNPFGGEFTVFAGLEECIKFIANFKFTEDEISFLQSVMPMCEDAFFDYLRGIDCSDVEVYSIPEGSVVFPKVPLMRVEGPVAVVQLLETPFVNLINYASLVTTNAARHRHVAGKSKVLMEFGLRRAQGPDGAISASKYCFMGGFDATSNVLAGHLFGIPLRGTHSHAYVSSYMSLDEIPDRTLRNKDGSKICKDFVSLVKEWPLPDSGARRISLCTGPGIPGGAGGPCCLASIIILVSFSLPVLLTSTGTLAQPTPPTNARCRSTQGDKTGTSALLLCLS

SEQ ID NO: 5380 - protein, 284 aa, Triticum aestivum
  misc_feature (172)..(172): Xaa can be any naturally occurring amino acid
  misc_feature (202)..(202): Xaa can be any naturally occurring amino acid
  misc_feature (231)..(231): Xaa can be any naturally occurring amino acid
  misc_feature (239)..(239): Xaa can be any naturally occurring amino acid
  misc_feature (248)..(248): Xaa can be any naturally occurring amino acid
  misc_feature (252)..(252): Xaa can be any naturally occurring amino acid
  misc_feature (260)..(260): Xaa can be any naturally occurring amino acid
MAPLGDAVAPEVDAADPGLVVSFGEMLIDFVPDVAGVSLAECGGFVKAPGGAPANVACAISKLGGSSVFIGKFGDDEFGHMLVEILKKNGVNAEGCLFDQNARTALAFVTLKSNGEREFMFYRNPSDDMLLTEAELNLDLIRRARIFHYGSISLITEPCRSEHVAVMRAVKXIGILCSYDHNVRLALWPSAQGRRDGIMSIXKEADLIKVSDDEVGFLTQGDRTEEKNVLXSFWLEGLXLLMVTDGEXGVRXFTKGFKGXPCPGYSVKTFKTNGAGGSLGRGPP

SEQ ID NO: 5381 - protein, 264 aa, Triticum aestivum
  misc_feature (172)..(172): Xaa can be any naturally occurring amino acid
  misc_feature (177)..(177): Xaa can be any naturally occurring amino acid
  misc_feature (252)..(252): Xaa can be any naturally occurring amino acid
MAPLGDAVAPEVAAAAPCLVVSFGEMLIDFVPDVAGVSLAESGGFVKAPGGAPANVACAISKLGGSSVFIGKFGDYKFGHMLVEILKKNGVNAKGCLFDQNARTALAFVTLKSNGEREFMFYRNPSDDMLLTEAELNLDLIRRARIFHYGSISLITEPCRSEHVAAMRAVKXTGILXSYDPNVRLPLWTSAQADRDGIMSIWKDADFIKVSDDEVVFLTQGDATDEKNVWSVWSEGLRLVIGTDGDKGARYXTKDFRGSWPAIL

SEQ ID NO: 5382 - protein, 113 aa, Triticum aestivum
SAQSKPSLWFEGLKLLIVTDGEKGCRYFTKDFKGSVPGYSVNTVDTTGAGDAFVGSLLVSVSKDDSIFYNEAKLREVLQFSNACGAICTTKKGAIPALPTTATALELISKGSN

SEQ ID NO: 5383 - protein, 337 aa, Triticum aestivum
MAPLGDAVAPAAAAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAATRAAKSAGILCSYDPNVRLPLWPSAQAARDGIMSIWKEADFIKVSDEEVAFLTQGDATDEKNVLSLWFEGLKLLIVTDGEKGCRYFTKDFKGSVPGYSVNTVDTTGAGDAFVGSLLVSVSKDDSIFYNEAKLREVLQFSNACGAICTTKKGAIPALPTTATALELISKGSN

SEQ ID NO: 5384 - protein, 138 aa, Triticum aestivum
MGTRGLAVLLLAAVLLQGLLPASEAEGLVRIALKKRAIDRNSRVAKSLSDREEVHLLGGASNTLPSEEEGDIVSLKNYMNAQYFGEIGVGTPPQKFTVIFDTGSSNLWVPSAKCYFSIACYLHARYKAGASSTYKKNG

SEQ ID NO: 5385 - protein, 138 aa, Triticum aestivum
  misc_feature (25)..(25): Xaa can be any naturally occurring amino acid
  misc_feature (38)..(38): Xaa can be any naturally occurring amino acid
  misc_feature (53)..(53): Xaa can be any naturally occurring amino acid
  misc_feature (69)..(69): Xaa can be any naturally occurring amino acid
  misc_feature (87)..(87): Xaa can be any naturally occurring amino acid
ADAPMHSDSVWAGRYEPRPVYPLVXENLRIIAIVSRDXCSSKQHSFIHQLLSXQGRAWIIMCTNGDASXIIPADLDLAFALPTVYDXLQSEINILPLQLLAYHHDRCLLDSDLNQPTNLLEQRDHPTSLRKNMQINSL

SEQ ID NO: 5386 - protein, 477 aa, Triticum aestivum
  misc_feature (75)..(75): Xaa can be any naturally occurring amino acid
  misc_feature (390)..(390): Xaa can be any naturally occurring amino acid
TRILLFVIICRKELVWPELDQLLRDEDDTTGATTPYTAAIPEYRVVFIDKSDLEFEDKSWTLANGNGVIDAQHPXRANVAVRKELHKPASDRSCIHLEFDISGTGLVYETGDHVGVYSENSIETVEQAETLLGLSPDTVFSIHADAEDGSPRKGGGSLAPPFPSPCTLRTALLRYADLLNVPKKAALTALAAHASDPTEAERLRFLASPAGKDEYAQWIVASQRSLLEVMSAFPSAKPPLGVFFAAIAPRLQPRFYSISSSPKLAPSRIHVTCALVYGPTPTERIHQGVCSTWMKNTLPLEYSEECSWAPIFVRQSNFRLPADPSTPIIMIGPGTGLAPFRGFLQERLALKESGVELGSSVLFFGCRNREMDYIYEEELQNFLQEGALSXELIVAYSREGPTKEYVQHKMVDKATEIWNVISQGGYIYVCGDAKGMAKDVHRVLHTIVQKQGSLDNSKTELYVKNLQMEGRYLRDVW

SEQ ID NO: 5387 - protein, 146 aa, Triticum aestivum
WIPRAAGIRHEKLNSSLKKYAPDSAPALAIQATIEKTKRRFENYGKFGLLCGSDGLFYLIVSGDQRHWGEFITPGVLFLYIAGWIGWVGRSYLIAVSGEKKPAMREIIIDVELAARIIPRGFIWPVAAYRELINGDLVVDDADIGY

SEQ ID NO: 5388 - protein, 169 aa, Triticum aestivum
  misc_feature (92)..(92): Xaa can be any naturally occurring amino acid
  misc_feature (100)..(100): Xaa can be any naturally occurring amino acid
  misc_feature (107)..(107): Xaa can be any naturally occurring amino acid
  misc_feature (126)..(126): Xaa can be any naturally occurring amino acid
  misc_feature (154)..(154): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFXSKVGFIFXREHNASXPGYYDGRLLGQCWKLPMFXGATDATQVINEVEEVKEGVPDAYVRIIXGFDNMRQVQCVSSSP

SEQ ID NO: 5389 - protein, 189 aa, Triticum aestivum
  misc_feature (69)..(69): Xaa can be any naturally occurring amino acid
  misc_feature (115)..(115): Xaa can be any naturally occurring amino acid
  misc_feature (151)..(151): Xaa can be any naturally occurring amino acid
MAPTVMASSATSVAPFQGLKSTAGLPVSRRSNGASLGSVSNGGRIRCMQVWPIEGIKKFETLSYLPPLXSTEALLKQVDYLIRSKWVPCLEFSKVGFIFREHNASPGYYDGRYWXTMWKLPMFGVQPNATQVINEGGRRSKKEYPDAYVRXIIGFDNMRHVQCVRFIAFKPPGCKIRQGLNSSLTTGHI

SEQ ID NO: 5390 - protein, 143 aa, Triticum aestivum
MEVLGKSVIAEPSNVIFLSTILNTEGEIPSHKCDKRCQNEHIFGNMYRCKLTGMTHICDKNCNQRILYDNHNSLCRVSGQLFPLSPLELTAVRGIRRKHEADSNEGCSFKRRRGAQLHPSPARGSYSAVSPIPSQAGDGMDLS

SEQ ID NO: 5391 - protein, 287 aa, Triticum aestivum
  misc_feature (244)..(244): Xaa can be any naturally occurring amino acid
  misc_feature (253)..(253): Xaa can be any naturally occurring amino acid
  misc_feature (275)..(275): Xaa can be any naturally occurring amino acid
MTVVAAAAAAAAQELPGHGQTVCVTGAAGYIASWLVKLLLERGYTVKGTVRNPDDPKNAHLKALDGAAERLVLCKADLLDYDAICAAVEGCHGVFHTASPVTDDPEQMVEPAVRGTEYVINAAADAGTVRRVVFTSSIGAVTMDPNRGPDVVVDESCWSDLEFCKKTKNWYCYGKAVAEQAAWEKAAARGVDLVVVNPVLVVGPLLQPTVNASAAHILKYLDGSAKKYANAVQAYVDVRDVAAXHVRVFEAPXPSGRHLCAERVLHREDVVHILXKLFPEYPSHQVP

SEQ ID NO: 5392 - protein, 147 aa, Triticum aestivum
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKTTAKSPKKKVAAPIA

SEQ ID NO: 5393 - protein, 252 aa, Triticum aestivum
  misc_feature (177)..(177): Xaa can be any naturally occurring amino acid
MAALTASIATSTVFAAKPRLARPPARLSVSCSVSSGDNTTPSLSDSIKIFSEGLALSSVLLSSAATSPPAAAADIAGLTPCKESKAFAKRDKHSVKKLNSSLKKYAPESDPALAIQDIIEKTKRRYENYGKSGLLCGSDGLPHLIVSGDQRHWGEFITPGVLFLYIAGWIGWVGRSXLIARRSNKNAAMREIIIEVELGDRIIPSGLIMSVAAYRELINGDLMMEDADIGYYSKGMHAWLTNRVQFKWTGDE

SEQ ID NO: 5394 - protein, 121 aa, Triticum aestivum
MNARGYRSTRTALFDGIEEGGIRSSAYSSHEIDEHENERAMDGLQDRVSILKRISGDINEEVEAHNRMLDRMGNDMDSSRGFLSGTVDKFKTVFETKSSRRMGTLVASFVALFMLVYYLTR

SEQ ID NO: 5395 - protein, 121 aa, Triticum aestivum
MNARGYRSTRTALFDGIEEGGIRASAYSSHEIDEHENERAMDGLQDRVSILKRISGDINEEVEAHNRMLDRMGNDMDSSRGFLSGTVDKFKTVFETKSSRRMGTLVASFVALFMLVYYLTR

SEQ ID NO: 5396 - protein, 125 aa, Triticum aestivum
MHPKARIHADPAAPELDRIDCLPDSLVLLILNKLEDVHSLGRCAAVSKRFNDLVPLVHDVYVKIDRVVAVDGDPDDALNLSSAKPRHIFSHLFKLMLFTIAKPFHGMRGPGGAGGRPLFPRLAQH

SEQ ID NO: 5397 - protein, 159 aa, Triticum aestivum
  misc_feature (52)..(52): Xaa can be any naturally occurring amino acid
PANGSFLKSIKDSVCPTELEPADGKSKVNVNPVRKEEEFTEPVKHAAPFEGXRRTLMEPSDNNTSNAAASSSVPAPRTITVDDSLPSTSLQIRFADGSRLVARFNTSHTIGDVRSFIDATRPASSDYTLQAGFPPKPLEDATKTIEEAGIANSVIIQSV

SEQ ID NO: 5398 - protein, 103 aa, Triticum aestivum
MARKKIREYDSKRLLKEHLKRLAGIDLQILSAQVTQSTDFTELSNQEPWLSSMKLVVKPDMLFGKRGKSGLVALNLDLAQVRQFVNERLGVEVEMGGCKAPIT

SEQ ID NO: 5399 - protein, 155 aa, Triticum aestivum
  misc_feature (52)..(52): Xaa can be any naturally occurring amino acid
  misc_feature (66)..(66): Xaa can be any naturally occurring amino acid
  misc_feature (83)..(83): Xaa can be any naturally occurring amino acid
  misc_feature (93)..(93): Xaa can be any naturally occurring amino acid
  misc_feature (97)..(97): Xaa can be any naturally occurring amino acid
  misc_feature (112)..(112): Xaa can be any naturally occurring amino acid
  misc_feature (122)..(122): Xaa can be any naturally occurring amino acid
  misc_feature (129)..(129): Xaa can be any naturally occurring amino acid
  misc_feature (138)..(138): Xaa can be any naturally occurring amino acid
  misc_feature (149)..(150): Xaa can be any naturally occurring amino acid
QAGLLEPKDVDLLNITSMACPALPLCPLAQTEAERGILPILKRIRAVFDKVXGIKDEESVVVRITXGCPNGCARPYMAEVGFXLGDGPNSYQXIWLXRNTKPRHLWQETLMXKVNFQDIEKXWDHCFPXWDNTPPRRXPLGASQTRMGXXQLKEW

SEQ ID NO: 5400 - protein, 232 aa, Triticum aestivum
  misc_feature (136)..(136): Xaa can be any naturally occurring amino acid
  misc_feature (197)..(197): Xaa can be any naturally occurring amino acid
MAALTASIATSTAFAAKPRLVRPPARLSVSCSESSGDNTTPSLSVSIKTFSEALALSSDLLSSDVTSPAEGADDIAGLTPCKESKVYDNRDNESVNKLNSSHKNYAPDSAPALAIHATIENTRCWFENYGKCGLFXGSEGLPHLIVRGDQWHWGEFITRGVLFLYIIGWIGWVCRSYLIADNGNKNPDMRYIMINVXLVLRIIPRGFIWAVRGYRECIKGRLVVENAHVRLI

SEQ ID NO: 5401 - protein, 567 aa, Triticum aestivum
MASPALISDTDQWKALQAHVGAIHKTHLRDLMTDADRCKAMTAEFEGVFLDYSRQQATTETVDKLFKLAEAAKLKEKIDKMFKGEKINTTENRSVLHVALRAPRDAVINSDGVNVVPEVWAVKDKIKQFSETFRSGSWVGATGKPLTNVVSVGIGGSFLGPLFVHTALQTDPEAAESAKGRQLRFLANVDPVDVARSIKDLDPATTLVVVVSKTFTTAETMLNARTIKEWIVSSLGPQAVSKHMIAVSTNLKLVKEFGIDPNNAFAFWDWVGGRYSVCSAVGVLPLSLQYGFPIVQKFLEGASSIDNHFHTSSFEKNIPVLLGLLSVWNVSFLGYPARAILPYSQALEKLAPHIQQLSMESNGKGVSIDGVRLPYEAGEIDFGEPGTNGQHSFYQLIHQGRVIPCDFIGVIKSQQPVYLKGETVSNHDELMSNFFAQPDALAYGKTPEQLRSEKVPENLISHKTFQGNRPSLSFLLSSLSAYEIGQLLSIYEHRIAVQGFIWGINSFDQWGVELGKSLASTVRKQLHASRMEGKPVEGFNPSSASLLTRFLAVKPSTPYDTTVLPKV

SEQ ID NO: 5402 - protein, 530 aa, Triticum aestivum
  misc_feature (83)..(83): Xaa can be any naturally occurring amino acid
  misc_feature (121)..(121): Xaa can be any naturally occurring amino acid
  misc_feature (147)..(147): Xaa can be any naturally occurring amino acid
  misc_feature (161)..(161): Xaa can be any naturally occurring amino acid
  misc_feature (172)..(172): Xaa can be any naturally occurring amino acid
  misc_feature (191)..(191): Xaa can be any naturally occurring amino acid
  misc_feature (197)..(197): Xaa can be any naturally occurring amino acid
GIDLEYARQEHVAAIHKTPLKNLETENDREKAVKLKNEEDILANAKKLATTETVEELCKAVMAPKVADMIDKVLNGEKINTTXENRSVRHVALRSRRDAVVNSEGVNWDLVVRSVKVVIVXSPGLFRRSSRLRGTRQTLPKVDQMEXLVQFNTAYVRLSGXPYCPGSSLICXVSKIFITADTMLNARTIRXSGLSLXLGPQAVSKHMIAVSTNLKLVKEFGIDPNNAFAFWDWVGGRYSVCSAVGVLPLSLQYGFPIVQKFLEGASSIDNHVHTSSFEKNIPVLLGLLSVWNVSFLGYPARAILPYSQALEKLAPHIQQLSMESNGKGVSIDGVRLPYEAGEIDFGEPGTNGQHSFYQLIHQGRVIPCDFIGVIKSQQPVYLKGETVSNHDELMSNFFAQPDALAYGKTPEQLRSEKVPENLISHKTFQGNRPSLSFLLSSLSAYEIGQLLSIYEHRIAVQGFIWGINSFDQWGVELGKSLASTVRKQLHASRMEGKPVEGFNPSSASLLTRFLAVKPSTPYDTTVLPKV

SEQ ID NO: 5403 - protein, 150 aa, Triticum aestivum
GELGPTSHAPGRHGAGISSGRPGRSYGKTPEQLRSEKVPENLISHKTFQGNRPSLSFLLSSLSAYEIGQLLSIYEHRIAVQGFIWGINSFDQWGVELGKSLASTVRKQLHASRMEGKPVEGFNPSSASLLTRFLAVKPSTPYDTTVLPKV

SEQ ID NO: 5404 - protein, 187 aa, Triticum aestivum
SGKNNILVEYPFWKGSERFNEIVDIKHIRPCPPHASVISFCINDDVEGFQDHASGPGKITEIHPKLTYTFKLRTSGKKVQLHQNTLRLRYDWTDNQWKQVAQNLSGTKFTGGDRVEVSSDEEGFHGAWFQGTVIKSVGHKFLVEYDALKDDDETTPLKETIGEEHIRPSPPAIPVTSGFKVLDEIDA

SEQ ID NO: 5405 - protein, 258 aa, Triticum aestivum
  misc_feature (115)..(115): Xaa can be any naturally occurring amino acid
KTRLGNPNPFKKPGRGGPRKTPNAALAALAAFHGTFHGFARQPALGPPAGGASPFSCSASSGDNNTPDLSASIKTFWAALALSSVVVSSAATSPPPAAADIAGLTPCKESKAFAXKREKQSVKKLNSSLKKYAPDSAPALAIQATIEKTKRRFENYGKFGLLCGSDGLPHLIVSGDQRHWGEFITPGVLFLYIAGWIGWVGRSYLIAVSGEKKPAMREIIIDVELAARIIPRGFIWPVAAYRELINGDLPLADADIGY

SEQ ID NO: 5406 - protein, 121 aa, Triticum aestivum
PALAINATIEKTKRRFENYGKFGLLCGADGLPHLIVSGDQRHWGEFITPGLLFLYIAGWIGWVGRSYLIAISGEKKPAMREIIIDVELAVKLLPRGFIWPVAAYRELITGNLVVDDADIGY

SEQ ID NO: 5407 - protein, 231 aa, Triticum aestivum
  misc_feature (203)..(203): Xaa can be any naturally occurring amino acid
MAALAASMATSTAFAAKPRLARPPARLSVSCSASSGDNNTPSLSASIKTFSAALALSSVLLSSAATSPPPAAADIAGLTPCKESKAFAKREKQSVKKLNSSLKKYAPDSAPALAIQATIEKTKRRFENYGKFGLLCGSDGLPHLIVSGDQRHWGEFITPGVLFLYIAGWIGWVGRSYLIAVSGEKKPAMREIIIDVELAARIXPRGFIWPVAAYRELINGDLVVDDADIRY

SEQ ID NO: 5408 - protein, 280 aa, Triticum aestivum
  misc_feature (102)..(102): Xaa can be any naturally occurring amino acid
  misc_feature (128)..(128): Xaa can be any naturally occurring amino acid
  misc_feature (139)..(139): Xaa can be any naturally occurring amino acid
  misc_feature (219)..(219): Xaa can be any naturally occurring amino acid
  misc_feature (230)..(230): Xaa can be any naturally occurring amino acid
  misc_feature (271)..(271): Xaa can be any naturally occurring amino acid
MEHEDTDMGLKESATLASDHESNPSTRPPARARAKDTPDAAAMAALTASIATSTAFAAKPRLARPPARLSVSCSASSGDNTTPSLSASIKTFSAALALSSVXLLSSAATSPPPAAADIAGLTPCKESXKAFAKREKHSXVKKLSSSLRKYAPDSAPALAIQATIEKTKRRFENYGKFGLLCGSDGLPHLIVSGDQRHWGEFITPGVLFLYIAGWIAWVXGRSYLIAVSGXENKPAMREIIIDVELAARIIPRGFIWPVCRLPRSSYNGETXVVDHADIGY

SEQ ID NO: 5409 - protein, 296 aa, Triticum aestivum
  misc_feature (93)..(93): Xaa can be any naturally occurring amino acid
  misc_feature (105)..(105): Xaa can be any naturally occurring amino acid
PEFPRRIIDPQGVQKPPQQSPARGGCRDNPGAPHGAPFTAFHGPPPGPLPHKPPRGPPARAALSFSWSGSHRGQTTPPPFSPSIQTLSPALAXLSSVVLSSAGTXPRPRAAAEIAGLTPCKESKAFAQREKQSVKKLNSSLKKYAPDSAPALAIQATIEKTKRRFENYGKFGLLCGSDGLPHLIVSGDQRHWGEFITPGVLFLYIAGWIGWVGRSYLIAVSGEKKPAMREIIIDVELAARIIPRGFIWPVAAYRELINGDLVVDETDPPSSVAAMRAWLASQSQVRWAAEDEGLWC

SEQ ID NO: 5410 - protein, 232 aa, Triticum aestivum
  misc_feature (190)..(190): Xaa can be any naturally occurring amino acid
  misc_feature (211)..(211): Xaa can be any naturally occurring amino acid
MAALAASIATSTAFAAKPRLARPPARLSVSCSASSGDNNTPSLSASIKTFSAALALSSVLLSSAATSPPPAAADIAGLTPCKESKAFAKREKQSVKKLNSSLKKYAPDSAPALAIQATIEKTKRRFENYGKFGLLCGSDGLPHLIVSGDQRHWGEFITPGVLFLYIAGWIGWVGRSYLIAVSGENKPAMXREIVIGVQLAARIMPGGFIWXVAAYRELINGDLVVDDADIGY

SEQ ID NO: 5411 - protein, 231 aa, Triticum aestivum
MAALTASIATSSAFAAKPRLARPPARLSVSCSASNGDNNTPSLSASIKTFSAALALSSVLLSSAATSPPPAAADIAGLTPCKESKAFAKREKQSVKKLNSSLKKYAPDSAPALAIQATIEKTKRRFENYGKFGLLCGSDGLPHLIVSGDQRHWGEFITPGVLFLYIAGWIGWVGRSYLIAVSGEKKPAMREIIIDVELAARIIPRGFIWPVAAYRELINGDLVVDDADIGY

SEQ ID NO: 5412 - protein, 140 aa, Triticum aestivum
  misc_feature (90)..(90): Xaa can be any naturally occurring amino acid
NSIKKLTASLKKYAPDSAPALAINATIEKTKKRFENYGKFGLLCGADGLPHLIVSGDQRHWGEFITPGLLFLYIAGWIGWVGRSARGAIXGEKKPAMREIIIDVELATRLLPRGFIWPVAAYRELINGDLVVDDKDIGYY

SEQ ID NO: 5413 - protein, 263 aa, Triticum aestivum
  misc_feature (141)..(141): Xaa can be any naturally occurring amino acid
MCGCREVMHAMWRPQKFKGIYLMATAYVLTLTLPSAASVYWAFGDELLTHSNALSLLPRTPFRDAALVLMLVHQFITFGFACTPLYFVWEKLIGLHDCRSLCKRAAARLPVVVPIWFLAIVFPFFGPINSAVGSLLVSFTXYIIPALAHMITYRSAHARENAVEQPPRFVGRWTGTYVINAFVVVWVLVVGFGFGGWASITNFVRQIDTFGLFTKCYQCPTPPIPDASWPFPGGLHNLTMLPPAPAPSPAHFFRHHRHHSRGL

SEQ ID NO: 5414 - protein, 110 aa, Triticum aestivum
  misc_feature (28)..(28): Xaa can be any naturally occurring amino acid
  misc_feature (40)..(40): Xaa can be any naturally occurring amino acid
  misc_feature (54)..(54): Xaa can be any naturally occurring amino acid
  misc_feature (73)..(73): Xaa can be any naturally occurring amino acid
  misc_feature (80)..(80): Xaa can be any naturally occurring amino acid
FFGTIAQNQGRLFWWNWVRAPKGINVDXPPISGVPDLAFXLANKTFTLTPGPFXVKLEQSGQAICISGFMAFXDVPPPRXPLWILGDVFMGAYHTVFDFGESRIGFAKSA

SEQ ID NO: 5415 - protein, 324 aa, Triticum aestivum
  misc_feature (293)..(293): Xaa can be any naturally occurring amino acid
MHPTRWELSHMVDLQAAALVISVVAAEVRDPGASVGGELVFGGVDKKHYKGKHTYVPVTRKGYWQFDMGDLLIGGESTGFCAGGCAAIVDSGTSLLAGPTTIVAQVNHAIGAEGIISTECKEVVREYGEMILELLVAQTRPQKVCSQIGLCVFDGSHSVSNQIESVVNKNEKRGSDLLCTACEMTVVWIQNQLRKNPTKELILDYANRLCERLPSPNGESTVDCHQISEMPDLAFTIANKTFTLTPEQYVVKLEQSGQAICISGVMAFDVPAPRGPLWILGDVFMGAYHPVFXFGESKIGFANPRTGVSRTRPYCHTQHVQFKT

SEQ ID NO: 5416 - protein, 89 aa, Triticum aestivum
FESTDPVDGSVSKHQGTRYLFGDGSRLVFRLSGTGSVGATIRVYIEQYEKDSSKIGRDSQDALAPLVDVALKLSKMQEYTGRFAPTVIT

SEQ ID NO: 5417 - protein, 143 aa, Triticum aestivum
VLWEVDGHWVVQGAVDVVIGANPSTEGGGDDEGVDVQAVKVVDIVVTFRLQEHPAFDKKQFISHMKRCIKNLSAKLEGDDLDVFKKNNVESATKYLLSKLKDLQFFVGESMHDDGGVVFAYYKEGAADPTFLYFAHGLKEVKC

SEQ ID NO: 5418 - protein, 168 aa, Triticum aestivum
MLVYQDKLSGDELLSDSFPYRELENGVLWEVDGHWVVQGALDVDIGANPSAEGGGDHQGVDDQAVKVVDIVDTFRLQEQPAYDRKQFISHMKRYIKNLSAKLEGDDLHIFENNVESATKYLLSKLKDLQFFAGESMHDDGGVVSAYYKEGAVDPPFLYYCHGLKEVKC

SEQ ID NO: 5419 - protein, 465 aa, Triticum aestivum
  misc_feature (283)..(283): Xaa can be any naturally occurring amino acid
SAHASADAWGVIELDMWPNSAKDDISILHGRTLTTPVSLLKCLKSIKEYAFAASPYPVIITLEDHLTPELQDKVAKMVLEVFGTILYYPEEEHPKELPSPESLKGRVLLSTKPPKEYLEAKDGGAAKDGDAEQNPGKGTDDDAAWGTEVPDFKTEIQSAKQEDDASENRRDGDEDDDDEDEQKMQQHLAPQYKRLITIRAGKPKGGTTSDALKCDPNKVRRLSLSEQQLAKAVVNHGTEIVRFTQRNLLRIYPKGTRVTSSNYNPFIGWVHGAQMVAFNMQGXYGRALWLMHGFYKANGGCGYVKKPDFLMQSEPEVFDPKKPQPVKKTLKVKVYMGDGWRMDFKHTHFDHFNQTHFDQYSPPDFYARVGIAGVPADSVMRKTKAVEGNWVPVWGEEFSFGLTVPELALLRVEAHEYDMSEKDDFAGQTVLPVSELQPGIRAVALFDRKGNKFPNVKLLMRFEFV

SEQ ID NO: 5420 - protein, 187 aa, Triticum aestivum
MGMQADAAEMTGPLLAGAPSAVEAVPPWREQLTVRGVVVSAILGVLFCLITHKLNLTVGIIPSLNVAAGLLAYFLVRTWTAALGMFGVVSKPFTKQENTVIQTCVVACYGLATSGGFGSYMLAMDQKTYELIGTDYPGNRAVDVKNPSLSWMIGFMFVVSFIGIFSLVALRKVMVINYKLTYPRGTA

SEQ ID NO: 5421 - protein, 400 aa, Triticum aestivum
EISSRFRFRFRSENSPGERARWRPPGRLIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLAEMTNGGVDRSVECTGNVNAMIQAFECVHDGWGVAVLVGVPHKDAEFKTHPMNFLNERTLKGTFFGNFKPRTDLPNVVEMYMRKELEVEKFITHSVPFSEINKAFDLMAKGEGIRCIIRMEN

SEQ ID NO: 5422 - protein, 379 aa, Triticum aestivum
  misc_feature (84)..(84): Xaa can be any naturally occurring amino acid
  misc_feature (326)..(326): Xaa can be any naturally occurring amino acid
MATAGKVIKCKAAVAWEAGKPLSMEEVEVAPPQAMEVRVKILFTSLCHTDVYFWEAKGQTPMFPRIFGHEAGGIVESVGAGVTXLAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLAEMTNGGVDRSVECTGNVNAMIQAFECVHDGWGVAVLVGVPHKDAEFRTHPMNFLNERTLMGTFFGNFXPCNELPNVVEMYIKQDLEVEKVITNSVPVSEINRPSELMGKGEGLRFIIRMEN

SEQ ID NO: 5423 - protein, 286 aa, Triticum aestivum
  misc_feature (71)..(71): Xaa can be any naturally occurring amino acid
  misc_feature (92)..(92): Xaa can be any naturally occurring amino acid
  misc_feature (143)..(143): Xaa can be any naturally occurring amino acid
  misc_feature (199)..(199): Xaa can be any naturally occurring amino acid
  misc_feature (220)..(220): Xaa can be any naturally occurring amino acid
  misc_feature (253)..(253): Xaa can be any naturally occurring amino acid
  misc_feature (268)..(268): Xaa can be any naturally occurring amino acid
SCEVRDQFSISIPGSENFGERDGDGREAAVAWEAGKPLSMEEVEVAPPQAMEVRVKILFTSLCHTDVYFWXAKGQTPMFPRIFGHEAGGIVXSVGEGVTELAPGDHVLPVFTGECKECPHCKSAESNMCDLLRINTDRGVMIXDGKSRFSIDGKPIYHFVGTSTFSEYTVMHVGCVAKINPEAPLDKVCVLSCGISTGXLGASINVAKPPKGSTVAIFGXLGAVGLAAAEGARIAGASRIIGVDLNASRFEEXRKFGCTEFVNRKIHXKPIQQVLAEMTNGGVDPC

SEQ ID NO: 5424 - protein, 383 aa, Triticum aestivum
  misc_feature (204)..(204): Xaa can be any naturally occurring amino acid
  misc_feature (297)..(297): Xaa can be any naturally occurring amino acid
  misc_feature (321)..(321): Xaa can be any naturally occurring amino acid
MATGGKVIKCKAAVALEAGKPVFMEEVEVAPPQAMEVRVQILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGPWAHPINVAKPPKGSTVAIFGXLGAVGLAAAEGARIAGASRIIGIDLNASRFEEARKFGCTEFVNPKDHSKPVQEVLAEMTNGGVDRSVECTGNVNAMIQAFECVHDGWGVAVLXVGVPHKDAEFKTHPMNFLNERTLXKGTFFGNSKPRTDLPNVVEMYMRKELEVEKFITHSVPFSEINKAFDLMAKGEGIRCIIRMEN

SEQ ID NO: 5425 - protein, 340 aa, Triticum aestivum
  misc_feature (212)..(212): Xaa can be any naturally occurring amino acid
  misc_feature (218)..(218): Xaa can be any naturally occurring amino acid
MGFDRANTANCVATGRGRTVCVTGAGGFIASWLVKLLLEKGYTVHGTVRNPDDVARNAHLGALEGAAERLTLFRVDLLDKESLIAAFRGCEGVFHTACPVTDDPEKMIEPAVNGTRNVINAAAEVGGIRRVVMTSSIGSVYMDPRRSTDGEADETCWSDLEFCKNTKNWYCYAKTVAEQAAWELAKERKLDLVVINPSLVLGPLLQSAVNAXSTWHIXKYLDGSVQTYTNAAQAYVHVRDVADAHARAYEMPDAHGRYLCAGRTLHRAEVCRILAKFFPEYPVPMRSKEGAGEMKKGCRFSSRRIMELGVSITPASQCVYDTVTSLQDKGILPRRDADMS

SEQ ID NO: 5426 - protein, 241 aa, Triticum aestivum
  misc_feature (11)..(11): Xaa can be any naturally occurring amino acid
  misc_feature (16)..(16): Xaa can be any naturally occurring amino acid
  misc_feature (18)..(19): Xaa can be any naturally occurring amino acid
  misc_feature (22)..(22): Xaa can be any naturally occurring amino acid
  misc_feature (79)..(79): Xaa can be any naturally occurring amino acid
  misc_feature (112)..(112): Xaa can be any naturally occurring amino acid
KPLHWDKVRAXSDRAXVXXPLXSRSFQVNEEMIETLFLCNPARAAPKEATKRPALPTPKAENKVLLDPKKAQNLALLAXAALNVTKEEVCEAPCEGNTQNFGADLLETLAKXWLPTKEEEIKLREFKEETSPIKLGPSEKFLKAVLDVPFAFKRVDAMLYIANFESEVKYLKNNFEILEAACEELRNSRLFLKLLEAILKTGNRMNVGTNRGDAHAFKLDTLLKLADVKGTDGKTTLLHFV

SEQ ID NO: 5427 - protein, 279 aa, Triticum aestivum
MDALTLTSLLKAAAAAFPDRRAIAVHAKIDLTHAALDALVDAAAARLAAGPDGLRPGQTVALCFPNTVELVVVFLAVIRARGVAAPLNPAYTQDEFEFYLSDWGARLLVTGADGNAPAQAAAAKLGLPHAVAATLTDAAGPLDLAGLAGDIQDNNPAPQNNGTVQHQEENEPSDVALFLHTSGTTSRPKGVPLTQRNLAASVQNIRAVYRFAETDATVVTLPLFHVHGLMCALLSSLASGASVALPAAGRFSASTFWADMLAAGATWYTAVPTIHQIIL

SEQ ID NO: 5428 - protein, 117 aa, Triticum aestivum
MEDGVSTYTVDEALVSMGFGKFQVFVLAYSGMAKISEAMEMMLLSFVGQSVHAEWGLSAQEESFITSVVFLGMLVGAYCWGLVSDNYGRRVGFNFTALVTGGAGLLSAFAPNYSSLR

SEQ ID NO: 5429 - protein, 249 aa, Triticum aestivum
MPRYDDRYDRYDDRYDRYDDRYDRYNDRYDRYDRYGGNTKLYVGHLSTHTRTKDVEYLFGRYGRIRCVELKYDYGFVEFSDPRDADDARYELDGQEIDGSRIIVEFARGIPRGPGGSREYLGRGPPPGSGRCFNCGIDGHWARDCNAGDWKNKCYRCGEKGHIEKNCQNSPKNLKRGRSYSRSPPPHRERSLSRSYSRSPYPRRDDRAVGHEERRPRSSSYSPRRSASPSGLNRSPAPNGKSHPPRGAS

SEQ ID NO: 5430 - protein, 127 aa, Triticum aestivum
  misc_feature (83)..(83): Xaa can be any naturally occurring amino acid
  misc_feature (98)..(98): Xaa can be any naturally occurring amino acid
  misc_feature (103)..(103): Xaa can be any naturally occurring amino acid
MATNIEDVPSVELMTELLRRAKCSSKPDKRIILVGPPGSGKGTQSPLIKDEYCLCHLATGDMLRAAVTAKTPLGIKAKEAMDXDDLVVGIIDEAMKKXSCQKXFILDGFPRTVVQAQKLDEMLANKC

SEQ ID NO: 5431 - protein, 239 aa, Triticum aestivum
  misc_feature (83)..(83): Xaa can be any naturally occurring amino acid
  misc_feature (98)..(98): Xaa can be any naturally occurring amino acid
  misc_feature (216)..(216): Xaa can be any naturally occurring amino acid
MATNIEDVPSVELMTELLRRAKCSSKPDKRIILVGPPGSGKGTQSPLIKDEYCLCHLATGDMLRAAVTAKTPLGIKAKEAMDXDDLVVGIIDEAMKKXPSCQKGFILDGFPRTVVQAQKLDEMLAKQGAKVDKVLNFAIDDAILEERITGRWIHPSSGRSYHTKFAPPKTPGVDDVSGEPLIQRKDDTTEVLKSRLEAFHIHTDPVIDYYSKNGLXVANLHAEKHKGSRGQKLFKACSP

SEQ ID NO: 5432 - protein, 166 aa, Triticum aestivum
MPRTRRLRGGFRLGRKLLTAWRWALCGRSRRRGGYLRLDTPCPVEGREAKKLAPVLRWGQSLARLLSLGRTDRGQRTLGGGGGDEAVKTPKGQVAVYVGGGGPGEPLRYVVPVVYFNHPMFGELLREAEEAFGFQHPGGITIPCAAAKFERAAAVAAGGKKGFARW

SEQ ID NO: 5433 - protein, 162 aa, Triticum aestivum
  misc_feature (87)..(87): Xaa can be any naturally occurring amino acid
MPRTRRLRGGFRLGRKLLTAWRWALCGRNRRRGGGGYLRLDTPCPMEGREAKKLAPVLRWGKSLARLLSLGRADRGQQTLEAVKTPXGQVAVYVGGGGPGEPLRYVVPVVYFNHPMFGELLREAEEAFGFQHPGGITIPCAAAKFERAAAVAAAGKKGFARW

SEQ ID NO: 5434 - protein, 278 aa, Triticum aestivum
MIPLCASSSPSTPAIIAPRPRRLRHRTATPSLPHSRSPHRHLLLASSSPAPTPRPLARAHRPGAVATAAEMVFSVTKKETKPYEGQKPGTSGLRKKVTVFQQPHYLANFVQSTFNALPADQVKGATIVVSGDGRYFSKDAVQIIAKMAAANGVRRVWVGQDSLLSTPAVSAIIRERISADGAKATGAFILTASHNPGGPTEDFGIKYNMGNGGPAPESVTDKIFSNTKTITEYLIAEDLPNVDISVIGVTSFTGPGAPFGPVGRAEGPFELLLITFKA

SEQ ID NO: 5435 - protein, 648 aa, Triticum aestivum
  misc_feature (210)..(210): Xaa can be any naturally occurring amino acid
  misc_feature (544)..(544): Xaa can be any naturally occurring amino acid
  misc_feature (588)..(588): Xaa can be any naturally occurring amino acid
  misc_feature (595)..(595): Xaa can be any naturally occurring amino acid
  misc_feature (632)..(632): Xaa can be any naturally occurring amino acid
  misc_feature (638)..(638): Xaa can be any naturally occurring amino acid
MIPLCASSSPSTPAIIAPRPRRLRHRTTTPSLPHSRSPHRLHLLASSSTPRPLARAHRPGSVVTAAEMVFSVTKKETKPYEGQKPGTSGLRKKVTVFQQPHYLANFVQSTFNALPADQVKGATIVVSGDGRYFSKDAVQIIAKMAAANGVRRVWVGQDSLLSTPAVSAIIRERISADGAKATGAFILTASHNPGGPTEDFGIKYNMGNGXGPAPESVTDKIFSNTKTITEYLIAEDLPNVDISVTGVTSFTGPEGPFDVDVFDSATDYIKLMKTIFDFESIKKLLASPKFSFCFDGLHGVAGAYAKRMFVDELGASESSLLNCVPKEDFGGGHPDPNLTYAKELVERMGLGKTSNADPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAALAWLSILAYKNKDNLGGDKLVTVEDIVLQHWATYGRHYYTRYDYENVDAEAAKELMANLVKMQSSLSDVNKXIKEIQPTVADVVSADEFEYKDPVDGSVSKHQGIRYLFGDGSRLXVFRLSGXTGSVGATIRIYIEQYEKDSSKTGRESSDALSPLVDVXLKLSKXQEYTGRSAPR

SEQ ID NO: 5436 - protein, 654 aa, Triticum aestivum
  misc_feature (479)..(479): Xaa can be any naturally occurring amino acid
  misc_feature (508)..(508): Xaa can be any naturally occurring amino acid
MIPLCASSSPSTPAIIAPRPRRLRHRTTTPSLPHSRSPHRHLLLASPSSPAPTPRPLARAQRLAAAATAAEMVFSVTKKETKPYEGQKPGTSGLRKKVTVFQQPHYLANFVQSTFNALPADQVKGATIVVSGDGRYFSKDAVQIIAKMAAANGVRRVWVGQDSLLSTPAVSAIIRERISADGAKATGAFILTASHNPGGPTEDFGIKYNMGNGGPAPESVTDKIFSNTKTVTEYLIAEDLPNVDISVIGVTSFTGPEGPFDVDVFDSATDYIKLMKTIFDFESIKKLLASPKFSFCFDGLHGVAGAYAKRMFVDELGASESSLLNCVPKEDFGGGHPDPNLTYAKELVDRMGLGKTSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWXLSILAYKNKDNLGGDKLVTVEDIVLQHWXATYGRHYYTRYDYENVDAEAAKELMANLVKMQSSLSDVNKSIKEIQPTVADVVSADEFEYKDPVDGSVSKHQGIRYLFGDGSRLVFRLSGTGSVGATIRIYIEQYEKDSSKTGRASSDALSPLVDVALKFSKIKEYTGRSAPTVIT

SEQ ID NO: 5437 - protein, 654 aa, Triticum aestivum
  misc_feature (365)..(365): Xaa can be any naturally occurring amino acid
  misc_feature (385)..(385): Xaa can be any naturally occurring amino acid
  misc_feature (394)..(394): Xaa can be any naturally occurring amino acid
  misc_feature (408)..(408): Xaa can be any naturally occurring amino acid
MILLGSSSPSTPAIIAPRPRRLRHRTTTPSLPHSRSPHRHLVLASSSPAPTPRPLARAHRPGAVATAAEMVFSVTKKETKPYEGQKPGTSGLRKKVTVFQQPHYLANFVQSTFNALPADQVKGATIVVSGDGRYFSKDAVQIIAKMAAANGVRRVWVGQDSLLSTPAVSAIIRERISADGAKATGAFILTASHNPGGPTEDFGIKYNMGNGGPAPESVTDKIFSNTKTITEYLIAEDLPNVDISVIGVTSFTGPEGPFDVDVFDSATDYIKLMKTIFDFESIKKLLASPKFSFCFDGLHGVAGAYAKRMFVDELGASESSLLNCVPKEDFGGGHPDPNLTYAKELVDRMGLGKTSNVEPPEFGAXAADGDADRNMVLGKRFFVTXPSDSVAIIXRANAVQSIPYFASXGLKGVARSMPTSAALDVVAKNLNLKFFEVPTGWKFFGNLMDAGMCSVCGEESFGTGSDHIREKDGIWAVLAWLSILAYKNKDNLGGDKLVTVEDIVLQHWATYGRHYYTRYDYENVDAEAAKELMANLVKMQSSLSDVNKSIKEIQPTVADVVSADEFEYKDPVDGSVSKHQGIRYLFGDGSRLVFRLSGTGSVGATIRIYIEQYEKDSSKTGRASSDALSPLVDVALKFSKIKEYTGRSAPTVIT

SEQ ID NO: 5438 - protein, 651 aa, Triticum aestivum
  misc_feature (138)..(138): Xaa can be any naturally occurring amino acid
  misc_feature (226)..(226): Xaa can be any naturally occurring amino acid
  misc_feature (235)..(235): Xaa can be any naturally occurring amino acid
  misc_feature (504)..(504): Xaa can be any naturally occurring amino acid
  misc_feature (642)..(642): Xaa can be any naturally occurring amino acid
MIPLCASSSPSTPAIIAPRPRRLRHRTTTPSLPHSRSPHRLHLLASSSTPRPLARAHRPGSVVTAAEMVFSVTKKETKPYEGQKPGTSGLRKKVTVFQQPHYLANFVQSTFNALPADQVKGATIVVSGDGRYFSKDAXVQIIAKMAAANGVRLVWVGQDSLLLTEYVAAIIRKRISSDVAKATGASVYEVRHKPRGPTVDFVIKYNMGNGGPAPKSVTDKIFSNTXSVTEYLIAXDLPNFDISLLGVTSFTGPEGPFDVDVFDSATDYIKLMKTIFDFESIKKLLASPKFSFCFDGLHGVAGAYAKRMFVDELGASESSLLNCVPKEDFGGGHPDPNLTYAKELVDRMGLGKTSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSILAYKNKDNLGGDKLVTVEDIVLQHWXATYGRHYYTRYDYENVDAEAAKELMANLVKMQSSLSDVNKSIKEIQPTVADVVSADEFEYKDPVDGSVSKHQGIRYLFGDGSRLVFRLSGTGSVGATIRIYIEQYEKDSSKTGRASSDALSPLVDVALKFSKIKEYTXGRSAPTVIT

SEQ ID NO: 5439 - protein, 396 aa, Triticum aestivum
MAPRAGGQTYGFPIYCASWLPLAHIIKPSPSADDVVDADASPAPSSPPPPPMVALGGGGGEGRSGVPNALVVAALDPAAAGAPPALSPEPVFRLGTEEQVPYRMAVHPRGDGVLCAFPNGCRLVRWESPEGDDPHSLVLRSDQEALVKLKDVGLQLAVSFSGEGSLLATGGEDGHLRVFKWPGMETIIEDPDAKTSVKDLSFSSDEKFLVVNRSSGPSRVWDLKSSEAVANLPREQGEIFGFCRFSTKSDNSQILFVTAMQGDYGKIISWNTTSWTRIGSKKVTRDAISAFSVSPDGTLLAIGTIEGTISVLGSRDMRVVVTVKKAHLGIVTTLAFSQDSRALLSTSFDSTARVTSTESPKSDGISLWSMVLAIILAILAYYYMQHKEDLLAMLPQ

SEQ ID NO: 5440 - protein, 263 aa, Triticum aestivum
  misc_feature (31)..(32): Xaa can be any naturally occurring amino acid
  misc_feature (206)..(206): Xaa can be any naturally occurring amino acid
  misc_feature (210)..(210): Xaa can be any naturally occurring amino acid
  misc_feature (226)..(226): Xaa can be any naturally occurring amino acid
TGRLQRSPPSRVFRLGTEERVPYRMAVHPRXXDGLLCAFPDGCRLVRWESPEGEDRHSLVLISDQEALVKLKDVGLQLAVAFSGEGSLLATGGEDGHLRVFKWPGMETIIEDPDAKTSVKDLSFSSDEKFLVVNRSSGPSRVWDLKSSEAVANLPREQGEIFGFCRFSTKSDNSQVLFVTAMQGDYGKIISWNTTSGTRIGSKKVXQFQXMTNDRYGDHLFRENTXGTIEGSISVLGSRDMRVVVTVKKAHLGIVTTLAFSQD

SEQ ID NO: 5441 - protein, 248 aa, Triticum aestivum
  misc_feature (80)..(80): Xaa can be any naturally occurring amino acid
MAPRKFFVGGNWKCNGTGDDVKKIVTVLNEAEVPSEDAVEVVVSPPFVFLQQATGLLRPDFPRAARLGWRRGGGAFTGRXSVPEMLVNLQVPGVILGHSERRALLNESSDFVADKVAYALAQGLKVIACIGETLEQREAGTTMEVVAAQTKAIAEKISDWTNVVLTYEPVWAIGTGKVHDGLRKWLQANVGPAVAESTRIIYGGSVNGANCKELAAQPDLDGFLVGGASLKPEFVDIIKSATVKSASA

SEQ ID NO: 5442 - protein, 180 aa, Triticum aestivum
  misc_feature (109)..(109): Xaa can be any naturally occurring amino acid
  misc_feature (118)..(118): Xaa can be any naturally occurring amino acid
  misc_feature (145)..(145): Xaa can be any naturally occurring amino acid
  misc_feature (161)..(161): Xaa can be any naturally occurring amino acid
PCDFIGVVKSQQPVYLKGETVSNHDELMSNFFAQPDALAYGKTPEQLHSEKVPENLIPHKTFKGNRPSLSLLLPTLSAYEVGQLLSIYEHRIAVQGFIWGINSFDQVGXVELGKSLRXSSKWRKQLHGNPGWEGKPVGGFNHSTXSLLARYLAVQPPPRYXTTVLPKCITQLFAAMPIAS

SEQ ID NO: 5443 - protein, 295 aa, Triticum aestivum
HYRTSLYKKAGWYRSGIPGISSTHASDRVDAFKSTMVSDDGTRFSVVNTSGDTVPVYHFLNTSTFAEYTVLDAACAVKINPAAPLEKMCLLSCGISTGVGAAWNTANVSKGSTVAIFGLGAVGLAVGEGARIRGASRIIGVDINPEKFAKGKEMGITDFVNSKACGKPVHEVIRELTDGGVDYSFECSGNVDVLREAFVSTHDGWGLTVVLGIHPTPRMMPLHPMELFDGRRITGCTFGDFKGKSQLPLLVDQCMQGEVKINFDGFITHEMPFSEINEAFRLLEEGKSLRCVLRL

SEQ ID NO: 5444 - protein, 159 aa, Triticum aestivum
  misc_feature (130)..(130): Xaa can be any naturally occurring amino acid
KRHWVDEMGNSCFMLLPRGLSIAWAEEPSYWAWLPPSPGEGSAGAAAGEEVAELKNVWSLEVHGKLDLSQLTPEVTYEVAFEVMLKQGCAGWQVPVDLQLELPGAWAQERKESLEKKARGQWLPLKVGNXEVEKGQQGGELLVTMSQDGGHWKSGLVVR

SEQ ID NO: 5445 - protein, 92 aa, Triticum aestivum
MWFRGESAVDCGSLASMPDIAFTIGGKKFKLKPEQYILKVGEGQAAQCISGFTAMDIPPPRGPLWILGDVFMGVYHTVFDYGKLRVGFAESA

SEQ ID NO: 5446 - protein, 104 aa, Triticum aestivum
FRGESAVDCGSLASMPDIAFTIGGKKFKLKPEQFILKVGEGQAAQCISGFTAMDIPPPRGPLWILGDVFMGVYHTVFDYGKLRVGFAESAYGYGLAATRPEANA

SEQ ID NO: 5447 - protein, 169 aa, Triticum aestivum
  misc_feature (120)..(120): Xaa can be any naturally occurring amino acid
  misc_feature (139)..(139): Xaa can be any naturally occurring amino acid
  misc_feature (147)..(147): Xaa can be any naturally occurring amino acid
MASGGVLPLASLNHISIVCSSVEESLRFYMNVLGFIPIRRPGSFNFNGAWLFNYGIGIHLLQCEEPQSLPGKTEINPKDNHISFQCESMMAVERRLKELGIPYIQRCVEEGGIYVDQIFXHDPDGFMIEICNCDNLPVXPLADHTFXHGRLQEGRRRQATAEAGGGTSS

SEQ ID NO: 5448 - protein, 378 aa, Triticum aestivum
  misc_feature (316)..(316): Xaa can be any naturally occurring amino acid
  misc_feature (336)..(336): Xaa can be any naturally occurring amino acid
  misc_feature (345)..(345): Xaa can be any naturally occurring amino acid
  misc_feature (353)..(353): Xaa can be any naturally occurring amino acid
RSDTCELVARFCYGLTIELSPANIVHLRCAAEYLEMTEETAQDNLIHQAEMFFNQVVLRSWKDSLEALKTCDVLPHAEDLHIAKRCVESLAAKASIDPDLFGWPVSEHGAMHSPGGSVLWNGISTGAKLGNFSSDWWYDDASSLSFPTYKRLISTMESRGAKEEIVAGSLTYYAKKCLPGLNRRQSMGPVPLTSAAATLSEEEQRHLLEDIDRMLPLQRGLISTNVLLWLLRTAMILKVNRACISNLEKRVGMQLDEATLEDLLLPNFSYTMDTLYNVECVRRILDHFLAMGQTMGGGSPCLNDVMGSPSLARITXVAKLIDGYLAEIGPNITLSXPKFESLACXLAEIARPXNYGLYRAISFLGRAIWLRESRGGFW

SEQ ID NO: 5449 - protein, 156 aa, Triticum aestivum
ACTKNVFISSFAEIPGSFVSIMIVDRIGRRLSMASMLFTSCVFLFPLVFSRTEILTRISLFGARLCISASFTIVYIYAPEIYPTSVRTTGIGVASSVGRIGGILCPLVAVALVHNCHQTTAILLFELVVFLSGVAVMFFPFETKGCRLNDTEADMH

SEQ ID NO: 5450 - protein, 338 aa, Triticum aestivum
MSVSNIGMMDGAYFVGRNEILAWINTTLQLGLAKVEEAASGAVACQLMDAAHPGAVPMHKVNFDAKNEYDMIQNYKVLQDVFNKLKITKHIEVNKLIKGRPLDNLEFMQWMKRYCDSVNGGFMTSYNASERRESSKGGKDTNRRTSGTSQAPAKSASATHKAQPPSHAAKRANGHASNAPQRCAKPPPAYDAQMTELKLLVDSAEKERDFYFSKLRDVEILCQSPEVEHLPIAKAIQKILYASEDDPSTVAEAQAEMVAQQNQMQQQPMLSPILEASEAPSITPKDSSEESLRQEAAAAHKRKSISDLEEFEMGSSSRMRLSDVSDVQLCGSPLMSFT

SEQ ID NO: 5451 - protein, 173 aa, Triticum aestivum
  misc_feature (69)..(69): Xaa can be any naturally occurring amino acid
  misc_feature (109)..(109): Xaa can be any naturally occurring amino acid
  misc_feature (111)..(112): Xaa can be any naturally occurring amino acid
  misc_feature (124)..(125): Xaa can be any naturally occurring amino acid
  misc_feature (131)..(131): Xaa can be any naturally occurring amino acid
  misc_feature (136)..(136): Xaa can be any naturally occurring amino acid
  misc_feature (162)..(162): Xaa can be any naturally occurring amino acid
  misc_feature (164)..(164): Xaa can be any naturally occurring amino acid
  misc_feature (166)..(166): Xaa can be any naturally occurring amino acid
IVMGLLVLTMGQDLPDGNLASLQKKGDMAKDKFSKVLWGAVTNYRTWIFVLLYGYCMGVELTTDNVIAXYYYDHFHLDLRAAGTIAACFGMANIVARPMGGYLSDLGAXYXXMLLASGNIWILXXPLGGAXCIWLXRASAPPASIDCHGLLLICAQAAMWCXFXVXQFFGPLG

SEQ ID NO: 5452 - protein, 173 aa, Triticum aestivum
  misc_feature (79)..(79): Xaa can be any naturally occurring amino acid
MAPTVMASSATSVVPFQGLKSTAGLPVSRRSNGASLGSVRNGGRIRCMQVWPIEGIKRWETLSYLPPIRTEALLRQVDXLIRSKWVPCLEFSKVGFIFREHNASPGYYDGRYWTMWKLPMCGCTDPTQVINEVEEVKKEYPDAYVRIIGFDKLRQVQSVSFIAFKPPGCKESG

SEQ ID NO: 5453 - protein, 234 aa, Triticum aestivum
  misc_feature (34)..(34): Xaa can be any naturally occurring amino acid
  misc_feature (157)..(157): Xaa can be any naturally occurring amino acid
KVQTLAGSALIPPSMKRTSGEYLVKNGVRTFACXSETVKFGHVTFFWNGNRSGYFDETREEYVEIPSDSGITFNEQPKMKALEIAEKTRDTILSGKFDQVRINLPNGDMVGHTGDIEATVVACKAADEAVKMVLDAVEQVGGIYLVTADHGNAEDMXQRNKAGEPMLDKSGSIQILTSHTLQPVPVAIGGPGLHPGVRFRSDIPRPPARAAARNHYCGRLQVDHMWRAPNALDA

SEQ ID NO: 5454 - protein, 178 aa, Triticum aestivum
AAAAATSAAAHSSPPAKEEPAAAAEAKPASSGEAVSLNYEEARALLGRLEFQKGNVEDALCVFDGIDLQAAIERFQPSSSKKTTEATLVLEAIYLKALSLQKLGKSIEAAKQCKSVIDSVESMFKNGTPDIEQKLQETINKSVELLPEAWKKAGSLQETFASYRRALLSPWNLDEECI

SEQ ID NO: 5455 - protein, 161 aa, Triticum aestivum
  misc_feature (107)..(107): Xaa can be any naturally occurring amino acid
REQKLELHRGGGRSRTSGSPGLQEFGTSFAQPDALAYGKTPEQLHSEKVPENLIPHKTFQGNRPSLSVMLSSLSAYEIGQLLSIYEHRIAVQGIIWGINSFDQWGVXLGKSLASTVRKQLHASRMEEKPVEGFNPTSASLLTRFLTVKPSTSYNTTVLPKV

SEQ ID NO: 5456 - protein, 298 aa, Triticum aestivum
GNAQAFNLTALRKLNDVKSTDGGTTLLHFVIEEVVRAEGKRLAVNRNYTIRRSGSLAKSSVDGGISAAGSAGQGPSREDRQNEYLNLGLPIVGGLSSEFANVKKAATVDYDVTANECTILGNRLAGIKKLLETCGDDGFSRGLRGFVNAAEQELKALSGVQEKVLDLVQRTTEYYHAGATKDRNAHPLQLFVIVRDFLGMVDQACVDIKRRLQQQKKPTPPSSQPTTAAAAKGPAEAAKGAPDGAKAVAGGAAAAPPAQKPPPEEADSKRKRVMPRFPNLPAHFMKDGADSDSSSDEE

SEQ ID NO: 5457 - protein, 116 aa, Triticum aestivum
MASPALISDTDQWKALQAHVSAIHKTHLRDLMTDADRCKAMTAEFEGVFLDYSRQQATTETVDKLFKLAETAKLKEKIDKMFKGEKINTTENRSVLHVALRAPRDAVINSDGVNVV

SEQ ID NO: 5458 - protein, 158 aa, Triticum aestivum
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLADVPLAHGGVIPKINPVLLPKRTAEKEGKEPKSPKKTTKSPKKTTKA

SEQ ID NO: 5459 - protein, 156 aa, Triticum aestivum
MEVSGAAAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTSEKEGKEPKSPKKATKSPKKATKA

SEQ ID NO: 5460 - protein, 157 aa, Triticum aestivum
  misc_feature (59)..(59): Xaa can be any naturally occurring amino acid
MEASGAAAKGKKGAAGRKAGGPRKKSVTRSVKAGIQFPVGRIGRYLKKGRYAQRVGTGXAPVYLAAVLEYLAAELLELAGNAAKDNKKSRIIPRHLLLAVRNDEELGKLLAGVTIAHGGVIPKINPVLLPKRTAEKEGKEPKSPKKATKSPKKATKA

SEQ ID NO: 5461 - protein, 294 aa, Triticum aestivum
MGGEWWRKKWVAWAAAAAIFVVLMLVTPAIPQDKDYHDFADQRVLFLGIPNTLNVISNIPFLFVGLAGLILCHYKNYFRLCSQGELWSWTLFYAGVTAVGVGSSYYHLYPNDATLVWDRLPMTIAFTSIVAIFIIERVDDRAGTKSLAPLVIAGALSILYWSFFDDLRPYAIIQFVPCIVIPVMAIVIPPMYTHSSYWLWAAGFYLLAQVEEAADQPIYRWTHDLVSGHTLKHLCAAMVPVFLTLMLAKRTIEPDRVSLLQMWKISWRERGSQDSNPVDVKYDYAAVSTTSEQQ

SEQ ID NO: 5462 - protein, 294 aa, Triticum aestivum
MDGEWWRKKWVAWAAAAAIFVVLMLVTPAIPQDEDYHDFADQRDLFLGIPNTLNVLSNIPFLFVGLAGLILCHYKNYFRLCSQGELWSWTLFYAGVTTVGVGSSYYHLYPNDATLVWDRLPMTIAFTSIVAIFIIERVDDRAGTKSLAPLVIAGALSILYWSFFDDLRPYAIIQFVPCIVIPVMAIVIPPMYTHSSYWLWAAGFYLLAKVEEAADKPIYRWTHDIVSGHTLKHLCAAMVPVFLTLMLAKRTIEPDRVSLLQMWKISWRERGSQDSNTVDVKYDYAAVSTTSEQQ

SEQ ID NO: 5463 - protein, 160 aa, Triticum aestivum
  misc_feature (2)..(2): Xaa can be any naturally occurring amino acid
  misc_feature (7)..(7): Xaa can be any naturally occurring amino acid
  misc_feature (10)..(10): Xaa can be any naturally occurring amino acid
  misc_feature (17)..(17): Xaa can be any naturally occurring amino acid
  misc_feature (22)..(22): Xaa can be any naturally occurring amino acid
  misc_feature (24)..(24): Xaa can be any naturally occurring amino acid
  misc_feature (37)..(37): Xaa can be any naturally occurring amino acid
  misc_feature (45)..(45): Xaa can be any naturally occurring amino acid
  misc_feature (69)..(69): Xaa can be any naturally occurring amino acid
  misc_feature (72)..(72): Xaa can be any naturally occurring amino acid
  misc_feature (76)..(76): Xaa can be any naturally occurring amino acid
  misc_feature (94)..(94): Xaa can be any naturally occurring amino acid
  misc_feature (118)..(118): Xaa can be any naturally occurring amino acid
  misc_feature (132)..(132): Xaa can be any naturally occurring amino acid
  misc_feature (139)..(139): Xaa can be any naturally occurring amino acid
  misc_feature (151)..(151): Xaa can be any naturally occurring amino acid
MXPTVMXSSXNSVAPFXGLKSXAXLPVSRRSNGASLXSVSNGGRXRCMQVWPIEGIKKFETLSYLPPLXTEXLLKXVDYLIRSKWVPCLEFSKXGFIFREHNASPGYYDGRYWTMWKXPMFGCTDATQVINXVEEVKKXEYPDAYVRINRXSTTMRQGAV

SEQ ID NO: 5464 - protein, 79 aa, Triticum aestivum
  misc_feature (3)..(3): Xaa can be any naturally occurring amino acid
CRXFGTRGDLILCRLSKNRRVTLQEFKGKTLVSIREYYFKDGKELPTSKGMSMTVEQWETFSKSVPAIEDAVKTLGESD

SEQ ID NO: 5465 - protein, 107 aa, Triticum aestivum
  misc_feature (30)..(30): Xaa can be any naturally occurring amino acid
  misc_feature (59)..(59): Xaa can be any naturally occurring amino acid
  misc_feature (95)..(95): Xaa can be any naturally occurring amino acid
  misc_feature (98)..(98): Xaa can be any naturally occurring amino acid
  misc_feature (104)..(104): Xaa can be any naturally occurring amino acid
SCRIRHEKESSSRITSSRYLGGKWGKAAKXKELPASLPTASVNVDEDDVHVSMSCGSTXNVKSARNVLQEVRTQTPPEMFDLSKIVCGTYIDPRXMVXPGLRGXLII

SEQ ID NO: 5466 - protein, 240 aa, Triticum aestivum
  misc_feature (83)..(83): Xaa can be any naturally occurring amino acid
MAAPTSSASACSGERWPPLESSPEVFNQFMWSLGVPRGEAEFHDVYGLDADALAMVPQPVLAVVFCFPDPPEDPSRPSRTSLXTEDKESLDGVYFIKQIDSLGNACGTIALLHAVGNACSEISLLENSGLDLFFKSTASMDPYERARVLEKDDDMARAHSLAANAGDTEIGDIVEEHYVCFTTLNGTLYELDGIKGGPIKHGPSSPESLLQDAVNVIKAMMQRIPNSVNFNAMVLSRKLK

SEQ ID NO: 5467 - protein, 436 aa, Triticum aestivum
ALPLPPPPQPCTWRLPASPADHSRKSQPSPDVPSGRVTEIPGETSVLDAVRILSEHNIRAAPVLNPEPGAPADWQGRYLGIIEYSAIILWVLDNADLAAVALSAGSATAAGVGMGAVGAVGVAALGATGPAAVAGLTAAAVGAAVAGGLTAEKGVAKDGVTAADHLGEDFYKVLLQQEPFKSTTVRSIVESYPWSPFVPVTLDSSMLAVLLLLSKYRLRNVPVIEPDKPVIKNFITQTGVVKGLQQCKGRDWFDYISALPLSDLGLPFMSLDEVITVNSDDLILEAFKCMKDNKIGGVPVVEGPKRKLVGSVSIRDIRFLLLRPDLFSDFRHLTVLEFMNALGSTLPDSGGNGLVKPPLTCAPDASMGSVIDSIGSRITHRIYVVDGDFEVVGVVTLRDVISCFIHEPPGFCDSYLASAMEKLEDKGDADSSVENS

SEQ ID NO: 5468 - protein, 210 aa, Triticum aestivum
MARPEENAKFPSCDAYFDTIQSKKKLPLALQESLTAAFAQIPVASFPDVPSGRVTEIPGETSVLDAVRILSEHNIRAAPVLNPEPGAPADWQGRYLGIIEYSAIILWVLDNADLAAVALSAGSATAAGVGMGAVGAVGVAALGATGPAAVAGLTAAAVGAAVAGGLTAEKGVAKDGVTAADHLGEDFYKVLLQQEPFKSTTVRSIVESYP

SEQ ID NO: 5469 - protein, 393 aa, Triticum aestivum
MSVTRVLALLVAAALAAAAPARVGAAGACAAERFSKNRVYAACTDLPTLGASVHWTYDPAASSLSVAFVAAPPSSGGWVAWGLNPSGDGMSGTQALVASPTGSGGAYGVQTFDIQGTSLGSPGPIAYKTSDLAAEVGADGRVQMFGKLALQNGTGEVNQVWQVGPASGGSIGIHAMAAANMGAKGKLNLVTGATTAVSGGSILRKKNTHGILNAVSWGILLPMGGIVARYLKTFKSADPAWFYLHVACQLIGYAVGVSGWATGIHLGNLSKGITYSLHRNIGIAVFALGTVQIFALFLRPKKDHKLRVYWNVYHHSVGYTIIILGIVNIFKGMSILDVAQKWKTGYIIAIGILGGVAVALEVITWAIVLKRRKTEDKAYNGGASNNNNGHLPM

SEQ ID NO: 5470 - protein, 346 aa, Triticum aestivum
  misc_feature (311)..(311): Xaa can be any naturally occurring amino acid
MAKPISIEVWNPSGKYRVVSTKSMPGTRWIKLLTDNDCRLEICTEKKTILSVDDILALIGDHCHGVIGQLTEDWGEVLFSALKRAGGTAFSNMAVGYNNVDVDAANRNGIAIGNTPGVLTETTAELAASLSVAAARRIVEADQFMRAGLYDGWLPHLFVGNLLKGQTVGVIGAGRIGSAYARMMIEGFKMNLIYFDLYQSTRLEKFVTAYGQFLKANGEQPVTWKRASSMEEVLREADVISLHPVLDKTTYHLINPERLAMMKKEAVLVNASRGPVIDEVALVEHLRANPMFRVGLDVFEDEPYMKPGLAXLKNCVVVPHIASASKWTREGMATLAALNVLVSFLG

SEQ ID NO: 5471 - protein, 284 aa, Triticum aestivum
  misc_feature (75)..(75): Xaa can be any naturally occurring amino acid
  misc_feature (120)..(120): Xaa can be any naturally occurring amino acid
TRLVPAPEFPRILLNQRGPELGAGDTSTGTEGLNSIPRCTTQGPSVLPIGKHQPLPAPAATPAKIAPSILSSELXNLASKPEGMVPLGADWLNMDVMDGHFVHNLPIGAPVIVGSRKHTXAYLDCHLMVTNPSDYVEAFGKAGASGFTFHIEVTRDNWKELIQSIKAKGMRPGVSLKPGTPVEDVFPLVEAETPVELVLVMTVEPGFGGQKFMPEMMDKVRTLRKKHPSLDIEVDGGLGPSTIDAAASAGANCIVAGSSVFGAPDPGEVISALRKSVEASQIKS

SEQ ID NO: 5472 - protein, 146 aa, Triticum aestivum
  misc_feature (112)..(112): Xaa can be any naturally occurring amino acid
  misc_feature (138)..(138): Xaa can be any naturally occurring amino acid
  misc_feature (140)..(140): Xaa can be any naturally occurring amino acid
MAAAAAAAAKIAPSMLSSDFANLASEAERMVRLGADWLHMDVMDGHFVPNLTIGAPVIESLRKHTKAYLDCHLMVTNPSDYVEAFGKAGASGFTFHIEVTRDNWKELIQSIXKAKGMRPGVPLKPGTPVEDVFPWGEXEXPVELVS

SEQ ID NO: 5473 - protein, 230 aa, Triticum aestivum
  misc_feature (121)..(121): Xaa can be any naturally occurring amino acid
  misc_feature (220)..(221): Xaa can be any naturally occurring amino acid
MAAAAKIAPSMLSSDFANLASEAERMVRLGADWLHMDVMDGHFVPNLTIGAPVIESLRKHTKAYLDCHLMVTNPSDYVEAFGKAGASGFTFHIEVARDNWKELIQNIKAKGMRPGVSLKPXGTPVEDVFPLVEAETPVELVLVMTVEPGFGGQKFMPEMMDKVRTLRKKHPSLDIEVDGGLGPSTIDAAASAGANCIVAGSPCSARPTPGEASPALRKSXXGVARKTDHL

SEQ ID NO: 5474 - protein, 209 aa, Triticum aestivum
  misc_feature (131)..(131): Xaa can be any naturally occurring amino acid
MAAAAAAAAKIAPSMLSSDFANLASEAERMVRLGADWLHMDVMDGHFVPNLTIGAPVIESLRKHTKAYLDCHLMVTNPSDYVEAFGKAGASGFTSRIEVPGDNWKELIQSIKAKGMRPGASFKPGSPVEHXFPLLEAETPPEFVPVMTVEPALGGPKFMPESSDIVRTLRKKHRPPTLTRRAVSHPPPASLIRLPVPGKSRRHSLIAVC

SEQ ID NO: 5475 - protein, 226 aa, Triticum aestivum
MAAAAKIAPSMLSSDFANLASEAERMVRLGADWLHMDVMDGHFVPNLTIGAPVIESLRKHTKAYLDCHLMVTNPSDYVEAFGKAGASGFTFHIEVARDNWKELIQSIKAKGMRPGVSLKPGTPVEDVFPLVEAETPVELVLVMTVEPGFGGQKFMPEMMDKVRTLRKKYQSLDIEVDGGLGPSTIDAAASAGANCIVAGSSVFGAPDPGQVISALRKSVEASQIKS

SEQ ID NO: 5476 - protein, 187 aa, Triticum aestivum
MSVAWRLLSSNTMAPTVMGSSATSVAPFQGLKSTAGLPISRRSSSAGLSSVSNGGRIRCMQVWPIEGINNFESVGDLLPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 5477 - protein, 192 aa, Triticum aestivum
  misc_feature (36)..(36): Xaa can be any naturally occurring amino acid
  misc_feature (70)..(70): Xaa can be any naturally occurring amino acid
  misc_feature (148)..(148): Xaa can be any naturally occurring amino acid
RRPTPSVPGSRSNNTLPWSPAVMASSATTGAPFQGXKSTAGLPVGRRSSGSLGSASHGGWIMCMQVWPIXGIKKFETLSYLPPLSTEALLKQVDYLIRSKWVPCLKFNKVAFLFREHNSFPGYYDGRYWTMWKLPMFWCTDTTQVLNXEVEDVKKEYPDSYIRVIRLDNLRQLQCVIFIAFRPSGCEEYDKA

SEQ ID NO: 5478 - protein, 162 aa, Triticum aestivum
  misc_feature (58)..(58): Xaa can be any naturally occurring amino acid
  misc_feature (78)..(78): Xaa can be any naturally occurring amino acid
  misc_feature (81)..(81): Xaa can be any naturally occurring amino acid
  misc_feature (94)..(94): Xaa can be any naturally occurring amino acid
  misc_feature (100)..(101): Xaa can be any naturally occurring amino acid
  misc_feature (124)..(124): Xaa can be any naturally occurring amino acid
  misc_feature (136)..(137): Xaa can be any naturally occurring amino acid
  misc_feature (141)..(141): Xaa can be any naturally occurring amino acid
MAPTVMASSATSVAPFQGLKSTAGLPISRRSSSAGLSSVSNGGRIRCMQVWPIEGIKXFETLSYLPPLSTGGLLKQVXDYXIRSKWVPCLRFSXVGFVLXXEHNTPPGYYDVHTGKCWELPMFXGCTDAHKCQQVXXVKKXYLTLFPLIFTAPSACLRLHRF

SEQ ID NO: 5479 - protein, 141 aa, Triticum aestivum
  misc_feature (71)..(71): Xaa can be any naturally occurring amino acid
  misc_feature (76)..(76): Xaa can be any naturally occurring amino acid
  misc_feature (79)..(79): Xaa can be any naturally occurring amino acid
  misc_feature (89)..(89): Xaa can be any naturally occurring amino acid
  misc_feature (94)..(95): Xaa can be any naturally occurring amino acid
  misc_feature (100)..(100): Xaa can be any naturally occurring amino acid
  misc_feature (109)..(109): Xaa can be any naturally occurring amino acid
  misc_feature (126)..(126): Xaa can be any naturally occurring amino acid
  misc_feature (131)..(131): Xaa can be any naturally occurring amino acid
  misc_feature (133)..(134): Xaa can be any naturally occurring amino acid
  misc_feature (136)..(136): Xaa can be any naturally occurring amino acid
MAPAVMASSATTVAPFQGLKSTAGLPVSRRSSGSLGSVSNGGRIRCMQVWPIEGIKNSKTLSYLPPLSTEXLLKQXDYXIRSKWVPCLXSTRLXXLPFSXNIPPGYYDXPYWTIWKLLCSGCTDAXTSVNXVXXVXKDYPE

SEQ ID NO: 5480 - protein, 117 aa, Triticum aestivum
  misc_feature (60)..(60): Xaa can be any naturally occurring amino acid
  misc_feature (72)..(72): Xaa can be any naturally occurring amino acid
MAPAVMASSATTVAPFQGLKSTAGLPVSRRSSGSLGSVSNGGRIRCMQVWPIEGIKKFEXTLSYLPPLSTEXLLKQVDYLIRSKVGACLQFSKGLLRPLSKKPPGLLVEYWDKCWLP

SEQ ID NO: 5481 - protein, 174 aa, Triticum aestivum
  misc_feature (141)..(141): Xaa can be any naturally occurring amino acid
  misc_feature (145)..(145): Xaa can be any naturally occurring amino acid
  misc_feature (159)..(159): Xaa can be any naturally occurring amino acid
MAPAVMASSATTVAPFQGLKSTAGLPVSCRSGSTGLSSVSNGGRIRCMQVWPIEGIKKFETLSYLPPLSTEALLKQVDYLIRSKWVPCLEFSKVGFVFREHNSSPGYYDGRYWDNVGKLPMFGCTDAHSAQRGGGVKKEYXDAYXRVIGFDNIASECVXLNAFRHKAARNPGKA

SEQ ID NO: 5482 - protein, 175 aa, Triticum aestivum
MAPAVMASSATTVAPFQGLKSTTGLPISRPSGSAGLSNVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 5483 - protein, 144 aa, Triticum aestivum
  misc_feature (24)..(24): Xaa can be any naturally occurring amino acid
IQEGQDWGATLLIFKLNRALCVQXWSPKENKFAVGSGAKSACICYYEQENNCRIQFGTTASPMQTTWGSSCQAPRCCFHATAAAATETTTMNPSPCLQCLLSARRGHPAKAMSANPEAGMHTPEGHPHHLLPLPCSPIRRQDIE

SEQ ID NO: 5484 - protein, 222 aa, Triticum aestivum
MAAAAGDEPETTVEVKLRAVGPSRPTTIRLPPLISVADLRRSVALDRRLPEDRLRLVLRGTTLPWGDDTHVNLRDGDSLIVAVAPKPPAKHLRGDDDDDDDDDEEELKFKIPQTTTWWKKRIFIFLREKLRLPDILLMALFSVTMKAWIIITLWFLLAPIARKYEVGPLYILATGFLIILLNLGRRQQGDISAYSIFNEDFREIPGTFNAERIDRDLRAGQL

SEQ ID NO: 5485 - protein, 134 aa, Triticum aestivum
  misc_feature (91)..(91): Xaa can be any naturally occurring amino acid
THVKLRDGDSLIVAVAPKPPAKHLRGDDDDDDDDDEEELKFKIPQTTTWVEEKDFHISSEKNWRLPDILLMALFSVTMKAWIIITLWFLLXPIARKYEVGPLYILATGFLIILLNLGRRQQGDISAYSIFNEDF

SEQ ID NO: 5486 - protein, 137 aa, Triticum aestivum
  misc_feature (56)..(56): Xaa can be any naturally occurring amino acid
  misc_feature (64)..(64): Xaa can be any naturally occurring amino acid
  misc_feature (69)..(69): Xaa can be any naturally occurring amino acid
  misc_feature (114)..(114): Xaa can be any naturally occurring amino acid
  misc_feature (124)..(124): Xaa can be any naturally occurring amino acid
  misc_feature (126)..(126): Xaa can be any naturally occurring amino acid
  misc_feature (129)..(129): Xaa can be any naturally occurring amino acid
LLSEAALALEAEVLKNPDNAEGWRLLGVTHAENDDDQQAIAAMLRAQEANPTNLEXVLLALGVXSHTNXFGQGRSIKDTFPRWVQEHPKVWSLRRSPTKLINIWPDVGKLFNEXQVSPEEPDVXIXLGXLDNLIKEI

SEQ ID NO: 5487 - protein, 570 aa, Triticum aestivum
MPAAHSLLHLAAPKSVAPTSTLSLAGAAHLRLLPSRRPQRLVASCSSAHPDLAAFPNPNGLLVAEPAAAAPIDIDVATEAELRENGSRSTRRTKLVCTVGPATCGPSELEALAVGGMNVARLNMCHGDREWHQKVISSVRMLNEEKGYAVAVMMDTEGSEIHMGDLGGAPAAKAEDGEIWTFSVRSFEAPLPELTVHVNYEGFAEDVRVGDDLLVDGGMARFEVVEKLGPDVKCRCTDPGLLLPRANLTFWRDGSVVRAKNAMLPTITSKDWLDIDFGIAEGVDFIAVSFVKSAEVINHLKSYIAARSRGSDIAVIAKIESIDSLTNLEEIIRASDGAMVARGDLGAQIPLEQVPSIQQPIGKLCRQLNKPVIVASQLLESMIEYPIPTRAEVADVSEAVHQRADALMLSGESAMGRYPDKALIVLSSVSLRIERWWREEKHHEPLELEDVSSSFSDKISEEICISAAKMANKLEVDAVFVYTKGGHMASLLSRCRPDCPIFAFTNSTSVRRRLNLQWGLIPFRLTFSDDMESNLNRTFSLLKARGMIKSGDLVIALSDMLQSIQVMNVP

SEQ ID NO: 5488 - protein, 474 aa, Triticum aestivum
MAAIDEASGRRAASCFFEVGQREIGSSSSRRISGSEGLILRMNQYGKLRGHSGCVNTISFNPAGDLLVSGSDDTDIILWDWLAKTEKLTYPSGHQQNVFHARVMPFTDDSTIVTVGADGQVRVGQLKQGGGFTTKQIGEHHDRAHKMALEPGSPHILYSCGEDGLVQHFDLRSDSPTKLLTCYSFSNRRRRVRLNTIAIDPQNPNYFSIGGSDEYVRLYDFRKINLESSSNMNLPVDTFCPKHLLMGGKVHITGIAYSYSSELLVSYNDELIYLFQNYMGLGPNPESTPPEHLDKLEQLQSYSGHRNFRTVKGVSFFGPNNEYVLSGSDCGHVFIWRKKEGELMRIMRGDKHIVNCIEPHPHFPFLATSGIDNTIKIWTPSSSKVMQLPQYANKVIASNARERQFYASRGEMTLSADVMMRILRLQSTQSELYANHEPSAADFATGGDETFFIGLGDGDGNQRSNSDPRECIVT

SEQ ID NO: 5489 - protein, 345 aa, Triticum aestivum
  misc_feature (258)..(258): Xaa can be any naturally occurring amino acid
  misc_feature (307)..(307): Xaa can be any naturally occurring amino acid
MGICFSSSHAQLQRTCSRSTRRHLLSFRPIQVTMMNKFVQKSRLVPVRNSRDIVDPRVRRKETPPNPISSPPLPSARPNPIRSPPSSSVAMGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIADKIKDWTNVVVAYEPXVWAIGTGKVASPAQAQEVHANLRDWLKTNVSPEVAESTRIIYGGSVTGXASCKELAAQPDVDGFLVGGASLKPEFIDIINAAAVKSA

SEQ ID NO: 5490 - protein, 283 aa, Triticum aestivum
MAKDIEAAPPGGGYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGYSTGTGLAAEIIGTFVLVYTVFSATDPKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 5491 - protein, 137 aa, Triticum aestivum
PRPRSAPLQIRAAAGKMFDDQDLGFFTNFLGIFIFVLVIAYHFVMSRPSNRGVVTKTCNPGPRLLLLFLPATRQFQRSALGSQVQRRGDDGERDRERAQSPYRSARRPARCLTIKTWVSSPTSWGSSSLCWSSRTTL

SEQ ID NO: 5492 - protein, 385 aa, Triticum aestivum
  misc_feature (42)..(42): Xaa can be any naturally occurring amino acid
  misc_feature (378)..(379): Xaa can be any naturally occurring amino acid
MATRCAAAADLPAGRPRKRARHGWDVAPATKAQITFCGQEVXDMTTLVLPSHPPDYTCFSLLSKGVARNASPPRREDDKDGHYVFAVGENLTSRYKIYRKMGEGTFGQVLECWDRERKEMVAIKIVRAVNKYSDAAMIEIDVLQKLARNDATGKHCVQIRNWFDYRNHICIVCEKLGPSLYDFLRKTAYRPFPIDLVRELGEQLLESVAFMHGLKLIHTDLKPENILLVSSEDAKLAENKDGSFSKKVPKSSAIKLIDFGSTAYDHQDCSYIVSTRHYRAPEVILGHGWSYPCDIWSIGCILVELCSGETLFQTHENLEHLAMMERVLGPLPRHMLERADHHAQKYIRRGRLNWPEGATTRESMRAVLKLPRLQILVXXHVDHSA

SEQ ID NO: 5493 - protein, 372 aa, Triticum aestivum
  misc_feature (278)..(278): Xaa can be any naturally occurring amino acid
FSKSKLRINSVSQVEDGIVYIDIGGPTLIRAAAKNHKDVLVVVDHHDYPALLKYLQEKQADPQFRRMLAWKAFQHVASYDSAVSEWLWKQSNGGDIFPPSFTVPLSMKSTLRYGENPHQKAAFYGDRSLSLVNAGGIATSFQHHGKEMSYNNYLDADAAWNCVSEFENPTCVVVKHTNPCGVASRQDVLEAYRLAVRADPVSAFGGIVAFNTTIDEDLAKEIREFRSPTDGETRMFYEIVVAPGYTEKGLEVLKGKSKTLRILEAKRSGKNMLSLRQXSGGWLAQQSDDLTPEDITFTTGSERAPTDSELSDAKFAPHPVDPAMCYLQNCWTQHQCSSDPEPGSWMQHALSWTGVYGRFHRCKFSNSQDKFR

SEQ ID NO: 5494 - protein, 225 aa, Triticum aestivum
MAKETEYYDALGVSPAASDDEIRKAYYIKARQVHPDKNPDDPQASDKFQALGEAYQVLSDPLQRKAYDGYGKTSISRDNILDGALVFTLLFGSELFEDYIGHLAMATMASSEMASGDNGSAEKLQDRLKGVQREREEKLARFLNKFLSQYVSGDMEGFAHRAESEAKRLSSTSYALDIRRTIGYVYSRQAAKELGKKAMYLGVPFLTEWVRNKGHLWRSQITAAK

SEQ ID NO: 5495 - protein, 189 aa, Triticum aestivum
MAAAAGDEPETTVEVKLRAVGPSRPTTIRLPPLISVADLRRSVALDRRLPEDRLRLVLRGTTLPWGDDTHVKLRDGDSLIVAVAPKPPAKHLRGDDDDDDDDDEEELKFKIPQTTTWWKKRIFIFLREKLRLPDILLMALFSVTMKAWIIITLWSLFAPLAREYEVGPLYILATGFLIILLHLHLTRSA

SEQ ID NO: 5496 - protein, 249 aa, Triticum aestivum
RGFCCCLVPCNCCKTIWKNNILVEYPFWKGSERFNEIVDIKHIRPCPPHASVISFCINDDVEGFQDDGWWPGKITEIHPKLTYTFKLRTSGKKVQLHQNTLRLRYDWTDNQWKQVAQNLSGTKFTGGDRVEVSSDEEGFHGAWFQGTVIKSVGHKFLVEYDALKDDDETTPLKETIGEEHIRPSPPAIPVTSGFKVLDEIDAYTNDGWWVGVISEVLGDQKYKVYFKAYKEQNDFELEQLRRHCDWVGG

SEQ ID NO: 5497 - protein, 517 aa, Triticum aestivum
  misc_feature (375)..(375): Xaa can be any naturally occurring amino acid
PTRPPTRPPTRPLASYRRALLSQWNLDDECCARIQKRFSVFLLYGGVEASPPSLASQTEGSFVPKNNLEEAILLLMILLKKWYLGKTHWDPSVMEHLTFALSLCGQTSVLAKHFEEVLPGIYPRTERWYSLALCYSAASDDEAALNLLKKSLNKNESPNDINALLLAAKICSSDYYLASEGVEYAKRAIGDDELLDGHLRSVGLHLLGSCLANESKIASSDHQRSLLQAEALKSLGEAFSLDRHNPDLIFDMGVEYAEQRNMQAALKCAKQFIDTTGGSVSKGWRLLSLVLSAQQKYSEAEVVTDAALEETTKWEQGPLLRIRAKLKAAQSLPMEAVEAYRALLALVQAQRKAYGSLKNGTEERDNKVSEFEVWXQGLAHLYASLSYCRDAEICLQKAKALKTYSAPTLHAEGDMHEVGEPTQHALAAYLNALSTEVDHVPSQVSIGALLSKPGPKYLPVARSFLSDALRLEPTNRMAWFYLGQVHKHDGRLAEAADCFQAASMLEESEPVESLRPL

SEQ ID NO: 5498 - protein, 137 aa, Triticum aestivum
SIVWSPTMISLFAGYGIAGFMFYTITPFVLEMSGATLLNLSLLTSDMWAVAIRVFFYQQQINWLYYLAFAVVAIGLIIYSLNESSSADATAHKHRSSSSLCTTSQVRIPPQEVVLFWTEKKGSSKKLTSVKGATRSD

SEQ ID NO: 5499 - protein, 396 aa, Triticum aestivum
  misc_feature (317)..(317): Xaa can be any naturally occurring amino acid
MKSALLTAAALLGSAQAGVHKMKLNKVPLADQLAMNSVEDHLQSLGQKYMGAARPKNAADYAFATNVPSVEGGHPVPVSNFMNAQYFSEITIGTPPQSFKVVLDTGSSNLWVPSQECGSIACYLHSKYDSSASSTYKKNGSEFEIHYGSGSLSGFVSNDVVSIGDLKIKDQDFAEATKEPGLAFAFGRFDGILGLGYDRIAVNGMVPPFYQMVNQKLLDEPVFAFYLDGQEGQSEATFGGVDKSKYTGDLEYIPLRRKAYWEVDLDAIAFGDEVAEQENTGAILDTGTSLNVLPSALAELLNKEIGAKKGYNGQYTXECDKVSSLPDITFTLAGSNYSLPSTDYILEVQGSCISTFQGMDFPEPVGPLVILGDAFLRRYYSVYDLGKNPVGLARAK

SEQ ID NO: 5500 - protein, 137 aa, Triticum aestivum
  misc_feature (13)..(13): Xaa can be any naturally occurring amino acid
  misc_feature (35)..(35): Xaa can be any naturally occurring amino acid
VRSFKTLEVACDXLRHSRLFKKLLEAVLKTGNRMXDGSFRGGAQAFKLDTLLKLADVKGLDGKTTLLHFVVQEIIRSEGVRAARSAKEHNSSVFSVSGGTDDLSEDVGDDTEHYKQLGLEMVFGLSDNLQNVRKASI

SEQ ID NO: 5501 - protein, 567 aa, Triticum aestivum
  misc_feature (423)..(423): Xaa can be any naturally occurring amino acid
MASPALISDTDQWKALQAHVGAIHKTHLRDLMTDADRCKAMTAEFEGVFLDYSRQQATTETVDKLFKLAEAAKLKEKIDKMFKGEKINTTENRSVLHVALRAPRDAVINSDGVNVVPEVWAVKDKIKQFSETFRSGSWVGATGKPLTNVVSVGIGGSFLGPLFVHTALQTDPEAAESAKGRQLRFLANVDPVDVARSIKDLDPATTLVVVVSKTFTTAETMLNARTIKEWIVSSLGPQAVSKHMIAVSTNLKLVKEFGIDPNNAFAFWDWVGGRYSVCSAVGVLPLSLQYGFPIVQKFLEGASSIDNHVHTSSFEKNIPVLLGLLSVWNVSFLGYPARAILPYCQALEKLAPHIQQLSMESNGKGVSIDGVRLPFEAGEIDFGEPGTNGQHSFYQLIHQGRVIPCDFIGVIKSQQPVYLKGEXVSNHDELMSNFFAQPDALAYGKTPEQLHSEKVPENLIPHKTFQGNRPSLSFLLSSLSAYEIGQLLSIYEHRIAVQGFIWGINSFDQWGVELGKSLASTVRKQLHASRMEGKPVEGFNPSSASLLTRFLAVKPSTPYDTTVLPKV

SEQ ID NO: 5502 - protein, 140 aa, Triticum aestivum
  misc_feature (19)..(19): Xaa can be any naturally occurring amino acid
  misc_feature (64)..(64): Xaa can be any naturally occurring amino acid
  misc_feature (129)..(129): Xaa can be any naturally occurring amino acid
VNVVTEVWAVKDKIKQFPXKTSKIGQWFGAPGKPLQMVAQFGIGGTSLGLRFVQTVPKTDQKAXKCAKRRQLRFSCNVDPVDGARGIQDLDPATTLVVVVSKNFTTAETMLNARTIKEWIVSALGPQAXSKHMIAVSTNL

SEQ ID NO: 5503 - protein, 241 aa, Triticum aestivum
  misc_feature (114)..(114): Xaa can be any naturally occurring amino acid
  misc_feature (152)..(152): Xaa can be any naturally occurring amino acid
MGESRQELVAWLNSLLQLNITKVEQCGTGAALCQVFDSIYMDVPMSKGKFNVNSEYLYIQNFKGLQNTFAKHQIDKPIPVPSLIKCKMQDNLEFLQWTKRFWDLNFPDHEYDAXSRRKGGSMPPSAAAPKPVSATTGAARRGGSTPSGGPRXAKAAGPATAALQQENATLKETVVGLERERDFYFSKLRDIELLVQTAVDEDPELEKLEDGLVKQIQTILYSTEEGFEIPAEGEVDDQETF

SEQ ID NO: 5504 - protein, 160 aa, Triticum aestivum
  misc_feature (80)..(80): Xaa can be any naturally occurring amino acid
MDVSGTGAGAKAKKGAAGRKAGGPRKKSVTRSVKAGLQFPVGRIGRYLKNGRYAKRVGTGAPVYLAAVLEYLAAELLELXPGTAAKDNKKSRIVPRHLLLAVRNDQELGRLLAGVTIAHGGVLPNINPVLLPKKTAEKEPKEGKSPKKTAKSPKKADKKA

SEQ ID NO: 5505 - protein, 175 aa, Triticum aestivum
KLLGMVTSRDIDFLEGKQNHNIKLENVMTKREDLVVASAGVTLTEANDIIEKSKKGKLPIVNDSDELVALIARTDLKKARSYPDASKDDNKQLLVGAAIGTRENDKERLRLLAAAGVDVVVLDSSQGNSTYQIDMIRYIKQTYPELQVVGGNVVTAAQAKNLIDAGVDGLRVGMG

SEQ ID NO: 5506 - protein, 243 aa, Triticum aestivum
MVSADAARNVVGIIGNVISFGLFLSPTPVFWRIIKAKDVEEFKPDPYLATLLNCMLWVFYGLPIVHPNSILVVTINGIGLVIEGSYLIIFFLYSTNNKRLKMIGVLAAEAAFMVAVVLGVLLGAHTHEKRSMIVGILCVIFGTIMYASPLTIMGKVIKTKSVEYMPFTLSLVNFLNGCCWLAYALIKFDLYVTIPNGLGAFFGLMQLILYGCYYKRTPKEEKSVELPTSNPAGAGNVSVTVDR

SEQ ID NO: 5507 - protein, 440 aa, Triticum aestivum
MEDAAEGKTNVLQGRYELGRVLGHGNFGRVHAARDLRTGRGVAVKVVAKDKVERAGMVEQIKREIAVMKMVSHPNIVELHEVLATRTKIYLALELVRGGELFARISRAGRLREDVARRYFRQLISAVDFCHGRGVYHRDLKPENLLLDEAGNLKVADFGLSALAGHARPDGLLHTACGTPAYVAPEVLGGNGYDGAKADIWSCGVILYVLLVGALPFQDENLMSMYRKMQRGGFLCPSWVSKDARKLIGRLLDPNPSSRITIASLVESPWFKKTSPIPSPLLEPVPPAAARGNGEDKDEPPEALNAFHLISLSAGFDLSPLFDQEPATGRGTRGGVMRFATREPASGVISRLEGLATGGAMRVTKSGARGGRLEGAERGRKGRLGVAAEFFSVAPSVLVVDVKKDGGDTMEYRSFCSDELRPALKDIVWAAAAAAAAFPR

SEQ ID NO: 5508 - protein, 236 aa, Triticum aestivum
MAAAAAAAGARRLLARRASSSPVTISALLRRGGAAAAAAPHEPLLRPAALAAVASRLGFLRGMARRPGGDGYSPARSGGGGGGGDRAPTEMAPLFPGCDYEHWLIVMDKPGGEGATKHQMIDCYIQTLAKVLGSEEEAKRKIYNVSCERYFGFGCEIDEETSNKLEGIPGVLFVLPDSYVDPEHKDYGAELFVNGEIVQRSPERQRRVEPVPQRASDRPRYNDRTRYQRRRENQQR

SEQ ID NO: 5509 - protein, 367 aa, Triticum aestivum
  misc_feature (102)..(102): Xaa can be any naturally occurring amino acid
MARVRSNGRRAGGSGGGGGRGGKGKGKGKGPGKWKMPLSVARKQQAVLANVDQVTGERIPKSFVFSRGKLPSTLRHLQQDLRKLMLPYTALKLKEKKRNNLXRDFVNVASPLGVTHFLILSNPKSLPHLRFAKSPQGPTYTCQILEYALAADIANSQKRPRCPAEIFKNSPLVVLSGFNGLGEPFKSFVTFFRHLVPAIDTDTVKLSTCQRLLLLQYDKETEAIDFRHYSIKLQPVGVSRKIRKLMQNNQVPDLRDLKDVSDYVTKAGYGSESEPDDEAATVSLASDIDKLNRASRKSAVRLQEIGPRMTMRLVKVESGLCSGDILYPQSVGKEDVKEGQEEEEIEDAEDMMELDDGTEEDDSVDEE

SEQ ID NO: 5510 - protein, 122 aa, Triticum aestivum
MSQHFINKDKDGTANSRCTCVAWVPEREGIFVVSNADGNLYVYDKSKDGSADWAFPTVRDQNQLVISHAKSNKSNPTARWHICQGAINAISFSPDGAYMATVGRDGYLRVFDFAKEQLIFGG

SEQ ID NO: 5511 - protein, 222 aa, Triticum aestivum
  misc_feature (86)..(86): Xaa can be any naturally occurring amino acid
GKVKLEVDSAKGGKVESIESDVVLVAIGRRPYTAGLGLENIGLEADDRGRVLIDSEYRTKIPHIRCVGDCTFGPMLAHKAEEEAVXVVEYIKSGYVGVNYGAIPSVMYTHPEVAWVGQSEQDLKSQNIPYRVGSFPFAANSRAKTNIDTEGMVKMLADPETDRILGVHIIGPNAGEMIAEGTLALEYGASSEDIARTCHAHPTLAEAFKEAAMATHAKAIHY

SEQ ID NO: 5512 - protein, 99 aa, Triticum aestivum
  misc_feature (36)..(36): Xaa can be any naturally occurring amino acid
RGSSLMQLPAGNCRVDPRCDPPGGMDCSAHAVEFDXNTGAVRSFKILTDSWCSSGAFDVDGMLVQTGGYFEGVKVVRRLNPQGNADWVEFPNTLAEGRW

SEQ ID NO: 5513 - protein, 72 aa, Triticum aestivum
IVYPLLQLWDVNMDSGPVATFQVHEYLRPKLCDLYENDSIFDKFECCQSGDGLRVATGSYNNVVRVFNCGAG

SEQ ID NO: 5514 - protein, 117 aa, Triticum aestivum
AFRRRSRRWGLPVTRQRSSWCRPVPVGMATSSSASGGGAAGGAPGLKTYFKTPEGRHKLQYEKTHSPSVLHYNHSSGGKTVSQMTVAYLKEKPVGQGSTPSQREHLEFKMLGTGMEP

SEQ ID NO: 5515 - protein, 459 aa, Triticum aestivum
MLGARRSFSRLAAAVRTPVDVPRMPAFDHVPLPYDGPSAVEIARKRAEFLSPSLFHFYSKPLNIVEGKKQYLYDEHGRRYLDAFAGIATVCCGHTHPDIIDAITAQANRLQHSTVLYLNHAIADFAEALAAKMPGDLKVVFFTNSGTEANELAIMMARLYTGSHDIISLRNSYHGNASGTMGATAQKNWKFNVVQSGVHHAVNPDPYRGAFGSDGEKYARDVKEIIDFGTTGHVAGFISEAIQGVGGIVEVAPGYLPLAYDAVRKAGGLCIADEVQAGFARVGSHFWGFETHGVIPDIVTMAKGIGNGIPLGAVVTTPEIAQVLTRRSYFNTFGGNPLCTAGGLAVLKVLDRERLQENAFIVGAYLKDRLRGLQEKHQIIGDVRGTGFMLGVELVTDRQLKTPAKDEICQAMEHMKDMGVLVGKGGFYGNVFRITPPLCFTKEDADFFVDVMDIALSKL

SEQ ID NO: 5516 - protein, 276 aa, Triticum aestivum
  misc_feature (256)..(256): Xaa can be any naturally occurring amino acid
MGMDRTLYLWRSSEERAADMSTRRTEDGAVKCALRHFRRELVTRGLRFMAAAWGGLSPLPGAAAARVLRRPRVRPRVRGRVGKLYTYIVQPWAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFXPPGCEESGKGLNSSLTTGHI

SEQ ID NO: 5517 - protein, 159 aa, Triticum aestivum
HEGTEERDNKVSEFEVWQGLANLYASLSYCRDAEICLQPTRPLKTYSATTLHAEGDMHGVREQTQHALAAYLNALSTEVDHVPSKVSIGALLSKQGPKYLPVARSFLSDALRLEPTNRMAWFYLGQVHKHDGRLAEAADCFQAASMLEESDPVESLRPL

SEQ ID NO: 5518 - protein, 377 aa, Triticum aestivum
  misc_feature (344)..(344): Xaa can be any naturally occurring amino acid
MDTSGGGTAAGGAAQIQGMATHGGRYVLYNVYGNLFEVASKYAPPIRPIGRGAYGIVCAAVSSDTGEEVAIKKIGNAFDNHIDAKRTLREIKLLRHMDHENILAIKDLIRPPRRDDFKDVYIVTELMDTDLHQIIRSNQSLTDDHCQYFLYQLLRGLKYVHSANVLHRDLKPSNLFLNANCDLKIADFGLQRTTSETDLMTEYVVTRWYRAPELLLNCSQYTAAIDVWSVGCILGEIITRQPLFPGRDYIQQLKLITELIGSPDDSSLGFLRSDNARRYMKQLPQYPRQDFRLRFRNMSDGAVDLLERMLVFDPSRRITVDEALHHPYLASLHDINEEPTCPAXPFSFDFEQPSFTEEHMKELIWRETLAFNPDPPY

SEQ ID NO: 5519 - protein, 183 aa, Triticum aestivum
CYSSSLPSPPSIPPAACVQSARLVPDFQSILLTTAAASSPLCARGSSIRLLSQMETPTGPAQAGGRFPVPHRSLSLDIKGNKTDIVISRYEDNFLVIVTQIGCMGTILAAKKDESVFSDPTYDVSVLFGKRDEPLLLACARQLIEHISGSGSARPLVISLGLKDHSQGTLKDVVSAIVDNRLW

SEQ ID NO: 5520 - protein, 156 aa, Triticum aestivum
MATPWDSSSSRLWGALGQASSVAQLVGVDALGLVSMVVQAALAARRHRDACVQLAQHVELVGGLLGELELDELMRREATRRPLEQLGAALRRCYALATACQDCGYLRRLLLGGRMADELCAPHHDVDWFCRLRPLTPLVPFAANSRRAMVNSIEIW

SEQ ID NO: 5521 - protein, 368 aa, Triticum aestivum
VTLITDEDESAPDLDKMGDFNLAHRVVLAPLTRCRSYGNLAQPHNALYYAQRAAPGVLLVAEACAVSEAARGYPHVPGLWSQEQVEAWKPVVDAVHGKGAVFFCQLWHTGRVSPTEFQPNGQAPVSSTDKQVPPQVAHDGSVLEFAPPRRLATEEIPHIVNDFRVAARNAMRAGFDGVEIHAGNGYLIDQFMKDGVNDRTDAYGGGLDNRCRFAAEVIAAVCHEAGAGRVGVRLSPFADYVDCVDSDPEALGLHVIGVMNGLGVLYCHMIEPRMCVNERMIPRRLLPFRRAFRGTFMVNGGYDREEGDKAVVEGYADLVAYGRLFLASPDLPERFGRNAVLNKYDRSTFYTSDPVVGYTDYPFLDPED

SEQ ID NO: 5522 - protein, 167 aa, Triticum aestivum
  misc_feature (92)..(92): Xaa can be any naturally occurring amino acid
DRGLAMLRTRRLRGGFRLGRQLLTAWRWALCGRNRRRGGGGYLRLDTPCPMEGRDAKKLAPVLRWGKSLARLLSLGRADRGQQTPQAVNTPXGQVAVYVGGGGPGEPLRYVVPVVYFNHPSIGELLRTATTPFGFQHPGGITIPCAAATLELAAAVAAAGNPSFAPW

SEQ ID NO: 5523 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 5524 - protein, 189 aa, Triticum aestivum
  misc_feature (64)..(64): Xaa can be any naturally occurring amino acid
  misc_feature (72)..(72): Xaa can be any naturally occurring amino acid
  misc_feature (105)..(105): Xaa can be any naturally occurring amino acid
  misc_feature (144)..(144): Xaa can be any naturally occurring amino acid
  misc_feature (172)..(172): Xaa can be any naturally occurring amino acid
MAPTVMASSATSVAPFQGLKSTAGLPVSRRSNGASLGSVSNGGRIRCMQVWPIEGIKKFETLSXYLPPLSTXEALLKQVDYLIRSKWVPCLEFSKVGFIFREHNXSPGYYDGRYWTMWKLPMFGCTDATQVINEVEEVKKEYPXDAYVRIIGFDNMRQVQCVSFIAFKPPGXCEESGKALNSSLTTGHI

SEQ ID NO: 5525 - protein, 364 aa, Triticum aestivum
MMASEPVARAVAEEVGRWGSMKQTGVSLRYMMEFGSVPTDRNLLLSAQFLQKELPIRIARRALELESLPFGLSAKPAILKVRDWYLDSFRDIRYFPEVRNRDDELAFTQMIKMIKVRHNNVVPTMALGVQQLKNEQFSSRKLPPGFDEIHGFLDRFYMSRIGIRMLIGQHVALHEPEPEPGVIGLINTKLSPIQVAQIASEDARSICMREYGSAPDINIYGDQNLTFPYVTSHLHLMLFELVKNSLRAVQERYMNSDKDVPPVRIIVADGTEDVTIKVSDEGGGIRRSGLPRIFTYLYSTAKNLPDMEGPSEGVTMAGYGFGLPVSRLYARYFGGDLQIISMEGYGTDAYLHLSRLGDSEEPLP

SEQ ID NO: 5526 - protein, 375 aa, Triticum aestivum
MAAQAIHQFAECITCHAWSPDHSMIAFCPNTTEVHIYKFFTDKWEKLHVLAKHDQIVSGIDWSRSSNKIVTVSHDRNSYVWTQEGQDWVPTLVILKLNRAALCVQWSPKENKFAVGSGAKSVSICYYEQENNWWISKVIRKKHESSVTSVAWHPNNIHLATTSTDGKCRVFSTIIKGVDTRGPQAGASVDWKFGEHCAQLDLSPTWALGVRWSPSGKTWAYAGHSSMIYFVDDVEGSPAAQNWALRDLPLRDILLVSEKMAMGVGLDCNPWILAADETGLGSFVRYLDERKVTPSTSKASQLSEALGKLYGQSRQGSSSDTVEPSKPRGGAHENCITCIVPLRKGSESIVKRFSTSGLDGKIVVWDLENHITIPK

SEQ ID NO: 5527 - protein, 431 aa, Triticum aestivum
  misc_feature (222)..(222): Xaa can be any naturally occurring amino acid
  misc_feature (288)..(288): Xaa can be any naturally occurring amino acid
  misc_feature (307)..(307): Xaa can be any naturally occurring amino acid
MDATTAKQLRRLRTLGRGASGAVVWLASDDASGQLLAVKSAGAGAADTLRREGSVMAGLCSPHIVPCLGSRAAPGGEYQLFLEFAPRGSLADEAARSGGSLAERAIQGYAADVARGLAYLHGNSLVHGDVKARNVMVGADGRAKLADFGCARAADSDRTIGGTPAFMAPEVARGEEQGLAADVWALGCTVIEMATGHAPWSDMDDVFAAVHRIGYTDAVPEXPASLSPQAKDFLRKCLARNPRHRSTAAQLLEHPFLASAFHDVDAEPAKQDWIMSPKSTLNADFWEXSDEESETEDMLTSAAERIXSLASPCSALPDWESDDGWIVVHGGRPEASETTTPTAIAGTDFGPWSEEGLEAEVDVHFAGADAGRWYDLVRNVDGAHYFGWYERDLGVSVVTDRPLCLIVSHGRKIVKFGCHCDRERTMHFDFA

SEQ ID NO: 5528 - protein, 453 aa, Triticum aestivum
  misc_feature (113)..(113): Xaa can be any naturally occurring amino acid
  misc_feature (371)..(371): Xaa can be any naturally occurring amino acid
MARPEENAKFPSCDAYFDTIQSKKKLPLALQESLTAAFAQIPVASFPDVPSGRVTEIPGETSVLDAVRILSEHNIRAAPVLNPEPGVPADWQGRYLGIIEYSAIILWVLDNAXLAAVALSAGSATAAGVGMGAVGAVGVAALGATGPAAVAGLTAAAVGAAVAGGLTAEKGVAKDGVTAADHLGEDFYKVLLQQEPFKSTTVRSIVESYPWSPFVPVTLDSSMLAVLLLLSKYRLRNVPVIEPDKPVIKNFITQTGVVKGLQQCKGRDWFDYISALPLSDLGLPFMSLDEVITVNSDDLILEAFKCMKDNKIGGVPVVEGPKRKLVGSVSIRDIRFLLLRPDLFSDFRHLTVLEFMNALGSTLPDSGGNGXVKPPLTCAPDASMGSVIDSIGSRITHRIYVVDGDFEVVGVVTLRDVISCFIHEPPGFCDSYLASAMEKLEDKGDADSSVENS

SEQ ID NO: 5529 - protein, 101 aa, Triticum aestivum
LRLLVTLGANVIEVGMQVCEPYSDGHVIQAFVERSLSGGVSTDAAMAMLKEVTPELSCPVVSLSDFNPIARRVTGSLTARSREAGVQGAVHSTIYKGRHDG

SEQ ID NO: 5530 - protein, 92 aa, Triticum aestivum
  misc_feature (43)..(43): Xaa can be any naturally occurring amino acid
SGTSLLSGPTAIITQINEKIGAPGVVSQECKAVVSQYGQRILXLLLKEMDPSKICSLVGLCTPDGTQRVRAGSPSVLYHEGGRSNDVMCHAC

SEQ ID NO: 5531 - protein, 562 aa, Triticum aestivum
  misc_feature (329)..(329): Xaa can be any naturally occurring amino acid
  misc_feature (376)..(376): Xaa can be any naturally occurring amino acid
MLVLFETPAGFALFKVLDEGKLSSVEDLWKDFASSDKARKVVELKAFNKFENTSDALSAATLLIDSKPSKGLRKFLQKHCDGETLAVADSKLGNAIKEKLQIDCLHNSAVMELMRGLRNQLTELMSGLAEHDLGPMSLGLSHSLSRYKLKFSPEKVDTMIIQAIGLLDDLDKELNTYAMRVREWYGWHFPELTKIVADNIHYAKAVKMMGNRVNAVNLDFSEILPEEVEAELKEAAVISMGTEVNDLDLSNIRELCDQVLALSEYRAQLYDYLKSRMNTIAPNLTALVGELVGARLISHGGSLMNLAKQPGSTIQILGTKKALFRALKXTKHATPKYGLIYHASLIGQAAPKHKGKISRSLAAKSALAIRYDALGXDGDDNSMGLESRIKLETRLRVLEGKELGRSAGSTKGKPKIEAYEKDRKGGGALITPAKTYNSAADLVLGQTTEETPKKSEVASKKRKHQEEEPTAEAAEEDGEQEKEKSKKKKKKSKDMEEIPAAVTDASENKKKKKSKETEETPAANTDGEKKKKKKKSDAEDAPMEIDVSAKKDKKKKKKHADE

SEQ ID NO: 5532 - protein, 559 aa, Triticum aestivum
  misc_feature (461)..(462): Xaa can be any naturally occurring amino acid
MLVLFETPAGFALFKVLDEGKLSSVEDLWKDFASSDKARKVVELKAFNKFENTSDALSAATLLIDSKPSKGLRKFLQKHCDGETLAVADSKLGNAIKEKLQIDCLHNSAVMELMRGLRNQLTELMSGLAEHDLGPMSLGLSHSLSRYKLKFSPEKVDTMIIQAIGLLDDLDKELNTYAMRVREWYGWHFPELTKIVADNIHYAKAVKMMGNRVNAVNLDFSEILPEEVEAELKEAAVISMGTEVNDLDLSNIRELCDQVLALSEYRAQLYDYLKSRMNTIAPNLTALVGELVGARLISHGGSLMNLAKQPGSTIQILGAEKALFRALKTKHATPKYGLIYHASLIGQAAPKHKGKISRSLAAKSALAIRYDALADGDDNSMGLESRIKLETRLRVLEGKELGRSAGSTKGKPKIEAYEKDRKGGGALITPAKTYNSAADLVLGQTTEETPKKSEVASKKRXXQDEEPTAEAAEQDGEQEKEKSKKKKKKSKDIEETPAAVTDASEKKKKKKSKEAEDTPAANTDGEKKKKKKKSDAEDAPMEVDVSAKKEKKKKKKADE

SEQ ID NO: 5533 - protein, 137 aa, Triticum aestivum
  misc_feature (95)..(95): Xaa can be any naturally occurring amino acid
MRPPSQQPQNNTLRTVTSPVRERSAKGNNDNNAVPPTSLDDKKGSSSGSEGSIWPNFAVSLTNKEKEEDFLVFKGSKLPQRPKKRVKAIQEDCQXVCPGTWLCDLTLERYEVREKKVSKKRPRGLKAMHDMDSESEE

SEQ ID NO: 5534 - protein, 314 aa, Triticum aestivum
  misc_feature (70)..(70): Xaa can be any naturally occurring amino acid
MPGRLLWATTKHVVCTAHTQSMTHWSSLNQISTELINGDDCIIPKQRGHGSQSVSMVQFTTMAVDNDFLXVVGGFHGELICKRLEDDGIVFSTRVTDDENAITNSLEIYQDPNGSRRLVVANNDCSVRIFDTKYFDLLNHYVFPWSVNSVSVNPDATLFAVLGDHEDGLVVDPKCGKPIGKVRGHLDYSFSSAWHPDGNILATGSQDTTCRLWDIRNLSQSLAVLGGRLGSIRCIKFSSDGRFLATAEPIDFVHIYDCFADYGKSHEIDFFGEIAGLSFSPDTEAFYIGVADQTYGGLMEFKRRHQHHYLNCLW

SEQ ID NO: 5535 - protein, 275 aa, Triticum aestivum
  misc_feature (98)..(98): Xaa can be any naturally occurring amino acid
  misc_feature (238)..(238): Xaa can be any naturally occurring amino acid
MDFEADGRFGNKRVHNRLGPAPGAASSSSSTKVCIHWRAGRCNRFPCPFLHSELPEAATTKRPNQRDGPGGHVWRNPNSGGGGRGGGGGFNKWGTHAXGADGGVRHKVPDRPCKFFLAGDCTYGEKCRYPHTYCMSNSITLLTPLQGHEKVVTGIALPTGSDKLYSGSKDGTVRLWDCQTGQCAGVLPVGGEVGCMISEGPWLFVGIPDAVKVWNMQTQAEMNLTGPTGQVYALAIGXELLFAATQDGRILAWRFSAVTNCFEPAASLTGHQLAV

SEQ ID NO: 5536 - protein, 551 aa, Triticum aestivum
MALPLALPLAALLLSAAAPALAHTPSCPDGWQISPDRAKCFMHISTSLSWDGSEALCRNFSGHLAALSSVQELNFARSLCGAASSGCWVGGRRRNTSSGVVGWKWSDNSSSWNGTAFPGEPLRPNCTGARCGLATGDDMCTLVTSKHTALTGKKCAESHGLICMMNHEDRCYHDHCHKEYFIVLIVVSGLILSTTLAVVVWLLVYKRSKKRKRSREASGASATALVPPLWKVFNSEELRSITKNFSEGNRLPGNARTGGTYSGTLPDGSKLAIKRLKRSSLQRKKDFDSEISRVAKLYHPNLVAVKGCCYDHGDRFIVYEFVANGPLDVWLHQIPRGGRSLEWATRMRVATTLAQGIAFLHDKVKPQVLHRDIRASNVLLDEEFGSHLMGVGLSKFVPWEVMHERTVKAATYGYLAPEFIYRNELTTKSDVYSFGVLLLEIISGRRPAQSVESAGWQTIFEWATPLVQSHRHLELLDPLINDMPEIGVIQKVVDLVYACTQHVPSVRPRMSHVVHQLQQLELKSAASEQLRSGTSTSATSPMLPLEVRTPR

SEQ ID NO: 5537 - protein, 174 aa, Triticum aestivum
  misc_feature (29)..(29): Xaa can be any naturally occurring amino acid
MAPAVMASSATTVAPFQGLKSTAGLPVSXRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 5538 - protein, 133 aa, Triticum aestivum
MEMKLTIKRVPTVLSNYQEEGGGGCGRNCLGDCCLPASKLPLYAFKADPKKPAQDDELPTEFFLNSLLLAQWEDRVARGLFRYDVTACETKVIPGELGFVAQLNEGRHLKKRPTEFRVDRVLQPFDSAKFNFT

SEQ ID NO: 5539 - protein, 131 aa, Triticum aestivum
  misc_feature (116)..(116): Xaa can be any naturally occurring amino acid
MMEPGPPYFAGMGSSAGGSGSGFYPTYGGNMAGAAGVNSGIQNFPAVRLRGLPFDCEDVDISKFFAGLDIVDCLLVHKNGRFSGEAFVVFPSSMQAEFALHRNRQNMGRRYVEVFXRCKKQDYYKRDSRPR

SEQ ID NO: 5540 - protein, 153 aa, Triticum aestivum
PSGTATAALINGFHTPQGDKNARQQVRGFLKYFGISFFWSFFQWFYTGGDVCGFLHFPTFGLRAWKQTFFFDFSLTYVGAGMICSHLVNLSLLFGAVLSWGVMWPLMSKQEGKWYSAKASASSMTGLYGYKAFLCIALLIGDGFYNFLKVILV

SEQ ID NO: 5541 - protein, 125 aa, Triticum aestivum
  misc_feature (45)..(45): Xaa can be any naturally occurring amino acid
  misc_feature (47)..(47): Xaa can be any naturally occurring amino acid
  misc_feature (90)..(90): Xaa can be any naturally occurring amino acid
MQGSRSVGFLKYFGISFFWSFFQWFYTDGNVCGFRRFPTFGLKTXKXTFFFDFSLTYVGAGMICSHLVNLSLLFGAVLSWGVMWPLMSKXEGKWYSAKASASSMPGLSTVYDIIVPELASFVSLN

SEQ ID NO: 5542 - protein, 242 aa, Triticum aestivum
KNIDSLHAKFEALEKKVEEGLPKKQLRMIIMGPPGAGKGTQAPAIKDKFCACHLATGDMLRAAVNAKTPLGLAAKKIMDEGGLVSDEIVVGMIEENLDKNPECKNGFILDGFPRTVVQAEKLDEMLDARKKPLNSVVELVIDDNLLVSRITGRLIHPSSGRTYHREFNPPKVPMKDDVTGEPLIQRSDDNVESLKKRLDAFHKQTVPVVEYYKKKGIWYGVDASQSPKSVWASLGAIFDKTL

SEQ ID NO: 5543 - protein, 335 aa, Triticum aestivum
YQVYKQVDEGSPECGIIVNRHRRWLRNLLWATSKHDVYVTQNYSVMHWSSLLRRGKEVPNVAGPNQDMRGGRPLSRVQISTMTVKDNLLAAGGFHGELICKYVDQPGVAFCTNLAGNKKSITNAVEIYESPNGSTRVVAANNDCVVRTFDTEKYSLLTQFPFAWSVNNMSVSPDGKLLAVVGDSSDCLIADSGSGKEIASLRGHADYSFASAWHPDGRVLATGSQDRTCRLWDVRNPSDAFAVLEGRIGAVRGLRFSPDGRFLAAAEPADFVRVYDVAAGYARAQEIDLFGEIAGVSFSPDDGAEALFVGVADRTYGSLLEFRRRHRHAYLDCYL

SEQ ID NO: 5544 - protein, 383 aa, Triticum aestivum
  misc_feature (165)..(165): Xaa can be any naturally occurring amino acid
  misc_feature (261)..(261): Xaa can be any naturally occurring amino acid
MAAQAIHQFAECITCHAWSPDHSMIAFCPNTTEVHIYKFFTDKWEKLHVLAKHDQIVSGIDWSRSSNKIVTVSHDRNSYVWTQEGQDWVPTLVILKLNRAALCVQWSPKENKFAVGSGAKSVSICYYEQENNWWISKVIRKKHESSVTSVAWHPNNIHLATTSYXDVNCRVFSTIIKGVDTRGTSSWGPQAGASVDWKFGEQIAQLDLSPTWAFGVRWSPSGKTLAYAGHSSMIYFVDDVEGSPAAQNLALRDLPLRDVDXLFVSEKMAIGVGFDCNPLIFAADETGLWSFVRYLDERKVTPSTSKASQLPEALGKLYGQSRQGSSSDTVEPSKPRGGAHENCITCIVPLRKGSESIVKRFSTSGLDGKIVVWDLENHITIPK

SEQ ID NO: 5545 - protein, 363 aa, Triticum aestivum
  misc_feature (27)..(27): Xaa can be any naturally occurring amino acid
  misc_feature (114)..(114): Xaa can be any naturally occurring amino acid
NSRGPAAWGAAIYVRADKIDLTSLDIXLEQQLNKKWGKTNIKSQGPKADWEIDLAKLEIRHVIAQGTYGTVYRGTYDGQQVAVKLLDWGEDGFATEAETTALRTSSKQEVAVWXHKLSHPNVTRFIGASMGTTDLKIPVNDNGARANLPARACCVVVEYLAGGTLKQYLIKNRRRKLAYKVVVQLALDLSRGLSYLHSRKIVHRDVKTENMLLDTQRNLKIADFGVARVEAQNPKDMTGATGTLGYMAPEVLDGKPYNRKCDVYSFGICLWEIYCCDMPYPDLSFADVSSAVVHQNLRPDIPRCCPSAFANIMRKCWDGNPDKRPDMDEVVQLMEALDTSKGGGMIPDGQSSGCLCFTRARGP

SEQ ID NO: 5546 - protein, 506 aa, Triticum aestivum
  misc_feature (202)..(202): Xaa can be any naturally occurring amino acid
MRPMHLLGVTCLWILSCALLLGGACSDGLLRINLSKKRLDKETLAAAKSARQETNLLRPDDGSRHSLGLSDDDIVPLDNYLDTQYFGEIGVGTPPQNFTVIFDTGSSNLWVPSSKCYFSIACYLHHKYKSTKSTTYKKNGETCTISYGSGSIAGFFSEDSVLVGELVVKNQKFIETTREASPTFIIGKFDGILGLGFPEISXVGSAPPIWQSMQEQKLIEKDIFSFWLNRDPDASAGGELVFGGVDKKHYKGKHTYVPVTRKGYWQFDMGDLLIGGESTGFCAGGCAAIVDSGTSLLAGPTTIVAQVNHAIGAEGIISTECKEVVREYGEMILELLVAQTRPQKVCSQIGLCVFDGSYSVSNQIESVVDKKEKRGSDLLCTACEMTVVWIQNQLRKNQTKELILDYANQLCERLPSPNGESTVDCHQISEMPDLAFTIANKTFTLTPEQYVVKLEQSGQTICISGFMAFDVPPPRGPLWILGDVFMGAYHTVFDFGESRIGFAKSA

SEQ ID NO: 5547 - protein, 556 aa, Triticum aestivum
  misc_feature (12)..(12): Xaa can be any naturally occurring amino acid
EEFGTRLQAPSXSMGIGTTNSRNLSQMLSQHLRPTGEPNPLRRWYRRASYFLEDNWRRCWVILLWLSICGGLFTWKFMQYRERAVFKVMGYCVCVAKGGAETLKFNMALILLPVCRNTITWFRNRTAAGRFVPFDDNINFHKVIAAGISVGAGLHIISHLTCDFPRLLHATEEEYEPMKPFFGEDQPPNYWWFVKGTEGWTGLVMLALMAVAFTLATPWFRRGRVRLPGPLSRLTGFNAFWYTHHLFIIVYALLIVHGHFLYLTKKWQKKSTWMYLAVPMVMYACERLTRALRSSVRPVKILKVAVYPGNVLSLHLSKPQGFRYKSGQYIFVNCAAVSPFQWHPFSITSAPQDDYVSVHIRTLGDWTRELKNVFSKVCRPPTEGKSGLLRAEYDRDGAMSNPSFPKVLIDGPYGAPAQDYKQYDIVVLVGLGIGATPMISIIKETMNNMKPSAGNAETGHPGDAEYCAARAKYYGVTREEDSFEWFRGVMDEIAESDKESGIELLNYRTTVYEGGGARSALIARLQCHNHAKNGLNLRDQRPGLCPTRRTGTKRRA

SEQ ID NO: 5548 - protein, 203 aa, Triticum aestivum
PASAKSFINKHIKRVAVIGAGPGGIAALRALSKEGTFDTITVYERNAQIGGTWIYDSKVDPPPAVPSTDALEVDYTLKVDKLCSPIYASLRTNLPKDLMCFRDAPFSKSLPYFPSHEQVLDYVKSLAVSEGLLPMIKFSTRVDKIDHQDNSWKIVSTNLETGEQFEDKFDAVAVANGHYNVPFIPNIPRIEQLNQNKNIQVMH

SEQ ID NO: 5549 - protein, 269 aa, Triticum aestivum
MADGKRSVAETFSRLRERGKTAFIPFITAGDPDLATTSKALRILDSCGSNVIELGVPYSDPLADGPVIQAAASRALKKGTKLGSVLAMLTEVIPELSCPIVLFTYYNPILKNGVRNFMAKIKQAGVHGLVVPDLPLEETTLLRSEATMHNIELVLLTTPTTPTERMKEITKASEGFVYLVSAVGVTGARSNVNLRVEHLLKEIKQVTDKPVAVGFGISTPEHAKQIAGWGADGVIIGSAIVRQLGEAASPEEGLRRIEEYAKSIKAAIP

SEQ ID NO: 5550 - protein, 512 aa, Triticum aestivum
  misc_feature (304)..(304): Xaa can be any naturally occurring amino acid
  misc_feature (405)..(405): Xaa can be any naturally occurring amino acid
HEADRRFGTGEEGYDATYPKIYSLAQCTPDMAADDCRTCLRDIIEKFTPQYFVGKPGGRVFGVRCNFRFETYSFFSGVPPLQLPGPLPPAPAPAPAAREEEGRRSRTGLILAITLPIVAALLLISTCVCFWRRRKPAERKPSVPLPYSATNPDDIQSIDSLLLELSTLRAATDNFAESNKLGEGGFGAVYKGVLSEGEEIAVKRLSQSSTQGIEELKTELVLVAKLQHKNLVRLLGVCLEGQEKLLVYEYMPNRSLDTVLFDAEKSRDLDWGKRLKIVNGVARGLQYLHEDSQLRIVHRDLKAXSNVLLDSDCNPKISDFGLAKLFGWDQSQAVTSHIAGTYGYMAPEYAMRGQYSVKSDAFSFGVLLLEIVTGRKNSSFASPDSEPSLDLLSLVWEHWTSGTVXKLVDPVPGRPFAREARMLKLVNIGLLCVQDSPADRPTMSAVNVMLSSSTVSLQAPSRPTFCVDDMEGFSGMYSGAYPGGSQSTGDSKPQAAMSPSPNEVSLTEIEPR

SEQ ID NO: 5551 - protein, 341 aa, Triticum aestivum
  misc_feature (198)..(198): Xaa can be any naturally occurring amino acid
  misc_feature (223)..(223): Xaa can be any naturally occurring amino acid
  misc_feature (230)..(230): Xaa can be any naturally occurring amino acid
  misc_feature (327)..(327): Xaa can be any naturally occurring amino acid
MAQTPPIPRVSLGTQGLEVSKLGFGCMGLTGSYNSPVEDDAGVAVITHAFRRGVTFFDTSDVYGPHANEILLGKALKQLPREQVQVATKFGIQRDAQGKSTICGRPEYVRACCEASLHRLGVDHIDLYYQHRIDTTIPIEDTIGELKKLVEEGKVKYIGLSEASPDTIRRAHAVHPISAVQMEWSLWARDIEPEIVPXCRELGIGIVPYSPIARGFFGGRGVXQQVSAEXSLKGHPRFSAENLEKNKQLYLKMEELAKKHQCSPAQLALSWVLHQGDDVVPIPGTTKIKNLDSNIDSLKVRLTEDDLKEISNEIREEDVAGGRQYTXFAKFTWNYADTPKK

SEQ ID NO: 5552 - protein, 260 aa, Triticum aestivum
MGSLLLLSLLVISGVGVGGGVRLAGNGGYEDWRLGTATYIKESQGHPLNDGGGACGYGDLDIFRYGRYTAGLSGALFGRGSACGGCYELRCVNNILYCLRGSPTVVVTATDFCAPNFGLADDYGGWCNFPKEHLEMTEAAFLRVAKAKADIVQVQFRRVSCDRAGGIRFTITGGPNFLQVLITNVAADGEVDAVKVKGSKTGWIPMGRNWGQNWQCDADLRGQPLSFEVTGGKGRTITMYNVAPSDWMFAQTFAGKQFVE

SEQ ID NO: 5553 - protein, 175 aa, Triticum aestivum
MAPAVMASSATTVAPFQGLKSTAGLPVSCRSGSTGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 5554 - protein, 386 aa, Triticum aestivum
  misc_feature (40)..(40): Xaa can be any naturally occurring amino acid
  misc_feature (147)..(147): Xaa can be any naturally occurring amino acid
  misc_feature (203)..(203): Xaa can be any naturally occurring amino acid
  misc_feature (215)..(215): Xaa can be any naturally occurring amino acid
MATAGKVIKCKAAVAWEAGKPLSMEEVEVAPPQAMEVRVXILFTSLCHTDVYFWEAKGQTPMFPRIFGHEAGGIVESVGEGVTELAPGDHVLPVFTGECKECPHCKSAESNMCDLLRINTDRGVMIGDGKSRLSIEGVPACLFVVTXTFNELPSGSKVCVPSMYPSSALSVCVLSCGISTGLGASINVAKPPKGSTVAIFGAXAVGLAAAEGARXIAGASRISWVFTNSAPANLKETKKIWLHEFDCTEFENPQGHTQRGRQVPAERTQGGVDRNDECTGNGNAMKQAFECVHDGWGVAVLVGVPHKDAEFKTHPMNFLNERTLKGTFFGNFKPRTDLPNVVEMYMRKELEVEKFITHSVPFSEINKAFDLMAKGEGIRCIIRMEN

SEQ ID NO: 5555 - protein, 379 aa, Triticum aestivum
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLAEMTNGGVDRSVECTGNVNAMIQAFECVHDGWGVAVLVGVPHKDAEFKTHPMNFLNERTLKGTFFGNFKPRTDLPNVVEMYMRKELEVEKFITHSVPFSEINKAFDLMAKGEGIRCIIRMEN

SEQ ID NO: 5556 - protein, 405 aa, Triticum aestivum
  misc_feature (33)..(33): Xaa can be any naturally occurring amino acid
  misc_feature (39)..(39): Xaa can be any naturally occurring amino acid
  misc_feature (156)..(156): Xaa can be any naturally occurring amino acid
  misc_feature (165)..(165): Xaa can be any naturally occurring amino acid
  misc_feature (167)..(167): Xaa can be any naturally occurring amino acid
  misc_feature (190)..(190): Xaa can be any naturally occurring amino acid
  misc_feature (211)..(211): Xaa can be any naturally occurring amino acid
  misc_feature (234)..(234): Xaa can be any naturally occurring amino acid
  misc_feature (236)..(236): Xaa can be any naturally occurring amino acid
  misc_feature (245)..(245): Xaa can be any naturally occurring amino acid
  misc_feature (263)..(263): Xaa can be any naturally occurring amino acid
  misc_feature (270)..(270): Xaa can be any naturally occurring amino acid
  misc_feature (276)..(276): Xaa can be any naturally occurring amino acid
  misc_feature (281)..(281): Xaa can be any naturally occurring amino acid
  misc_feature (283)..(283): Xaa can be any naturally occurring amino acid
  misc_feature (300)..(300): Xaa can be any naturally occurring amino acid
  misc_feature (307)..(307): Xaa can be any naturally occurring amino acid
  misc_feature (310)..(310): Xaa can be any naturally occurring amino acid
  misc_feature (335)..(335): Xaa can be any naturally occurring amino acid
  misc_feature (359)..(359): Xaa can be any naturally occurring amino acid
LHFDDALSLDPSAVAAAVAWEAGKPLSMEEVEXVAPPQXAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFXEYTVMHVGXCXAKINPEAPLDKVCVLSCGISTGXLGASINVAKHQRVRPVAIYGXGAVGLAAAERCRIAGASRIIWCXLXTPADFERSXKTLACHGIVNPEDHTSQXQQVLAEXMTNGLXFGTAXFXRCPGGHTVTVVVTHKAXGTCVFHXNGXGVYDIDAGWVMPHKDARIIKNPPDXTSVNERTLEGTFFGNFKPRTDLPXVVEMYMRKELEVEKFITHSVPFSEINKAFDLMAKGEGIRCIIRMEN

SEQ ID NO: 5557 - protein, 485 aa, Triticum aestivum
  misc_feature (17)..(17): Xaa can be any naturally occurring amino acid
  misc_feature (370)..(370): Xaa can be any naturally occurring amino acid
MGTMEEKPALGLGSLVXSLRVVYKSGRTKDLSWRRSQLKGLIRLLTEKEEEIFDALHDDLGKHRTESFRDEVGVLVKSIKHTLQNLEKWAAPEKAPTPLVSFPATALVLPEPLGVVLIFSCWNLPIGLALEPLSGALAAGNAVVLKPSELAPATAAFLAANIPRYLDAEAVKVVLGAAEIGQELMEHRWDKVLFTGGARVGRIIMTKAAKYLTPVALELGSKCPCIVDWLDSKRDSQVAVNRIIGAKWSTCAGQACIAIDYILVEEQFAPILIELLKSTLERLFTKPEDMARILNERQFNRLCGLLEDHKVSRSIVHGGDVDPKILSIEPTILLNPPLDSDVMTKEIFGPLLPIITVKKIEESIEFVSSXPKPLATYAFTTSEALKQRIVRETSSGSVTFNDAIVQYGLESIPFGGVGQSGFGQYHGKYSFEMFSHKKAVFRRSFLVEFMFRYPPWSDDSKLGMLRHVFRYDYVSLFLALLGLRR

SEQ ID NO: 5558 - protein, 90 aa, Triticum aestivum
  misc_feature (27)..(27): Xaa can be any naturally occurring amino acid
  misc_feature (37)..(37): Xaa can be any naturally occurring amino acid
  misc_feature (45)..(45): Xaa can be any naturally occurring amino acid
MALRGVHTVAPFQGLKCTAGMPVARRXGNSSFGNVSXGGRIRCMXVWPIEGIKKFETLYYLTPITVEDLLKQIENLLRSRGCLLEGPVPP

SEQ ID NO: 5559 - protein, 198 aa, Triticum aestivum
MDRHDLGASGEIEKTPREAAAPDMESEPAAARAAERVPPWREQVTVRGMVAALLIGVVYTVIVMKLSLTTGLVPTLNVSAALLAFLALRGWTHALHRLGIACRPFTRQENTVVQTCAVACYTIGFGGGFGSFLLGLDKKTYELSGVNTPGNVPGSYKDPGIGWMMGFLLAISFVGLLTLLPLRKVLGIDGMPTYPSGT

SEQ ID NO: 5560 - protein, 166 aa, Triticum aestivum
RGTTGACPESFYTNGGLKLRVVWTISSLIAASTRHYLLRSIIKEHPTLVSLVLTDADGQGTLTMGAEQLKEFRENQLSASACSNRTQVPACNMKLKYAPYLELPGGIALQGATLVAIKPSTEGSNGGHISRKETDAFISGAFDGPFKFALKALMKRRTYLLEMNGF

SEQ ID NO: 5561 - protein, 120 aa, Triticum aestivum
ANKVIGELEKLVADSNFVGSTIEGRKVTKAGNFSYTDLDGSVASKQGLYAGFSSGSRIVVRLSGTGSSGATIRLYIEQHTSDPSKYELDAQDFLKEEVKFATELLKFKEHVGRDEPDVKT

SEQ ID NO: 5562 - protein, 145 aa, Triticum aestivum
PRVRTIRVWDLATLQCIQTLSDHTNVVMSLLCWDQFLLSCSLDQPIKVWAATESGNLEVTYTHKEENGALALTGMPDAQSKPVLVCSLNDNTVRLYDLPSFSDRGRIFSKQEIRAIQTGPGGLFFTGDGTGELKVWQWIIDASQT

SEQ ID NO: 5563 - protein, 384 aa, Triticum aestivum
  misc_feature (34)..(34): Xaa can be any naturally occurring amino acid
LCSPAAMGNCFGSRIGSDSPYKSAGGSASPSSSXRWAWRRGEGGASVSSSRVSSSPPTTVPPTPRSEGEILQSANVKSFAFNELKTATRNFRPDSVLGEGGFGSVFKGWVDETTFAPARPGTGMVIAVKKLNQEGFQGHREWLAEVNYLGQLSHPNLVRLVGYCLEDEQRLLVYEFMPRGSLENHLFRRGSHFQPLSWNLRMKVALGAARGLAFLHSDMAKVIYRDFKTSNVLLDSSYNAKLSDFGLAKDGPTGDKSHVSTRVMGTHGYAAPEYLATGHLTAKSDVYSFGVVLLEMLSGRRALDKNRPSGEHNLVEWARPYLTSKRRVFHILDARLGGQYSLSGAQKTAALAMRCLSGDARARPGMAEVVTALEQLQDAKEAAA

SEQ ID NO: 5564 - protein, 453 aa, Triticum aestivum
  misc_feature (152)..(152): Xaa can be any naturally occurring amino acid
AHVTCDFPRLISCPSDKFMALLGPNFGFMQPTYPDLLASAPGVTGILMIIIMTFSFTLAMHTFRRSVVKLPSPLHHLAGFNAFWYAHHLLLLVYVLLVVHSYFIFLTRIWYKKTTWMFLIVPVLFYACERIIRKVRENNYHVNILKAGIYPXNVLSLHMKKPPGFKYKSGMYLFVKCPDVSPFEWHPFSITSAPGDDYLSVHIRTLGDWTSELKNLFGKCFEAQVTSKKATLSRLETTVVADSATEDTRFPKVFIDGPYGAPAQNYKKYDILLLIGLGIGATPFISILKDLLNNIKSNDEVESIHGSEIGSFKNSGPGRAYFYWVTREQGSFDWFKGVMNEVADNDHSDVIEMHNYLTSVYEEGDARSALIAMVQSLQHAKNGVDIVSGSKIRTHFARPNWRKVFSDLANAHKNSRIGVFYCGSPTLTKQLKDLSKEFSQTTTTRFHFHKENF

SEQ ID NO: 5565 - protein, 266 aa, Triticum aestivum
ARAIVDSNTDLHVTMKRLAVGKWGCNNGQACIAPDYVITTKSFAPELVDSLKRVLKRFYGEDPLQSEDLSRIVNSNHFRRLTNLIEDKKVAQKIVYGGQTDEKQLKIAPTVLLDVPLDTTLMAEEIFGPLLPIVTVDKIEDSIQFINSRTKPLAAYLFTKDKKLQEEFVSNVPAGGMLVNDVALHLANPHLPFGGVGDSGIGSYHGKFSFDCFTHKKAVLIRGFGGEATARYPPYTIEKQKILRGLINGSFFALILALLGFPKERR

SEQ ID NO: 5566 - protein, 74 aa, Triticum aestivum
PLGGKKFAFNPKGFFLKGGEGALAPGPRGFPPMGLPPPRGPFWVLGEVFLGPPPPVFDLGKLGGGFPKGALRGV

SEQ ID NO: 5567 - protein, 616 aa, Triticum aestivum
  misc_feature (155)..(155): Xaa can be any naturally occurring amino acid
MNPPAPDQTTQQQKPNGRRAVGSSQTWTRYGVLLPSQQTRKLKEWILTDEQQQVVNASGLGHLALTTGFTIDRSLLTAFCERWNNETNTAHFMGFEMAPSLRDVSYILGIPVTGHVVTAEPIGDEAVNRMCLHYLGESPGSGEQLCGLFRLTWVXRKFHQLPENPTINDIAFSTRAYLLYLVGSTLFPDTMRGFVSPRYLPLLGDFRKIHEYAWGAAALAHLYRGLSVAVTPNATTQFLGSATLLMAWIYEYIPLTQPQQKNQNTLLPRACRWNFGGTTRGQRKKVMEWRKDFEQLQLSDVNWNPYKDINPAIVPGYCIAADNICHSRTWLISFNIKEVYVPDRFNRQFGREQGRLYQVPMWARRTWSKGKDWRVEYAREIEDFHQLVGCRFIPCTEANINSLPSESIAGQTTTRCSRNASQNFSMMVEDLKNDLPVIDRYLEGQVLPEEVASFLERVSTMIKTYSPPQSNERKDEAAQSKNVRAKNPRKRARKPSLSEDPSSPQDCGVDRYAGALVPYQAGKCDRVLDGTVPLLNRGEALKENEVMDPWQMSHLTAESSSSGDSSLPESRRRRCEESGAPRSNQGVRRSGRMCVQLKMLKHRDGVGAEETNPIFL

SEQ ID NO: 5568 - protein, 529 aa, Triticum aestivum
MSPLAPLLALLSLLCSSLALDSGSEPTLLWTCGNDQVSILETSGGRQNLSINGVLVKDRAQGCDRLRSYFGSGCLSCDERSQSWRSAWMRYCGDDGSQSSYVTSTPNIPRRLLKQAPGNGAQAEDDPCRNMGLHENKHDANDSSEKEDPLLAVPGVLLICCGLMLPCFHAERKEGRRHNTTSIQRNAVDSLSSFDVSTSSEKIPPTPHRIPPSPSRFAPSPHIARVGSVDLSVQQILRATQNFSHSFKLGEGGFGTVYRAVLSDGQVVAVKRAKKDQFAGPSDEFSNEVELLAKIDHRNLVRLLGYTDKGNERIIITEYVPNGTLREHLDGQHGRTLDFNQRLEIAIDVAHALTYLHLYAEKTIIHRDVKSSNILLTDSYRAKVSDFGFARSGPSDTEKTHISTKVKGTAGYLDPEYLRTYQLTPKSDVFSFGILLVEIISARRPVELKRTAEERITIRWTFKKFNEGNMREILDPLLEDRVDEEVLEKLLSLAFQCAAPTREDRPTMKEVGEQLWEIRKEYGKSVRRV

SEQ ID NO: 5569 - protein, 252 aa, Triticum aestivum
  misc_feature (223)..(223): Xaa can be any naturally occurring amino acid
MAAAAEQDYWGLFREETGWYNEIFLSAVVPGGGGWWRALPHPLRSWLRNCIGGYLLYFATGFLWCFVIYYWKRNAYIPKDAVPTVEAMKKQIIVASKAMPFYCALPSISEHMIESGWTRCFFHISEVGWPMYIVYVSLYLIFVEFGIYWMHRELHDIKPLYKHLHDCNPIYNKENTLSPFAGLAFHPLDGILQAISHVIALFLLPMHFRTHIALLFIEAVCRXYRHNYGHYTVWMDWLVAALREPEDLLKKD

SEQ ID NO: 5570 - protein, 178 aa, Triticum aestivum
MVGSGMQRGAPLVVGRVIGDVVDPFVRRVALRVGYASRDVANGCELRPSAIADPPRVEVGGPDMRTFYTLVMVDPDAPSPSDPSLREYLHWLVTDIPGTTGVSFGTEVVCYEGPRPVLGIHRLVFLLFQQLGRQTVYAPGWRQNFSTRDFAELYNLGLPVAAVYFNCQRETGTGGRRM

SEQ ID NO: 5571 - protein, 113 aa, Triticum aestivum
PRVRITIASEGFVYLVSINGVTGARPDVNPRVKDLLKEIKQVTNKAVAVGFGISTPDHIRQVAQWGADGVIIGSAMVKHLGEADSPREGLKRLEVYARSLKDALSGGSIIGAS

SEQ ID NO: 5572 - protein, 349 aa, Triticum aestivum
MSDNSIQRALLPENPDANVLQRKPSQGAKRFRRCRSAPRSETDEKPQENGSSLPAKELFSVVRPSFRLVGFLLFLYLLVGVVVFYLVMDQLSGKRTNRVLDALYFCIVTMTSVGYGDLVPNSDTTKLLACVFVFTGMAIIALFVSKSADYLVEKQEVLFFKALHMNMKCGEAKMLRQIETNKTKYKFYTAALLLVTAIVVGTVFLWKVEKLSLVDSFYCVCATITTLGYGDKSFSSQLGRTFAVFWIITSTIILALFFMYLAEIYTERRQKMLAKWVLTRRVTTMDLEAADLDSDRKVGAAEFVVYKLKELGKISQEDISSFLEEFDKLDVDQSGTLSTYDLTQAQSGQ

SEQ ID NO: 5573 - protein, 174 aa, Triticum aestivum
MAPAVMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 5574 - protein, 328 aa, Triticum aestivum
  misc_feature (122)..(122): Xaa can be any naturally occurring amino acid
  misc_feature (131)..(131): Xaa can be any naturally occurring amino acid
  misc_feature (169)..(169): Xaa can be any naturally occurring amino acid
  misc_feature (195)..(195): Xaa can be any naturally occurring amino acid
  misc_feature (219)..(219): Xaa can be any naturally occurring amino acid
MAAAAGGGRSRKSVCVTGAGGFVASWLVKLLLSKGHYAVRGTVRDPGNAKNAHLKALEGAGERLELLSADLLNYDSIASAVAGCEGVFHVASPVPSGRSTNPEEEVIAPAVTGTLNVLKACXEAKVKRVVXLSSVAAVFNNPNWPKDKVFTEDSWSDEDLCRKGEDWYXCLSKTLAEREAFAYAAKTGLDVVTIXPSLVLGPLMQSTVNASSNILLKLXLKGERDTVENKIRNLVDVRDVADALLLAYENPEASGRYICSSKPVKVSDMISVLKTLYPMYTYPKNFTEVEENTIYSSEKLQKLGWTFRPLEKTLGDSVESYKASGVLN

SEQ ID NO: 5575 - protein, 405 aa, Triticum aestivum
  misc_feature (46)..(46): Xaa can be any naturally occurring amino acid
MDPQTFVRLSVGQLGLRLPGASARKACHCEIRLRGFPVQIAAVPLXNSSEFSCGPLAPPAPGARHVPGLEALPTSRWFRAPEPPYLEIVVYVMRRDGGGHCVGLKRRLVGAVRVDVGPEWRDGKPVLLRHGWTGIGRAAELHVRVRVEADPRYVFRFEDEVALNPQVVQLHGGASQPIFSCKFIRDVRRASQPDHLGGQYWSSSGSGVEKETDMAGRRRERKGWKVAIHDLSGSAVAAAFMATPFVPATGCDTVARSNPGAWLIVRADTTGSSESWQPWGRLEAWRECAAPAGGKDAVCLRLHLLPERRDACVLVSETPLSCDKGGEFSIDMDRQSVLPEDAVASETPSASSYCAASMGESCAGGGFVMSCSVQGEAATSSRPPLVHLAARHVMCMEDAAMFLAL

SEQ ID NO: 5576 - protein, 511 aa, Triticum aestivum
  misc_feature (348)..(348): Xaa can be any naturally occurring amino acid
MIARGLLRSNASSQASKLVKYLTSAGSLQGHADSLSDASVRHFSSASSPQTNSTEENGFKGHGMLAPFTAGWQSNDVHPLVIERSEGSYVYDINGNKYLDSLAGLWCTALGGSEPRLVKAATDQLNKLPFYHSFWNRTTKPTLDLADDLLSMFTASKMGKAFFTNSGSEANDSHVKLVWYYNNALGRPNKKKFIARSKAYHGSTLISASLTGLPALHQKFDLPAPFVLHTDCPHYWRFHLPGETEEEFATRLAKNLEDLILKEGPETIAAFIAEPVMGAGGVIPPPKTYFDKVQAVVKKYDILFIVDEVITAFGRLGTMFGSDMYNIKPDLVTLAKALSSAYVPIGAXLVSPEIAAVVDSQSNKLGSFAHGFTYSGHPVACAVAIEALKIYRERNIPDHVKQIAPRFQEGTKAFAGSPIVGEIRGVGLILGTEFANNKSRDDPFPAEWGVGAIFGQECQKRGMLVRVAGDSIMMSPPLTMTPGEVDELVSIYGEAMKATEERVAELKSKKN

SEQ ID NO: 5577 - protein, 512 aa, Triticum aestivum
  misc_feature (348)..(348): Xaa can be any naturally occurring amino acid
MIARGLLRSNASSQASKLVKYLTSAGSLQGHADSLSDASVRHFSSASSPQTNSTEENGFKGHGMLAPFTAGWQSNDVHPLVIERSEGSYVYDINGNKYLDSLAGLWCTALGGSEPRLVKAATDQLNKLPFYHSFWNRTTKPTLDLADDLLSMFTASKMGKAFFTNSGSEANDSHVKLVWYYNNALGRPNKKKFIARSKAYHGSTLISASLTGLPALHQKFDLPAPFVLHTDCPHYWRFHLPGETEEEFATRLAKNLEDLILKEGPETIAAFIAEPVMGAGGVIPPPKTYFDKVQAVVKKYDILFIVDEVITAFGRLGTMFGSDMYNIKPDLVTLAKALSSAYVPIGAXLLLAPEIAAVVDSQSNKLGSFAHGFTYSGHPVACAVAIEALKIYRERNIPDHVKQIAPRFQEGTKAFAGSPIVGEIRGVGLILGTEFANNKSRDDPFPAEWGVGAIFGQECQKRGMLVRVAGDSIMMSPPLTMTPGEVDELVSIYGEAMKATEERVAELKSKKN

SEQ ID NO: 5578 - protein, 153 aa, Triticum aestivum
MDASPTGAVSKAKKYVVGRKLGGGPRKKAVARSVKAGLQFPVGRIGRFLKKGRYAQRVGMGAPVYLASVLEYLAAELLELAGNAAKDNKKSRIIPRHLLLAIRNDQELGKLLAGVTIAHGGVLPNINPVLLPKKTAEKDPKSPKKAAKSPKKA

SEQ ID NO: 5579 - protein, 302 aa, Triticum aestivum
MADPSFFVGIVGNIISILVFTSPIATFRRVVRNKSTEEFRWLPYVTTLLCTSLWAFYGLLKPGGLLIITVNAAGAALQATYVALYLAYAPRDTKVKMAKVVVGVNICFFAAVVVVGLVALHGAVRLFAVGVLCSALTIAMYAAPMVAMRTVVKTRSVEYMPFSLSFFLFLNGGIWSVYSLLVKDYFIGIPNAMGFVMGTAQLALYMAYRNKKKLVVLKEEDEEKGAVHLMGQVELGQAKVPSLKKGLSLPMPSSLPSPLHGFGNLIKALSATPLELHSVLSQHERVGAKEEHHDDEHAYSSK

SEQ ID NO: 5580 - protein, 557 aa, Triticum aestivum
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIENDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 5581 - protein, 562 aa, Triticum aestivum
  misc_feature (23)..(23): Xaa can be any naturally occurring amino acid
  misc_feature (214)..(214): Xaa can be any naturally occurring amino acid
MATTNWTLPDHPTLPKGKTEARXSLDRWGEASPDQNNVQSMFDPVRTVMVLRIIDMDASLDHSWKNYVDSASIGNIVRFVFSSSSTTDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVKTIENDLAQLREQGGEPPILYXDYATAMLRDTIEYSSYASNALGALPYAWSRPRCSGINAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 5582 - protein, 388 aa, Triticum aestivum
MDGGGEEGKQQPQLVLAHKLFLLSQPDVDDLAKVGLRDDVLAAVKSDDMAALYESLAADGVLEMDAALLAEMRGRIEEETKKFDEKIADAEENLGESEVREAHLAKSLYFIRVGEKEKALEQLKVTEGKTVAVGQKMDLVFYTLQIGLFHMDFDLISKSVDKAKILFEEGGDWERKNRLKVYEGLYCMAARNFKKATSLFLDSVSTFTTYELFPYDTFIFYTVLTSVITLDRVSLKQKVVDAPEILAVIGKVPHLSEFLNSLYNCQYKSFFVAFSGLTEQIKLDRYLQPHFRYFMREVRTVVYSQFLESYKSVTMEAMAASFGVTVDFIDQELSRFIAAGKLHCKIDKVAGVLETNRPDARNAFYQSTIKQGDFLLNRIQKLSRVIDL

SEQ ID NO: 5583 - protein, 259 aa, Triticum aestivum
PPAGAMDRKRINDALDRHLRAATERSSPSTSRAAAKPKPPSAAAPKPKEQLDSDSSEGGSAGGPSEADDTFWINWFCAMRGNEFFAEVDDDYIQDDFNLCGLSAQVPYYDHALDLILDLEPVQGDVFADDQNELIVASAEMLYGLIHARYILTTKGLAAMLEKFKNCDFGRCPRVSCSGQPCLPMGQSDIPRSSTVKIYCPKCEDLYYPRSKHQANTDGAYFGTTFPHIFMMTHSQLKPQKPAQQYVPRIFGFKVHKKT

SEQ ID NO: 5584 - protein, 343 aa, Triticum aestivum
MARAAAANLRGLVGIAAAGRRRVTASVAPPRASPGGRAFRAVASGSGGRTTPESSSSSSPALPQLQPRRGLATRRAVLRNLISGGLESEDGKLSCGYSSFKGRRPTMEDRYDVKFAKMKGQSVSLFGVFDGHAGALAAEYLKEHLLDNLIEHPQFLRNPKLALKTTFLKTDADFLESVTTPYREDGSTALAAVLVGDQIYVANVGDSRAIALKGGKAIPLSDDHKPNLKDERTRIENAGGGVSYDGFTWRVDGILAMSRAFGNRSLKNYVIAEPDIQETQVSSDLEYLVLATDGLWDVVQNEDVISLMRATDEPEVAAVKLTEMAHSRHSSDNITCIVVGFHH

SEQ ID NO: 5585 - protein, 199 aa, Triticum aestivum
  misc_feature (62)..(62): Xaa can be any naturally occurring amino acid
EQEVILSEGDEQKPKEIDLLPASERQKRIAELQAKLFQAAAVGAVRVKRRKGPRLGEDFTCXQAMIKADFWLLFFSLLLGSGSGLTVIDNLGQMSQSLGFEDSHIFVSMISIWNFLGRISGGFFSEIIVKDYAYPRAIALATAQVFMAIGHFIFAMGWLGKMYIGTLLIGLGYCTHWAIVPAAASELFGVKNFGAVYNF

SEQ ID NO: 5586 - protein, 432 aa, Triticum aestivum
  misc_feature (385)..(385): Xaa can be any naturally occurring amino acid
SARGFGECTNTAGGHLCRCPRGAQGDPLIRNGCIKSSLGLSVGIGVGSGASPSLMVLGAILITRKMKQRRAKMLKKRFFKQNRGHLLQQLVSQKADIAERMIIPLVELQKATNNFDKAREIGGGGHGTVYKGIMSDLHVVAIKKSKVAIQREIDEFINEVAILSQINHRNVVKLFGCCLETEVPLLVYEFISNGTLYHHLHVQEPAPSLTWEYRVRIATETARALAYLHSAVSFPIVHRDIKSQNILLDGTLIAKVSDFGASRCIPVDQTETATAIQGTFGYLDPLYFYSGQLTEKSDVYSFGVLLMELLTRKKPCSYRSSEEETLVSYFTSSLATGKLVRVLDPQVVEEGGKEVEEVAVLAVACVRIEGDHRPSMRQVELTLEXLGASHDSFVMHDMDVPKYPVIEGSNMEETSRQYSLEAEYLLSSRYPR

SEQ ID NO: 5587 - protein, 506 aa, Triticum aestivum
SAPGTACADTLEFVDVSANLLIGARPACMRSNSSARTVLDAGNCFRDAKLQRPSTYCSPGALAALLPPPQGSGAEQGGGKGGGVGMVLGIVGGVVAGALLIALVMVVVLRRARRQHPGVMALPKSPLIRAAKKGDSAKATAKMSQKIATPADKRHASQAAMVNTLEVPAYRVYTTEELQEATVNFASSNLIKKSALAQHYNGQLQDGTRVLVKCLRLKPKYSPQSLSHYMEIISKFRHRHLVSIIGHCVVSDQENPTIASSVYLISECVTNGSLRSHLTEWRKREMLKWPQRVSAAIGIARGIQFLHNATAPDIVQNDLNIENILLDKTLTSKISGFSLPMISTSKNGKLFSENPFAVQEENDHYSAQSAEQGDKDDIYQFGQILLEVITGKPTASQSELESLRAQLSEALAEDPDMLKDMADPTIRGTFAVDSLSKVTEVALNCTAGDPSERPSVDAVLSNLQYSMRVQDGWASSESLSLSVKSQGVSQCNALFVAVHPYGWPFA

SEQ ID NO: 5588 - protein, 251 aa, Triticum aestivum
LLLVTVDLGREIDALMVVRAQIRMMIKCDIIFMADKTMIHMLDSIIKSLRPTSAEATDVANAVLDGTDCVMLSGESAAGAYPEVAVKIMARICVEAESSLDNDAVFKEMIKAAPLPMSPLESLASSAVRTANKARATLIVVLTRGGTTAKLVAKYRPRVPILSVVVPVLTTDSFDWTVSSEGPARHSLIYRGLIPLLAEGSAKATDSESTEEILQAALKSAVKKQLCKAGDAVVVLHRIGMASVIKICTVK

SEQ ID NO: 5589 - protein, 143 aa, Triticum aestivum
PVETFNPIRQGIHHDILLSNFFAQTEALMVGKNEEQVRAEMGTNVVENIVPHKIFKGNKPTNSFLFQKLTPATLGSLIAMYEHKIFVQGAIWDINSYDQWGVELGKQLAKAILPELSASGEVASHDASTNGLINHYKKNKKQY

SEQ ID NO: 5590 - protein, 205 aa, Triticum aestivum
MAAAAGGGVAGVAGSPCGACKFLRRRCVAECVFAPCISSQRGAARFAAIHKVFGASNAATLLAHLPLADRCEAVVTITYEAQSRLRDPVYGCVAHEFALQQQVAILQAQLMQARAQLACGVLQTASPVSHQWPDSSSSSIASLLRQQEVNSGSFATGGALLPELMGGDVSMLQQHCGGKVEGGGGGAGDLQYLAQAMMRSSNYSL

SEQ ID NO: 5591 - protein, 302 aa, Triticum aestivum
MSRGAAASGSLRTALSYCVQQVRSYDYHNYLCLLHLPPAMRKAAFTFRAFNVETAKAIDVVSDPRKGLMRLLWWKDVVDKVCAGKKVEHPVALALSSVLSEHKVSKHWLKRSLEARINDGNRDEDAIPENVPELERYAEDTQSTILYMTLQAGGIQSTVADHAASHIGKASGLLLLLKALPHHVSKQGKIPYIPASVAEECGLLAREGGRTEVRMGDALPDAVFKVASVAEAHLQKARELATSVPAEAVPVLLPAVPAQVLLDSLRRREFNVFDSRLSSGVHGISPLWYQLKLNWHAWRNKY

SEQ ID NO: 5592 - protein, 281 aa, Triticum aestivum
  misc_feature (206)..(206): Xaa can be any naturally occurring amino acid
  misc_feature (217)..(217): Xaa can be any naturally occurring amino acid
  misc_feature (236)..(236): Xaa can be any naturally occurring amino acid
MAAGAAASFGLMDKAYFGGRGEILSWVNATLQLSLNKVEEAASGAVQCRFWQYVSPGLVRCTRWNFDAKTEYELSRTYKILQDVFNKLRIGKNIEVNKLVKGFPLASFDFSQVLKCYTSSKMGESLMENQIPCYTCTWAAKSGAPKGPTKSSNSLQANRSSSANSADGGSLNSNTDLASPVGKVDNAVKDEHYMEQNSRITAKVAXLKVVVASLDKXRDFYFAKIRGIGVLCQRPXFEALPMTKGIRKILYAADAKDSSLPEANEIITRSPGMFSGSDEAE

SEQ ID NO: 5593 - protein, 189 aa, Triticum aestivum
ELARAPAPRPWTRPIGDVSVASSVERVFESQPPLPGTWGQVTLRSMAISVVLGTVFGFVGLRIMMKAGIIQALNLPINALSFFFLKWLINLQRAAGFTTLPFSRQENVLILTTVTTCLNTAICGGFANYVVGMTSGVAKSLGENPDPRDIVDHIPTGRWMLFLFLIGMVGVTASVPLNQVIHHLHILAE

SEQ ID NO: 5594 - protein, 231 aa, Triticum aestivum
MDSGDAWGRSSSTSSAAAAAARRLQSRYDLYMGFDDADAGGDEVEARGAEAYNCPFCGEDFDFVGLCCHIDDEHAVEAKSGVCPICATRVGADLIGHLTMQHGSYFKMQRRRRVRKVSSGSHSLLSLLRKDLRDGSLQSFLGGSSYVSNPPAAAPDPFLQSLICSLPVAEPSKDFRSESSDKTFLLNKFPDEKIVERAETSLSDKDQKERAQRSAFARGLVLSTIFDDDTM

SEQ ID NO: 5595 - protein, 174 aa, Triticum aestivum
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSSGYYDGRYWTMWKLPMFGCTDATQVLNEVEEVKKEYPDAYVRVIGFDNLRQVQCVSFIAFRPPGCEESGKA

SEQ ID NO: 5596 - protein, 95 aa, Triticum aestivum
MAAAVVDAAVPVAAKANGAGARCCAAKGPGYATPREAMEKGPREGLLYVTCVYNGTGIDKPDYLATVDVDPNSATYSQVIHRLQATHIGDELHHS

SEQ ID NO: 5597 - protein, 158 aa, Triticum aestivum
KVFKGVSAAKYHTLVFGADGEVFTWGHRLVTPRRVVIARCLKKGGNANVKFHRMERLQVISVAAGVMHSTALTADGALFYWNSSDLDLRCQQIFSMCGRNVVSISAGKYWTALATSTGDVFMCDAKKRKDETPVFTRVNGVKRASSVCVGETHMLVLS

SEQ ID NO: 5598 - protein, 496 aa, Triticum aestivum
MARKMLKDGEAPVVADDGGSYDYDLFVIGAGSGGVRGSRTAAGFGAKVAICELPFHPISSEWLGGHGGTCVIRGCVPKKILVYGASFRGEFDDAKQFGWEINGDINYNWKKLLENKTQEIVRLNGVYKRILGGSGVTMIEGAGSIVDAHTVEVTQPDGSKQRHTTKHILIATGSRATLVDIPGKELAITSDEALSLEELPKRAVILGGGYIAVEFASIWKGLGAEVDLFYRKELPLRGFDDEMRTVVASNLEGRGIRLHPGTNLTELSKTADGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAETKNDLLIYTSSFNPMKNSISKRVEKSTMKLVVDAETDKVLGAAMCGPDAAEIMQGIAVALKAGATKATFDSTVGIHPSAAEEFVTMRTLTRRVSPPSKPKTNL

SEQ ID NO: 5599 - protein, 501 aa, Triticum aestivum
MARKMLKDGEAPAVADGGGGEGEGSYDYDLFVIGAGSGGVRGSRTAAGFGAKVAICELPFHPISSEWLGGHGGTCVIRGCVPKKILVYGASFRGEFDDAKQFGWEINGDINYNWKKLLENKTQEIVRLNGVYKRILGGSGVTMIEGAGSIVDAHTVEVTQPDGSKQRHTTKHILIATGSRATLVDIPGKELAITSDEALSLEELPKRAVILGGGYIAVEFASIWKGLGAEVDLFYRKELPLRGFDDEMRTVVASNLEGRGIRLHPGTNLTELSKTADGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAEAKNDLLVYTSSFNPMKNSISKRVEKSTMKLVVDAETDKVLGAAMCGPDAAEIMQGIAVALKAGATKATFDSTVGIHPSAAEEFVTMRTLTRRVSPPSKPKTNL

SEQ ID NO: 5600 - protein, 151 aa, Triticum aestivum
MAAQAIHQFAECITCHAWSPDHSMIAFCPNTTEVHIYKFFTDKWEKLHVLAKHDQIVSGIDWSRSSNKIVTVSHDRNSYVWTQEGQDWVPTLVILKLNRAALCVQWSPKENKFAVGSGAKSVSICYYEQENNWWISKVIRKKHESSVTSVA

SEQ ID NO: 5601 - protein, 258 aa, Triticum aestivum
  misc_feature (242)..(242): Xaa can be any naturally occurring amino acid
MSATCAADLAPLLGAAAMNATDYLCNRFADTTSAVDSTYLLFSAYLVFAMQLGFAMLCAGSVRAKNTMNIMLTNVLDAAAGALFYYLFGFAFAFGTPSNGFIGKHFFGLKDMPQTGFDYSFFLFQWAFAIAAAGITSGSIAERTQFVAYLIYSAFLTGFVYPVVSHWIWSVDGWASAARTSGPLLFKSGVIDFAGSGVVHMVGGIAGFWGALIEGPRIGRFDHAGRSVALKGHSASLVVLGXFLLWFGWYGSTGVLRH

SEQ ID NO: 5602 - protein, 721 aa, Triticum aestivum
  misc_feature (233)..(233): Xaa can be any naturally occurring amino acid
KVFKGVSAAKYHTLVFGADGEVFTWGHRLVTPRRVVIARCLKHAGRANVKFHRMERLQAISVAAGVMHSTALTADGALFYWNSSDLDLRCQQIFSMCGRNVVSISAGKYWTALATSTGDVFMCDAKKRKDETPVFTRVNGVKRASSVCVGETHMLVLSSIYHPEYPPKPKIQSKKPSSEWSGVMEELDEDILFTDVKPETDLSVTNSEMSKGIPSLKSLCEKVAIQHIMEPKXNAIQLLEVADSLEAKELKKHCEDTAIRNLDYIFTVAAPSIMNASPEILANLERLLDEKSSEPWSHRRLPTMTATYPAVIDSDAEGDNAGGFPRLRDNQKPASKLYGMSGYGNFLQKESNAEQFVSKQIRAIRKKLQQIEMLEAKQLDGHQLDDQQLAKLESRASLESELAELGFPTEAFSRPSVYVPNKKSEGSKKQKKKIKQAAQSDITSIKHEDKEQNHIKELPDVIPTHGSSEKEPVKPSDDGTSSNTKAIFCPLGDKASRLTSSKKKNKKGGLSLFLSGALDDTSKLSLPTPAVPVTPKQEGPAWGGAKITKGPASLRDIQSEQRSKTNELMTTKAKDRHEDSPDSAGLLRLSSFMPDACSSPISVAPARAVPAHEGDKSTPPWSSSATSPNLSRPSLRDIQMQQEKRHHGVVSHSPKTRTSGFAIPSLGAAPEVVGVKDNVPNRWFKPETDTPSSIRSIQIEEQAMKDFKRFYTTVRIMKPQV

SEQ ID NO: 5603 - protein, 149 aa, Triticum aestivum
EPGNYWYHVCEGEAERVLPPPRHAIRLAPSLMSIVDDIISSMQQDFDSVHVGGSVGDLIQRIGDGVGVRRQVYIAGEGINTVSMEVLKAKYNNLRYLDEFQRLWRKDSKWFLEMKRLNGGVPVKFDGYMRELVDREVFLKGKKKVEVLH

SEQ ID NO: 5604 - protein, 377 aa, Triticum aestivum
  misc_feature (148)..(148): Xaa can be any naturally occurring amino acid
  misc_feature (161)..(161): Xaa can be any naturally occurring amino acid
  misc_feature (271)..(271): Xaa can be any naturally occurring amino acid
  misc_feature (281)..(281): Xaa can be any naturally occurring amino acid
  misc_feature (295)..(295): Xaa can be any naturally occurring amino acid
PRVRTCVSVNYDDFVNDVEAGDMLLVDGGMMSFLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVVIACVXVDLLFESECCDSXSLIRMCRSMGKAVIVATNMLESMIVHPTPTRAEVSDIAIAVREGADAVMLSGETAHGKFPLKAVKVMHTVALRTEATIIGGETPSNLGQVFKNHMSEMFAYHSTMMSNTXLGTSIVVFTXRTGFMSILLSHYRXPSGTIFAFTDQEIVRQRLALYQGVCPVHMEFSDCAEKTFADALSYLLKHGMVKEGEEVALVQSGRQPIWRSQSTHNIQVRKV

SEQ ID NO: 5605 - protein, 172 aa, Triticum aestivum
  misc_feature (63)..(63): Xaa can be any naturally occurring amino acid
QADRLSRHYPDSARIMCAQFSAFMGIPFSWILLTVIPQSTDYWLAYAITLFLMGITISWCATXANNPMFAEVVPPKHRTMIYAFDRAFEGSFASLAAPAVGLVTEKIYGYDAKTVNIANGSAQGAYALSRGLLTMMILPFGICVLFYSPLYLVFKHDRDNAKVTRFKDQELI

SEQ ID NO: 5606 - protein, 341 aa, Triticum aestivum
  misc_feature (90)..(90): Xaa can be any naturally occurring amino acid
MEQSQMARVKLGTQGLEVSKIGFGCMGLTGVYNDPVPEDAGVAVIRRAFDAGVTFFDTADAYGPHTNEVLLGKALRQVPRERVQVALRHXFAGFDAGGLCVKGTPEYVRASCEASLVRLGVDYIDLYFQHRIDQSVPIEETMGELKKLVEEGKVKYVGLSEASADTIRRAHAVHPITAVQMEWSLWTRDIEEDIIPLCRELGIGVVPYSPLGRGFFAGRAAVESLPSGSLLSKHPRYTGENLEKNKVLYTRLEILSTKYGCTPAQLALAWVLHQGDDVVPIPGTTKLKNLDDNIEAVKVKLSKEDLKEISAAVPAGEVAGSRIIGILEPYSWRVANTPPQK

SEQ ID NO: 5607 - protein, 169 aa, Triticum aestivum
MQGEVEQQAPMQMVLRVKHPSSLSSGSEEASEGEGSSRSALSVFKAKEEQIERKKMEVRDKVFAQLGRVEEESKRLAFIRQELEGMADPTRKEVESIQRRIDTVNRQLKPLSKSCVKKEKEYKEILEAYNEKSKEKAILVNRLIELVSESERMRMKKLEELNKTVDSLY

SEQ ID NO: 5608 - protein, 312 aa, Triticum aestivum
  misc_feature (249)..(249): Xaa can be any naturally occurring amino acid
MSSSNGNGGKKPAPSGGRGGIRTLADINRGPSGFPGAGGSGSDSDEPQEYYTGGEKSGMLVQDPTRRNNVDSIFEQARVMGAQQVPLPSFEGQSSSSTSFAGTGRLLSGDAQTAPAAPQPPQDVLHNIHFWNNGFTVDDGPLRAYEDAANADFIESIKKSQCPQELEPADRRTAVHVNVIKRHGDYEEPARPRSAFQGVGRTLGGSSADESPAPAPVTQEPHGAPRSIGIVVDDSQPFTSIQLRLADGXTRMVARFNLNHTVGDIRSFIDASRPGAARPYQLQTGFPPKQLTDPTQTVDQAGLKNSVIMQKM

SEQ ID NO: 5609 - protein, 130 aa, Triticum aestivum
MARSVPYVSAAKLVSMARGNRVAVIDVRDEERSYQAHIAGSHHFASGSFAARMPELVLATSGKDTLVFHCALSQVRGPSCARMFSDYLSESKEDSGIKNIMVLERGFNGWEISGQPVCHCKDAPCKGTCS

SEQ ID NO: 5610 - protein, 87 aa, Triticum aestivum
LPHLIVSGDQRHWGEVITPGVLFLYIAGWIGWVGRSYLIAVSGEKKPAMREIGLAFPPHSVLGSRSGSVPVGSFGFMYREQEGMADV

SEQ ID NO: 5611 - protein, 419 aa, Triticum aestivum
  misc_feature (154)..(154): Xaa can be any naturally occurring amino acid
  misc_feature (164)..(164): Xaa can be any naturally occurring amino acid
  misc_feature (213)..(213): Xaa can be any naturally occurring amino acid
  misc_feature (254)..(254): Xaa can be any naturally occurring amino acid
  misc_feature (260)..(260): Xaa can be any naturally occurring amino acid
  misc_feature (276)..(276): Xaa can be any naturally occurring amino acid
  misc_feature (302)..(302): Xaa can be any naturally occurring amino acid
  misc_feature (316)..(316): Xaa can be any naturally occurring amino acid
  misc_feature (337)..(337): Xaa can be any naturally occurring amino acid
  misc_feature (356)..(356): Xaa can be any naturally occurring amino acid
  misc_feature (399)..(399): Xaa can be any naturally occurring amino acid
MARKKIREYDSKRLLKEHLKRLAGIDLHILSAQVTQLTDFAELVNQHPWLSTTKLVVKPDMLFGKRGKSGLVALNLDVAQVKEFVKERLGVEVEMGGCKAPITTFIVEPFVPHDQEYYLSVVSERLGSTISFSECGGIEIEENWDKVKTVFLPXEKPMTPDACXVPLIATLITGGTRKRLVISFKGSVCCLPKNLDFSFIEMNPFTMVNGEPXPLDMRGELEDTASFKYFKKWGNLEVPSTIRQKISVLTQSFXDELDDXTPSASLKFTVLSPKGXLSWTMIGGGVASVAYADRDVDLGICXPELGNYAEFMGAPXQLEVCQYARASTRLCDCGTLXARKRALLIGGGIANITDVXATFSKHHAGHCEKNDSKLKASKMPNYVRRGSPNYQTWTVGLPXLGTEIRVQIEVYARKETIMG

SEQ ID NO: 5612 - protein, 339 aa, Triticum aestivum
MAEKQQQGSNVEEGSSRAAGKVVCVTGASGYIASWIVKLLLDRGYTVHGTVRDTADPDKTWHLRALDGANDRLQLFNANLLEEGSFDAAIDGCECVFHAASPVFFTIKDPKAELLEAAVSGTLDVLRSCKKASVKRVVITSSMAAVTFNGKPRTPDVIVDETWFSVPELCEKHQQWYVLSKTLAEEAAWKFSKDNELEIVVMHPTMVIGPLLQPTLNASVEVILNLINGSSSTYPNIAHGWVNVKDVALAHILAYEVPSADGRYCIVERVAHYLELVKIISKMYPNIPLPYKRGDDEPLFPTYQVSTDKIRSLGVELIPLETTIKETIESLKERGFFEF

SEQ ID NO: 5613 - protein, 429 aa, Triticum aestivum
  misc_feature (243)..(243): Xaa can be any naturally occurring amino acid
  misc_feature (257)..(257): Xaa can be any naturally occurring amino acid
HSITSLYKKAGWYRSGIPGISSTQPQTYRNRAQKQETEQDFYRFLCNLRSIQFTASKMVAKEAIPLLTPHRMGRFELSHRVVLAPLTRCRSYANVPQPHAAAYYSQRATKGGLLIAEATGVSATAQGYPETPGIWTQQQVDAWKPIVDAVHRKGALFFCQIWHVGRVSTNDFQPDGQAPISSTDKQITPDAESGMVYSKPRQLQTDEIPLIVDDFRRAARNAVRAGRSTAWEIHGAHGYLLEXQFMKDSSNDRTDEXTGGSLENRCRFAVEVIDAIVHEIGADRVGIRLSPFVDYMDCFDSDPHALGMYMVQQLNKHQGFVYCHMVEPRMAIVDGRRQIPHGLLPFRKAFNGTFIAAGGYDREEGNKVVADGYADLVAYGRIFLANPDLPKRFELDSPLNKYDRNTFYTQDPVIGYTDYPFLEGGSNAE

SEQ ID NO: 5614 - protein, 230 aa, Triticum aestivum
MASSTAAAALTCLHPAAQASRLPRAATACFARLPAAHPGSGSWGRAAVSVAAPRRRRRAPGVVYAAATTEKSIYDFTVKDIDGKNVSLSKFKGKALLIVNVASQCGLTTANYTELSHLYEKYKTQGFEILAFPCNQFGFQEPGSNTQIKQFACTRFKAEFPIFDKVDVNGPFTAPIYKFLKSSAGGFLGDIVKWNFEKFLVDKNGKVVERYPPTTSPFQIEKDIQKLTAA

SEQ ID NO: 5615 - protein, 177 aa, Triticum aestivum
MAGRDRDPLVVGRVVGDVLDPFVRTTNLRVTFGNRTVSNGCELKPSMVAQQPRVEVGGNEMRTFYTLVMVDPDAPSPSDPNLREYLHWLVTDIPGTTGASFGQEVMCYESPRPTMGIHRFVLVLFQQLGRQTVYAPGWRQNFNTRDFAELYNLGPPVAAVYFNCQREAGSGGRRMYN

SEQ ID NO: 5616 - protein, 513 aa, Triticum aestivum
MVSNGELSQPQAGEYGLAVMRRRPKTKIVCTLGPASRSVDMIEKLLRAGMCVARFNFSHGSHDYHQETLDNLHAAMDRTGILCAVMLDTKGPEIRTGFLKDGKPIQLRKGQEIVISTDYSIKGDDKMISMSYKKLAVDLKPGSVILCADGTITLTVLHCDKEQGLVRCCCENTAMLGERKNVNLPGVVVDLPTLTEKDKEDILQWGVPNKIDMIALSFVRKGSDLVEVRKVLGEHAKSIMLMSKVENQEGVANFDDILAQSDAFMVARGDLGMEIPVEKIFYAQKVMIFKCNIQGKPVVTATQMLESMIKSPRPTRAEATDVANAVLDGTDCVMLSGETAAGAYPELAVQTMAKICLQAESCVDYSAVFKSIMSSAPIPMSPLESLASSAVRTANSAKATLILVLTRGGTTARLVAKYRPSMPILSVVVPELKTVEFDWICSDEGPARQSLIVRGVIPMLSAGTAKAFDSEATEEALRFAMKNAKEMGLCNAGDSIVALHRIGNASVIKLLTV

SEQ ID NO: 5617 - protein, 299 aa, Triticum aestivum
  misc_feature (98)..(98): Xaa can be any naturally occurring amino acid
MNSARAAPPPHLALPATLGSPPPLTGAARVVALANTPMPLPRARRLPVDAWMSSNACVVVIPAPDVSLPRKLGADYVGTFILIFFATAAPIVNHKYGXGVISPFGNAACAGLAVTTIILSTGHISGAHLNPSLTIAFAAFRHFPWLQVPAYVTAQVLGSISAGFALKGVFHPFLSGGVTVPDVTISTAQALFTEFIITFNLLFVVTAVATDTRAVGELAGIAVGAAVTLNILVAGPTTGGSMNPVRTLGPPVAAGNYRQLWIYLVAPTLGAVCGAGVYKLVKLRDVNGETPRPQRSFRR

SEQ ID NO: 5618 - protein, 122 aa, Triticum aestivum
GETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 5619 - protein, 478 aa, Triticum aestivum
MAAFILFLCLLVPLVLACAVRARKGAAGRASSGGGGKKGGTSLPLPPGSMGWPYVGETTQLYSSKNPNVFFARKRNKYGPIFKTHILGCPCVMVSSPEAAKFVLVTQAHLFKPTFPASKERMLGPQAIFFQQGDYHAHLRRLVSRAFSPEAIRGSVPAIEAIALRSLGSWEDLQVNTFQEMKTYALNVALLSIFGEEEMQYIEELKQCYLTLEKGYNSMPVNLPGTLFHKAMKARKRLGAIVAHIISARRERERGSDLLGSFMDGREALTDDQIADNAIGVIFAARDTTASVLTWMVKFLGDNPAVLKAVTEEHAEIAREKALSGEPLSWADTRRMRMTGRVIQETMRVASILSFTFREAVEDVEYQGYLIPKGWKVLPLFRNIHHNPDHFPSPEKFDPSRFEVAPKPNTFMPFGNGTHSCPGNELAKLEMLVLCHHLATKYRWSTSKSESGVQFGPFALPINGLPMTFTRKDDKNKA

SEQ ID NO: 5620 - protein, 157 aa, Triticum aestivum
METGAKAPKKAGRRAGGGGPKKKSVSRSVKAGLQFPVGRIGRYLKHGRYAKRVGSGAPVYLAAVLEYLAAELLELAGNAARDNKKNRIIPRHVLLAIRNDEELGKLLAGVTIAYGGVLPNINPVLLPKKAAAAASKEPKAGTTKSPRKSPAKKAADA

SEQ ID NO: 5621 - protein, 378 aa, Triticum aestivum
MEVSSAAVEMEVEEGAGMDVSPAAAVAMVDSEHSSEEEEEEEVSSSPVLALPEQARRKQGPAVAAAVPALVMPKDQDLEKEKKEKERQRERERAPQVGYMSGGCKSDDGSLSCGYSSFRGKRATMEDFFDIKSSKIDDKQINLFGIFDGHGGSRAAEYLKEHLFENLMKHPQFMSDTKLAISETYKKTDSDFLDSEINTHRDDGSTASTAVLLGNHLYVANVGDSRAVISKSGKAIALSDDHKPNRSDERKRIESAGGIVMWAGTWRVGGVLAMSRAFGNRLLKQFVVAEPEIQDQEIDDELEFLILASDGLWDVVPNEDAVSLVKMEEDPEAAARKLTETAFGRGSGDNITCVVVKFQHSKTGGGDSPPISPPGNQI

SEQ ID NO: 5622 - protein, 214 aa, Triticum aestivum
  misc_feature (129)..(129): Xaa can be any naturally occurring amino acid
  misc_feature (206)..(206): Xaa can be any naturally occurring amino acid
MSMDHALACASSLVPCQEVVEEPLLNSLLSIKQGLNMFIIEDKGGAIAIMCASLFFLGTWPAVLTLLERRGRLPQHTYLDYSITNLLAAVLIALTFGQLGDAKHNMPNFFTQLSQDNWPSVMFAMAGGXVLSVGNLSTQYAWAYVGLSVTEVISSSMVVVIGTTLNYFLDNRINKAEILFTGVACFLVAVILGSAVHASNAADNEXKLSESTNT

SEQ ID NO: 5623 - protein, 193 aa, Triticum aestivum
MGSCVSRSTASVEPGSGRAVATARVVGLDGSLAQFAAPVTAGEALGDAARAPSFLCSADELRFDAPARALAAEEALQPGWLYFALPMSMLRRPLSGQEMAALAVKASSALAVASGKGRKAARVAPLVLADDEGTGTEDGGWSRHAYGKSDALKTVHGGGETVGKTRTRAGSYGSRTSRPAGVQRLSSILEADD

SEQ ID NO: 5624 - protein, 585 aa, Triticum aestivum
  misc_feature (513)..(513): Xaa can be any naturally occurring amino acid
MTTYRVCCFLRRFRPASNEPSEAIGDVFEAYAGADGSGSALGEEALRRFLREVQGEAGDDDVEAAAREVLAFAAEHRLLKKGGGLTVEGFHRWLCSDANAALHPRRGVHHDMGLPLSHYFIYTGHNSYLTGYQLSSGCSEAPIAKALRDGVRVIELDLWPNAAKDDVEVLHGRTWTSPVDLMKCLETVKEHAFVSSPYPVILTLEDHLTPHLQAKVAKMIKETFGDLLHLSESEAMPVFPSPEDLRGKIIISTKPPKEYLETKSSKEEAQNGSAEESVWGDEIPDNKAQVATARQVSEKDTERYVEEDEEMEKKVQQGVNGEYKSLISISLTRRKHDMDQDLKVDPEKVSRMSLGEAAYEKATITHGSEIIKFTQRNLLRIFPKTTRITSSNYNPLMGWRYGAQMVAANMQGHGRKLWLTQGMFRANGGCGYVKKPDFLMNTDKMFDPRSKLPVKTRLKVTVYMGDGWRFDFRKTHFDKCSPPDFYARVGIAGVVADTMMKETKVIMDNWIPXWDHEFEFPLSVPELALLRVEVHESDNHQKDDFAGQTCLPVWELRSGIRSVRLYARDGEVLRSVKLLMRFEFS

SEQ ID NO: 5625 - protein, 412 aa, Triticum aestivum
MSCLGWLKKRKGSGSGRRGSSASAPPATMTNMRPTIITRAATGSAVSTGRSDDPGAGRPIKASNVLLDKHRRAKLSDFGLAEGGAHRREHARLNCGCGDARVRGTGVDGGGARGRTGRPASAPPGPTASPSPASASTRAASRGHKQWLAEVQLLGVLEHPNLVKLLGYCAVDGERGAQRLLVYEYMPNKSLEDHLFSRIHPALSWNRRLQIILGAAEGLAYLHEGLELQVIYRDFKASNVLLDKDFQAKLSDFGLAREGPTEGNTHVSTAAVGTHGYAAPEYIEKGHLTAKSDVWGFGVVLYELLTGRRSLDRNRPQGEQKLIEWVVQFPPDSRNFRMIMDPKLRGEYSSKAAREIAKLAQSCLLKNPKERPAMSEIVEVLRRAVQTEQAYVDKAPVAGNGKRVNVAPPSRR

SEQ ID NO: 5626 - protein, 316 aa, Triticum aestivum
MGSGNLMVKKVVRPSSFDLDIHLDKSWKEDVTCPICLDYPHNAVLLRCTSYEKGCRPFVCDTDQTRSNCLERFKGAYELPANVKVSSIAVAPLDSIHIVSSHANNRPSCPLCRGDVIGWIVISEARLHLNQKKRCCEEDCCSFTGNFNELQKHTQQKHPDSRPSEIDPARQVDWDNFQQSSDIVDVLSTIHAQVPNGIVLGDYVIEYGDDDTGDDYEVLRRVRRKWWSFICCKAFCRYPRSRRRGRGRDNRGSGRRNSNQAHLENFNLEVPTQAVDLRELRFDEIDDEYIVTGAVPSMATPGRMASFHYRDTRYGR

SEQ ID NO: 5627 - protein, 231 aa, Triticum aestivum
SFPHPASPPCSPLARASPRRICRTLKPHADTAPLRPHPGHLLPPTAAGGAMEVGGEEFAVGVVISAKTTLGEEFEGQIVSFDRPSNLLVIQEGVGRAERGERRNVRVLKANYIQEFSVVGKYDDPLDPAGCVLDLAAIHAREEAALRQAEIEAERIGVGVTPEAQRLFDALSKTLPVHWDKTDIVVMKEVRVCSPYLPENVSGGTSAANERVKKVLDFERKRQHVRVPGQF

SEQ ID NO: 5628 - protein, 135 aa, Triticum aestivum
  misc_feature (15)..(15): Xaa can be any naturally occurring amino acid
  misc_feature (30)..(30): Xaa can be any naturally occurring amino acid
FLVVDYMTLKLVSSXLAKGIAATDAVHEYXHAKLCDLYENDSVVDKCECCLSGDGLHAATGSYSNLLRVLGCSPESVGASTLEASRNPMRRQVADPTRPARTLTGAVRRGGENTSVDSSGNFCDLLTKLVHLAWH

SEQ ID NO: 5629 - protein, 155 aa, Triticum aestivum
MDASATVAAGKAKKGAAGRKAGGPRKKSVSRSVKAGLQFPVSRIGRYLKKGRYAQRVGTGAPVYLAAVLEYLAAELLELAGNAAKDNKKSRITPRYLLLAVRNDEELGKLLAGVTIAHGGVVPKINPVLLPKKTAEKSTKEPKSPKKTAKSPKKA

SEQ ID NO: 5630 - protein, 178 aa, Triticum aestivum
NRAVFEVLGYCVCIAKGAAETTKLNMALILLPVCRNTLTALRSTALSSVIPFDDNINFHKVIAVGIAIGAGMHTVVHLTCDFPRLVSCPSDKFQEKLGPFFNYVQPTWGTLFASTPGWTGILLVLIMSFSFTLATTSFRRSVVKLPSPLHHLAGFNSFWYAHHLLVFAYILLVMHSYY

SEQ ID NO: 5631 - protein, 383 aa, Triticum aestivum
  misc_feature (143)..(143): Xaa can be any naturally occurring amino acid
  misc_feature (358)..(358): Xaa can be any naturally occurring amino acid
  misc_feature (374)..(374): Xaa can be any naturally occurring amino acid
MNSLTATGSSSGAGSSGGGGGGEMRAADGEGYLRADGFDLVNLDMQLEKTRSRVWLDQQRGASPAQPGELLEWEIDLAKLDIQNQVASGTFGVVYRGTYDGNDVAVKVLDWGQEGQESSSKHREAFEKEVAVWQKLDHPNVTXFVGASMGTSQLKIPASKKGGSSHGPGQRCVVVVEYQHGGTLKTLLFQHRDKKLPYKKVVQLALDMARGLSYLHSQKIVHRDVKAENMLLDRKKSVKIADFGVARVEAQDDDNMTGQTGTLGYMAPEVLEGRPYDHKCDVYSFGVLLWETYCCALAYPNYSIADISYHVVKLGIRPDIPRCCPKPLSEIMTRCWDGNPDHRPEMAEVVAMLERIDXTKGKSMTPARPDHTSXGCSCFGFSK

SEQ ID NO: 5632 - protein, 177 aa, Triticum aestivum
  misc_feature (9)..(9): Xaa can be any naturally occurring amino acid
  misc_feature (106)..(106): Xaa can be any naturally occurring amino acid
ANTLRSEEXGDIVSLKNYMNAQYFGEIGVGTPPQKFTVIFDTGSSNLWVPSAKCYFSIACYLHARYKAGASSTYKKNGKPAAIQYGTGSIAGYFSEDSVTVGDLVXEIIFGGMDPKHYVGEHTYVPVTQKGYWQFDMGDVLVGGKSTGFCAGGCAAIADSGTSLLAGPTAIITEINE

SEQ ID NO: 5633 - protein, 359 aa, Triticum aestivum
IAGYFSEDSVTVGDLVVKDQEFIEATKEPGVTFLVAKFDGILGLGFKEISVGKAVPVWYNMVEQGLISDPVFSFWLNRHADDEGEGGEIIFGGMDPKHYVGEHTYVPVTQKGYWQFDMGDVLVGGKSTGFCAGGCAAIADSGTSLLAGPTAIITEINEKIGAAGVVSQECKTIVSQYGQQILDLLLAETQPKKVCSQVGLCTFDGTRGVSAGIRSVVDDEPVKSNGLHTDPMCSACEMAVVWMQNQLAQNKTQDLILDYVNQLCNRLPSPMGESAVDCASLGSMPDIEFTISGKKFALKPEEYILKVGEGAAAQCISGFTAMDIPPPRGPLWILGDVFMGPYHTVFDYGKLRVGFAKAA

SEQ ID NO: 5634 - protein, 249 aa, Triticum aestivum
  misc_feature (113)..(113): Xaa can be any naturally occurring amino acid
  misc_feature (220)..(220): Xaa can be any naturally occurring amino acid
MGANGHPPPASAAAQNGSHSSGGGGGGGGGGGGGGGANPSSGGTAAALRHDPGLSREWTPEEQAILDELLVKYASDAPVIRYAKIAMKLPEKTVRDVALRCRWSSCHICICRXDLPPGSPMRGLDHVQGVPGSPPLPPGLLAGRPSVPPYSLPALPVDDDEISSKAIGGPTGELLETNAQVLSQISTNLGTMQIQDNISLLCQTRDNILRVLKEMNDAPXIIKQMPPLPVKINEELVNSILPRPTVPMQ

SEQ ID NO: 5635 - protein, 436 aa, Triticum aestivum
MNSLQSFLAVAPVKPAAAAARLPSSRRARVSACLATPAPAPTAPAAAASARRELSAASRAVMADEAKYIVGTYKRAQVVFVAGRGCKLYDIDGREYLDMAAGIAVNALGHGDPDVDAAAADQRGRLVHASNVGYTVPQVELAKRLVEASFADRAFFANSGTEANEAAIKFSRKYQRVAHPNGDAPTEFMSFTNCFHGRTIGSLALTSKVQYREPFEPVMPGSTFVEYGNLEEAKKVIQSGKIAAVFVEPVQGEGGIHSATKEFLQGLRDACDEAGALLVFDEVQCGLGRTGYLWAHEVYGVVPDIMTLAKPLANGLPIGVALVTEKVAAAINYGDHGTTFGGGPFVCHAALATLDKIQKPGFLAEVTRKGEYFKQLLKAKLSGNPHVKEIRGAGLIVGIELDVPAGPLVDACLNAGVFLLTAAKGSVLTCMLVPIC

SEQ ID NO: 5636 - protein, 238 aa, Triticum aestivum
  misc_feature (233)..(233): Xaa can be any naturally occurring amino acid
RTRGRRRARPGDRVSPPGDWGEWRERGVVAQGDQPASLERVFADQRVPSWREQLTVRAFVASFFLAVMFNIIVMKLNLTIGVIPSLNVSAGLLGFFFVRLWTSAIERMGLLKQPFTRQENTVIQTCVVAAYGIPYSGGFGNYLLAMSGRIASQATEANNPQNIKNPHLGWIIGFLFLVSFIGLFGLVPLRKIMIIDYKLTYPSGTATAYLINGFHTPQGAKIAEKQVKKLGKXLGSQL

SEQ ID NO: 5637 - protein, 140 aa, Triticum aestivum
MTAPAEDKSVIIGERNKVATEKIKGAVNRGYKRIAVLYGGGHMPDLGRRLREELNMVPSNVQWVTAWSIRSRELDKKSLPFLKTMAEVSGWPLNRYETLALLIFSSVLAVDLWFWEFLVESSLNWASLAGSWIDQFSAPF

SEQ ID NO: 5638 - protein, 259 aa, Triticum aestivum
  misc_feature (247)..(247): Xaa can be any naturally occurring amino acid
MIEQFVNFVIRPPRSEYNPDQYLWEREFMLAGRRYKRLDLELTNPRGHTLKCSHYLPASVPENIALPCVIYCHGNSGCRADANEAAVVLLPSNITVFTLDFSGSGLSDGDHVSLGWHEKEDLKCAVSFLRTNKQVSRIGLWGRSMGAVTSLLYGAEDPSIAGMVLDSAFTNLYGLMLELVDVYKIPVPKFTDNMAVQYMRRTIQKRAKFDIMDLNVVKLAPKTFIPALFGHGLSDMFIQPHHCDRIXEAYGGDKSMVKF

SEQ ID NO: 5639 - protein, 110 aa, Triticum aestivum
MPPPRTLAVLLLAVVAVAAHGRLLASDGLPGQGSASDAAVLRLSSAGRPAGEAEEGGCEMTYGFLPCTETAGGNLFLALAYGFLMFKSATYLSAGSELLLEILGPGIVGG

SEQ ID NO: 5640 - protein, 214 aa, Triticum aestivum
  misc_feature (56)..(56): Xaa can be any naturally occurring amino acid
  misc_feature (82)..(82): Xaa can be any naturally occurring amino acid
  misc_feature (207)..(207): Xaa can be any naturally occurring amino acid
MAAGALGLALVAALAVALAGANSEGDALSALRRSLRDPGGVLQSWDPTLVNPCTWXFHVTCDRDNRVTRLDLGNLNLSGHLXVPELGKLEHLQYLELYKNNIEGTIPPELGDLKNLISLDLYKNNVSGTIPPTLGKLKSLVFLRLNGNRLTGPIPRELAGISSLKVVDVSGNNLCGTIPTTGPFEHIPLSNFERNPRLEGPELQGLXAVYETNC

SEQ ID NO: 5641 - protein, 295 aa, Triticum aestivum
  misc_feature (166)..(166): Xaa can be any naturally occurring amino acid
MDGEWWRKKWVAWAAAAAIFVVLMLVTPAIPQDEDYHDFADQRDLFLGIPNTLNVLSNIPFLFVGLAGLILCHYKNYFRLCSQGELWSWTLFYAGVTAVGVGSSYYHLYPNDATLVWDRLPMTIAFTSIVAIFIIERVDDRAGTKSLAPLVIAGALSILYWSFFDXDLRPYAVIQFVPCIVIPVMAIVIPPMYTHSSYWLWAAGFYLLAKVEEAADKPIYRWTHDIVSGHTLKHLCAAMVPVFLTLMLAKRTIEPDRVSLLQMWKISWRERGSQDGNTVDVKYDYAAVSTTSEQQ

SEQ ID NO: 5642 - protein, 325 aa, Triticum aestivum
  misc_feature (135)..(135): Xaa can be any naturally occurring amino acid
MEAETAAKRARESEGAAAADGAGEQAGISAVIPGWFSEISPMWPGEAHSLKVEKVLFQGKSDYQNVLVFQSSTYGKVLVLDGVIQVTERDECAYQEMITHLPLCSIKDPKKVLVIGGGDGGVLREVSRHSSVEQXIDICEIDKMVVDVSKQFFPRLALGFEDPRVSLHIGDGVAFLKNAPEGTYDAVIVDSSDPVGPAQELFEKPFFESVSRALRPGGVVCTQAESIWLHMHIIEDIVTNCRQVFKGSVNYAWTTVPTYPSGVIGFMLCSTEGPSVDFQHPVFSIEEDEYSTKSKGPLKFYNSEFHTASFCLPSFARRVIEAKAN

SEQ ID NO: 5643 - protein, 81 aa, Triticum aestivum
MGGEGASSSGGGFRARIDHYLYSGEKKHVVAGIAIFAAIFGVPWYFMTRGAKHDSHQDYVERANKARSDRLSSGQPSSLKE

SEQ ID NO: 5644 - protein, 160 aa, Triticum aestivum
LLHGIVHLNGYGHLVALHGFKGGSDFVSGHQIMDRPPTRPPGYPAQLAGAFRDNVRTLLGLRLLHGVAYGDTWFGRWGFRYGRPSYGVALQSYQQSLHALQSIPLCVLEPHLSCFSQELPMVVTKYQAISGHKLLNLGDLLRFMLELRTRLSDTFGTGMD

SEQ ID NO: 5645 - protein, 502 aa, Triticum aestivum
MVATAKIPQRQLFIDGDWRAPALGRRLPVINPTTEASIGEIPAGTSEDVDAAVAAARAALKRNRGRDWSRAPGAVRAKYLRAIAAKMIERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASLTCLELGDVCKEIGLPSGVLNIVTGLGHEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGEGGIDNYLSIKQVTEYTSDAPWGWYKAPA

SEQ ID NO: 5646 - protein, 822 aa, Triticum aestivum
HAFAHASDSYYGSNVARTFLIHATPAQSKAYETLLKAQEAALAACIPRNHMSAVFKAAVAVFEKNAPELLPYLTKSAGTGIGLEFRESGLNLNGKNDRLIKEGMIFNVNLGLSNMQAETNNEKTKQFSLLLADTALVNDKAAEILTNCSKAVKDVAYSFNEDEEEVPKPKRAKVEPNGVEALPSKATLRSDNQEMSKEELRRQHQAELARQKNEETARRLAGGGSGNGDGRGPSRNSNELVAYKNVNDVPYSRELVIQVDQRNEAVLLPIYGSMVPFHVSTVKSVTSHQDNRTCTIRIFFNVPGMPFSNDKDLKSQGAIYLKEITFRSKDPRHSSEVVQQIKTLRRQVASRESERAERATLVTQEKLQQASNKTKQMRLNDVWIRPPFGGRGRKLTGTLEAHVNGFRYSTSRADERVDIMYGNIKHAFFQPAEKEMITLLHFHLHNHIMVGNKKTKDVQFYVEVMDVVQTVGGSRRSALDPDEIEEEQRERDRKNRINMEFQNYINKVNDHWSQPQFKGLDLEFDIPLRELGFHGVPYKASAFIIPTSTCLVELIETPFLVVTLGEIEIVNLERVGFGTKNFDMAIVFKDFKKDVLRIDSIPSTSLDAIKEWLDTTDLKYYESRLNLNWRPILKTIIDDPQKFVDDGGWEFLNMEASDSEAEETEESDQGYEPSDAEPESESEEEDSDSASLVESDEDEEEDSDEDSEEEKGKTWDELEREATNADRDHGAESDSEEERRRRKVKTFSKSGAPPQRGPSSSKHAPLPQRGGSSSGNKSRPPPSSSKGGAALEEAEVQVIGSSWSRPLNLALSGRHSICMVWL

SEQ ID NO: 5647 - protein, 384 aa, Triticum aestivum
  misc_feature (286)..(286): Xaa can be any naturally occurring amino acid
  misc_feature (299)..(299): Xaa can be any naturally occurring amino acid
  misc_feature (338)..(338): Xaa can be any naturally occurring amino acid
MAAAASSPSPPAVITCRAAVAWGPGQALVMEDVEVAPPGPLEIRVKVVSTSICRSDVTQWQSTAQPDLFPRIFGHEASGVVESVGEGVTEFQVGDHALTVFIGECMSCKHCVSGKSNMCQTLGLERKGVMHSDQTTRFSIGGKPVYHYCAVSSFSEYAVVHSGCAVKVSPTMPMDRICLLSCGASAGLGAAWNVADVSKGSSVVIFGLGTVGLSVAQGAKLRGASKIIGVDTNPAKQEKGKAFGVTDFINPAELNEPLQQVVKRLTDGGADYSFECVGDTGGLCLXGWRPKSDIPLLVXSTQTRKSKLMALSHMICHSVTSTKRSLFGGWRPKCDIPXYVEKYANKEIQVDGLVTHDMPFSDINKALELMLQNRCLRCVIHMPK

SEQ ID NO: 5648 - protein, 279 aa, Triticum aestivum
  misc_feature (230)..(230): Xaa can be any naturally occurring amino acid
  misc_feature (251)..(251): Xaa can be any naturally occurring amino acid
AADYPHRGGGRLGLGPFAAAVFRTDNRRRAIAGGAVLASALLLVATPRLRHSPALHLFADMRNLLGVPNTLNVLTAYPLLLAGVPGLILCLFGGGCFGISLRWEALGWFLFYVGNVGAAFGSAYYHLKPDDDRLIWDRLPMMMSASSLLSILVIERVDERAGLSCLISLLSLLLVSSACERILDDMRLWVVLNLVPCVAIPAMLFLFPPKYTHSRFWFLATGFYLLAKIXEGLADRKVYSVNRYFISGHSXLEHLCFAMVTLILTVMLSFRNIKIARDS

SEQ ID NO: 5649 - protein, 224 aa, Triticum aestivum
  misc_feature (139)..(139): Xaa can be any naturally occurring amino acid
PRVRSGSAAALRSLLSRKLRRSTLLLWFVFYANSFAYYGLVLLTAQLSNANRSCASGLKYVKSETDASLYKDTFVTSLAEIPGLIASALLVEWFGRKATMWCLLFTCCGFLGPLVFYQSELWTTGLLFGARACAMGSYXVVCLYAPEDLCQAFFPVYPTSVRSTGVGIATAMGRVGGIICPLVAVGMLRSCHQMEAIIVFEVVLFLAAIACMLFPFETKGRAMN

SEQ ID NO: 5650 - protein, 225 aa, Triticum aestivum
MDSEHWISRLAAAKRFYAAQLGHADRAGMDELDMDGDENAGRPDFACPYCYEDHDVASLVAHLEEDHPFEPHAAPCPVCSEKVSKDMLNHITMQHGYLFKNRRRLRRFAVPGSQSLSLLSRDLREAHLQVLLGGGGHRSSNNNATNISADPLLSSFGLSFPTLDAEETSKLSTPAQSDVPVLKEAAARPWRSSIDSSLTREEREQARVRAAFVQDLLLSTLFRDQ

SEQ ID NO: 5651 - protein, 227 aa, Triticum aestivum
MDSEHWISRLAAAKRFYAAQLGHAGADRAGMDELDMDGDENAGRPDFACPYCYEDHDVASLIAHLEEDHPFEPHAAPCPICSEKVSKDMLNHITMQHGYLFKNRRRLRRFAVPGSQSLSLLSRDLREAHLQVLLGGGGHRSSNNNAANISADPLLSSFGLSFPTLDAEETSKLSTPAQSDVPVLKEAAARPWRSSMDSSLTREEREQASVRAAFVQDLLLSTLFRDQ

SEQ ID NO: 5652 - protein, 225 aa, Triticum aestivum
MDSEHWISRLAAAKRFYAAQLGHADRAGMDELDMDGDENAGRPDFACPYCYEDHDVASLVAHLEEDHPFEPHAAPCPICSEKVSKDMLNHITMQHGYLFKNRRRLRRFAVPGSQSLSLLSRDLREAHLQVLLGGGGHRSSNNNATNISADPLLSSFGLSFPTLDAEETSKLSTPAQSDVPVLKETAARPWRSSIDSSLTREEREQASVRAMFVQDLLLSTLFRDQ

SEQ ID NO: 5653 - protein, 372 aa, Triticum aestivum
MSKQGGIGSTVPLLTPYKMGAFDLSHRVVLAPLTRTRSYGNVPQPHAILYYQQRTTKGGLLIAEATGVSDTAQGYKDTPGIWTKEQVEAWKPIVDGVHAKGGIFFCQIWHVGRVSNHTYQPNGQAPISSTDKPLKPMVIDKHIVADFATPRPLETDEIPMVINDFRVAARNAIEAGFDGVEIHGAHGYLIDQFFKDQVNGRTDKYGGSLENRCRFGLEVVQAVVDEIGAGKVGMRLSPFANYWESSDSNPGALGLYMAHALNKIGILYCHTVEPRMITFVDKVETPNSLRAMRDAFKGTFIVAGGYGREDGNAAVSSGYADLVAYGRLFLSNPDLPQRFEIDAPLNKYNRDTFYISDPVVGYTDYPFHLSDV

SEQ ID NO: 5654 - protein, 464 aa, Triticum aestivum
MMESYAASPKDGGAEGGRADAATGLEESMWRLGLAGGEEAAGEGLPERPGEANCVYYLRTGACGYGETCRYNHPRDRAAAFDGGTRTARTVEYPERPGQPPCEYYMKNGTCKFGSNCKYNHPREGGSVQPVVLNSCGYPLRLGEKECSYYIKTGHCKFGSTCKFHHPEGPEHGVVSETPNMYPPVQQLPVSSPLPYPPLASWQLGRPSVLPGSFFPGSYPPMMHPSAVMPMQGWNPYMPPINQVASAGGQQTVQAGPLYGLSHQGPPSAVAYGSNYASLSSSAWPSSDKQEVVFPERPGQPECHHYMKTGTCKFGSTCKYNHPQYLSTPRSNYMLSPLGLPIRPGAQPCLYYSQHGFCKFGPGCKFDHPLGALSYSPSASSLGDVPIAPYPLSLPVAPMAPSPLSSGLRPDYILAKDSSANQPASPGTTFGNAGQLSKIYAPHMLLRPPTSATGATVTIHGGEF

SEQ ID NO: 5655 - protein, 275 aa, Triticum aestivum
MSGAAYRDRGFGGAAEMDRKRIKEALEKHTERPSPSTSRGASREKELLAAGKITTQIGKVPKVSDVEEFETDSEDSDVSGSEGEDTSWISWFCSLRGNEFFCEIDDDYIQDDFNLCGLSSQVPYYDYALDLILDIESSNGDVFTEEQNELIESSAEMLYGLIHARYILTSKGLAAMLEKFKNYDFGRCPRVYCCGQPCLPAGQSDIPRSSTVKVFCPKCEDLHYPRSKYQGNIDGAYFGTTFPHLFLMTYPHLKPQKPSQQYVPRVFGFKLHKQS

SEQ ID NO: 5656 - protein, 94 aa, Triticum aestivum
AQDNCMLGMGSGQPNRVDRLRIAFRKAGEAAKGAALASDAFFPFAWKDAVEEACENGISTIAQPGGSMRDKDAVDCCNKYGVSLLFTGVRHFRH

SEQ ID NO: 5657 - protein, 121 aa, Triticum aestivum
IGFLFTAVVTGIFGFLSALSPNYMCLLTLRFIVGMGLGAGHVLGTWFLEFVPAANRGTWVVVFHCTWSFGTILQALIAWVFFLISLPFSAQLSVCCQFTISHICQSTLFISVILGFILLIL

SEQ ID NO: 5658 - protein, 467 aa, Triticum aestivum
MIPAGGGPPKEKWHAPAVDLVVRGRQPKRQALPSYPSPVVVTATSAHAQSLTASPATTDHLRPPLLLPSPVMAPRAGGQTYGFPIYCASWLPLAHIIKPSPSADDVVDADASPALSSPPPPPMVALGGGGGEGRSGVPNALVVAALDPAAAGAPPALSPEPVFRLGTEEQVPYRMAVHPRGDGVLCAFPNGCRLVRWESPEGEDRHSLVLISDQEALVKLKDVGLQLAVAFSGEGSLLATGGEDGHLRVFKWPGMETIIEDPDAKTSVKDLSFSSDEKFLVVNRSSGPSRVWDLKSSEAVANLPREQGEIFGFCRFSTKSDNSQILFVTAMQGDYGKIISWNTTSWTRIGSKKVTRDAISAFSVSPDGTLLAIGTIEGTISVLGSRDMRVVVTVKKAHLGIVTTLAFSQDSRALLSTSFDSTARVTSTESPKSDGISLWSMVLAIILAILAYYYMQHKEDLLAMLPQ

SEQ ID NO: 5659 - protein, 218 aa, Triticum aestivum
MSMLGLRGLPAKMPKPPTRPLKTVAKEKKTKATNNWMTILGLPPKKASANDQVPPNEQQQTQHKTSEDTKKLAANALAAVRDAATAASGRGKVEITEVRDFAGKDIEIKKLVDADSKEAVEKASAAGASPSAVDNILEQIRKKQKLSVLDKTKKDWGEYKAEKGVEEELGAYKKSSNQYLDRQSFLKRADYREYELERDARLSLMAKRKSESMQDDDV

SEQ ID NO: 5660 - protein, 498 aa, Triticum aestivum
  misc_feature (65)..(65): Xaa can be any naturally occurring amino acid
HEGGILLCVTGSEAMYADLGHFSQRSIQIAFISVVYPALVLAYMGQAAYISQHHSFENSYHIGFXRPRTRGLRWPVLVIAILASVVGSQAIITGTFSIIKQCSALSCFPGVKIVHTSSTVHGQIYIPEINWILMILCLAVTIGFNNTKHLANAQGLAVITVMLVTTCLMSLVIVLVWNKSIFIALGFLMFFGSIEVMYFSASLGKFHEGAWVPITLSFIFMVVMSVWHYGTIKKYEFDVQNKVSVNWLLNLGPSLGIVRVRGIGLIHTELMSGIPAIFSHFVTNLPAFHQVLVFLCVKSVPVPHVEPEERFLVGRIGPKEYRLYRVIVRYGYRDVQQDDLEFEKELINSIAEFIRSGGADQNGFVEGSEKLSSISSGAIPLWEEGGDGEVDGPASPNKEINQQTVVPQRKQARFVLPKSAQVDAEVRSELQDLMDAREAGMSFILGHSHMKAKSGSSFVKRIVINFFYEFLRRNSRGPSYAANIPHASTLEVGMVYQV

SEQ ID NO: 5661 - protein, 194 aa, Triticum aestivum
  misc_feature (49)..(49): Xaa can be any naturally occurring amino acid
  misc_feature (65)..(65): Xaa can be any naturally occurring amino acid
  misc_feature (100)..(100): Xaa can be any naturally occurring amino acid
  misc_feature (141)..(141): Xaa can be any naturally occurring amino acid
MDGGGGMGPVGGGVGGMVGPVGVGGGGGGSDVELVSKTLQFEHKLFYFXILKENPRGRYLKMSEXTSTTRSTIIVPIAGVAWFLDLFDYYIRTDERDVFXKELRLDTKVFYFDIGENKRGRYLKVSEASVNRNRSTIIVPXAGSSGEEGWEAFGNVLFEINDEASRLYDLPNDASQATPGTSMAPSRPFWRCSC

SEQ ID NO: 5662 - protein, 398 aa, Triticum aestivum
  misc_feature (174)..(174): Xaa can be any naturally occurring amino acid
MASMTTPRLPFLPARTCSAAAAFSSLSSSPLQCCPVKRTSVTNANSAPLLSTSRPGAPAADGVGAADLNRLRASAMPVADSPLPAYCNPHELPRPLTSAALMESSGEGLKVAYQGFPGAYSESAAKKAYPHCQTVPCEHFDTAFQAVENYTVDRAVLPLENTLGGSIHRNYDLXYLRHELHIVGEVRLAVRHCLLANRGVKIGNLRNVISHPQALAQCEHTLTELGIEHRQAVDDTAGAAKLVAEQMLQDTGAVASSLAAELYGLDILAENIQDEKVNVTRFMMLAREPIIPRVDKPFKTSIVFSLEEGPGQLFKALAVFALREINLTKIESRPHKKRPFRVADDAFSTRVKYFDYLFYVDLEASMADPKTQNALRNLEEFATFLRVLGSYPTDVSEA

SEQ ID NO: 5663 - protein, 224 aa, Triticum aestivum
MGCLPSRASNRMASTDAPPANTKALLDGVSGKAREGELFAVMGASGSGKSTLVDALAGRIARDSLRGHVTLNGEPLHGSRLRAISAYVMQDDLLYPMLTVRETLLFAAELRLSRALSPAAKRERVDRLIDQLGLSRAADTIIGDEGHRGVSGGERRRVSIGTDIIHDPILLFLDEPTSGLDSASAFMVVQVLRTIARSGSVVVMTIHQPSARILGILGRLLLLS

SEQ ID NO: 5664 - protein, 167 aa, Triticum aestivum
MAASRGLPLLLVLAALLVGLASASSFISDGVFQAGAGSTTGRTLLQAKRDCPVNFEFQNYTVITSRCKGPKYPAKDCCDSFKEFACPFNNYINDESNDCASTMFSYINLYGKYPPGLFAHECREGKLGLSCEGVPQKDVVKSGVQRARSSSLALITLMCGLVALFFQ

SEQ ID NO: 5665 - protein, 158 aa, Triticum aestivum
MEYQGQQQHGQAATNRVAEYGNPVAGHGAGTGMGAHGGVGTGAGAAAGGHFQPTREEHKAGGILQRSGSSSSSSSSEDDGMGGRKKKGIKDKIKEKLPGGHGDQQQTAGTYGQQGHTGTAGTGGTYGQPGHTGMAGTDSTGEKKGIMDKIKEKLPGQH

SEQ ID NO: 5666 - protein, 277 aa, Triticum aestivum
MQRDRGVSAAAGGAGERKRIGEAMDRSSPSTSWGFSGGRERDRIAAGKQPEVPRSGGGSTAMSKGKLSDGESDTDSEESDLSGSDGEDTSWISWFCSLRGNEFFCEVDDDYIQDDFNLCGLSGQVPYYEYALDLILDVESSHGDMFTEEQNELIESAAEMLYGLIHVRYILTSKGLAAMLDKYKNYDFGRCPRVHCSGQPCLPVGQSDIPRSSNVKIYCPKCEDLYYPRSKYQSNIDGAYFGTTFPHLFLMTYPHLKPQKPSQQYVPKVFGFKLHKP

SEQ ID NO: 5667 - protein, 362 aa, Triticum aestivum
  misc_feature (200)..(200): Xaa can be any naturally occurring amino acid
  misc_feature (213)..(213): Xaa can be any naturally occurring amino acid
AYRQDQIVSVWLLQSTTFFSIWIKQHLQSIVHIFYSEGTDHSYSWYLQLRNLVWATSKHDVYMAQNNSVMHWSSLLQRGTEVLHVAGQVVPKQKAHGARTLSRVQISSMALKDNLMVAGGFRGELIFKYVDKPGVAFCTNAADNKNSVTNAVDVYESPSGATRVTAANNDCTVKFLDAERCSLLSRFTFPWSVNNNIGEXPDGKLLAVLGDSXPDCVIADAQSGEEIATLKGHLDYSFSSAWHPGGHVLATGNQDKTCRLWDTRNLSAPFAVLGGRIGAVRGLRFSSDGRFLAAAEAADFVHVYDARAGYGAAQEIGLFGEIAGVAFSPDADALFVGVADRAYGSLLEFGRRGRHAYLDSYL

SEQ ID NO: 5668 - protein, 273 aa, Triticum aestivum
  misc_feature (233)..(233): Xaa can be any naturally occurring amino acid
MLSTAPAAYSTSFAAFPTLARRRHRHRRVLLPFAAATDGAERFAASSSIADYLRYRRPMSGDLSVGGGGGKLQTAVVRYEKRFPWSLIHPFLLVDLVSTVHIADKEYFDKLQQALEDYDCVLYEMVISRDNLNNQQDPTFAKKMRSSRKGFSILGFIQKQMARILSLDYQLDCLDYGDEKWQHADLDYETFKLLQTERGESFLTFAVDMTLKSTKALVQPTSPDGLDFWRSKXLWASRVLPMPLIGLFVITGLCLPVDKQDGYPELEALSKLD

SEQ ID NO: 5669 - protein, 449 aa, Triticum aestivum
  misc_feature (120)..(120): Xaa can be any naturally occurring amino acid
  misc_feature (433)..(433): Xaa can be any naturally occurring amino acid
YNKFVQKSRLVPVRNSRDIVDPRVRGIQLIECVRGGPLSFRSSQALVLVLTFLSYASYHATRKTTSIVKSVLDPKTTNLGLLHWPSHMYLQELKGAANNTALESGWAPFNGEDGTQLLGXDLAFLGVYAIGMFFAGHLGDRVDLRILLTIGMVGTGLFTAAFGAGYWLNIHSFYYFLGVQMIAGLFQSSGWPSVVAVVGNWFGKSKRGLIMGIWNAHTSVGNISGSLIAAAMLKFGWSWSFAVPGAMIALVGLAVFLFLPVDPEVIGVEEDRHVKDYEKNGTDVPLLEGHSSGRDEAVGFIQAWRIPGVAPFALCLFFCKLVAYTFLYWLPFYLSHTEIGGEYLSDSAAGILSTLFDVGGVVGGILAGHISDRLDARALTAATFTFSAIPALFFYRIYGSISLTWNVALMFVTGVLVNGPYALITTAVCGDLXTHRWVDGDSQALGPGA

SEQ ID NO: 5670 - protein, 478 aa, Triticum aestivum
MEVVTSQWMNCSKLAKSITCQMLFLMMSLKKLTGTMMGASTICKSISRRKRITKGDIDDVRREIQIMHHLSGHLNVVAIKGAYEDQLYVHIVMELCAGGELFDRIIQRGHYSERKAAELTRIIVGVVEACHSLGVMHRDLKPENFLLANKDDDLSLKAIDFGLSVFFKPGQIFTDVVGSPYYVAPEVLCKKYGPEADVWTAGVILYILLSGVPPFWAETQQGIFDAVLKGVIDFDSEPWPVISDSAKDLITRMLNPRPAERLTAHEVLCHPWIRDQGVAPDRPLDTAVLSRIKQFSAMNKLKKMALRVIAESLSEEEIAGLKEMFQTMDADNSGAITYDELKEGLRKYGSTLKDTEIRDLMDAADVDNSGTIDYIEFIAATLHLNKLEREEHLVAAFSYFDKDGSGYITVDELQQACQEHNMPDAFLDDVIKEADQDNDGRIDYGEFVAMMTKGNMGVGRRTMRNSLNISMRDAPGAI

SEQ ID NO: 5671 - protein, 301 aa, Triticum aestivum
  misc_feature (142)..(142): Xaa can be any naturally occurring amino acid
  misc_feature (184)..(184): Xaa can be any naturally occurring amino acid
MLPYATAGEAEAALGRALTWAEAAWLRYSASVPDRYLHWPNIAITLVVYTLAPLPLALFDLAAPAAAAPYKLQPKVQHPPATFFRCYMDAVRVSLLIIGPYKLISYLAANYMDIRTGLPLPVGGEISAQLTLYFLVEELSEXWLHRLLHTKWGYEKIHHVYHEFTAPMAYAAWYGHWAEMLILXVPSLAGPALVPCHVTTLWIWFAARLVESLNIHSGFKLPFNAEKYIPFYGGAEHHDYHHYIGGQSKSNFAPVFTYCDYIYGTDKGYRYHKATLAKLKELAGSDVQKGVDNGFNGGKQD

SEQ ID NO: 5672 - protein, 105 aa, Triticum aestivum
MRPQSKSTRPLQLSPGLGFRRSIDQSTRAGAKMIEVVLNDRLGKKVRVKCNEDDTIGDLKKLVAAQTGTRAEKIRIQKWYTIYKDHITLGDYEIHDGMGLELYYN

SEQ ID NO: 5673 - protein, 656 aa, Triticum aestivum
LLAGLLVLAFWLRSGGSAPPKPPPASFRPPPVKVDADDADDGRKRVTIFFGTQTGTAEGFAKAMAEEAKARYEKVLFKVVDLDDYAAEDDEYEEKLKKETFALFFLATYGDGEPTDNAARFYKWFTEGKEKEVWLKDFNYAVFGLGNRQYEHFNKVAKEVDELLLEQGGNRLVPCGLGDDDQCIEDDFTAWKELVWPELDQLLRDEDDTTGATTPYTAAIPEYRVVFIDKSDLEFEDKSWTLANGNGVIDAQHPCRANVAVRKELHKPASDRSCIHLEFDISGTGLVYETGDHVGVYSENSIETVEQAETLLDLSPDTVFSIHADAEDGSPRKGGGSLAPPFPSPCTLRTALLRYADLLNAPKKAALTALAAHASDPTEAERLRFLASPAGKDEYAQWIVASQRSLLEVMAAFPSAKPPLGVFFAAIAPRLQPRFYSISSSPKLAPSRIHVTCALVYGPTPTERIHQGVCSTWMKNTLPLEYSEECSWAPIFVRQSNFRLPADPSTPIIMIGPGTGLAPFRGFLQERLALKESGAELGSSVLFFGCRNREMDYIYEEELQNFLQEGALSELIVAYSREGPTKEYVQHKMVDKATEIWNVISQGGYIYVCGDAKGMAKDVHRVLHTIVQKQGSLDNSKTELYVKNLQMEGRYLRDVW

SEQ ID NO: 5674 - protein, 488 aa, Triticum aestivum
  misc_feature (357)..(357): Xaa can be any naturally occurring amino acid
  misc_feature (411)..(411): Xaa can be any naturally occurring amino acid
  misc_feature (416)..(416): Xaa can be any naturally occurring amino acid
  misc_feature (426)..(426): Xaa can be any naturally occurring amino acid
MRIPRRKAGVPLGVPSRRAQIAAVFALAVLLGVSVLYDSAHIAASLRRHSGYNRLSPTREAPAGAGPRATPAQAVESAGAATDRTDPPPRLGAEGVSKSNPGTAADGSSPETGVLKEVVAEGGEATCDMYKGRWVHDEENAPMYKESDCEFLTEQVTCMRNGRRSDEYQKWRWQPDACDLPRFDAKLLLEKLRNKRMMFVGDSLNRNQWESMVCLVQSVAPWDKKKLVKNGSLNVFRLNEYNATIEFYWAPFLVESNSDDPDIHSITDRMITPTSIAKHAANWIGVDYLIFNTYIWWMNTPKMKIVPDGSFTRKPVKYDELDRVVAYRQILETWSGWVEENVDPKRTMVLFMSVSPXHMQSEGWGSPDNIKCFSETQPVLNYTKTLDVGTDWDLFTESHEVTKAMKKVPVXFMNIXQCSETRKDAXHTSVHTLRQGKLLTKEQQANPRKFAACIHWCLPGLPDTWNEFIYGHIVSSPPQRQIENQSAR

SEQ ID NO: 5675 - protein, 121 aa, Triticum aestivum
AQQDGADVSGLISMIIQAVLTARHNRFECEQLAHRVLMIAQLLPNVKEPEAAQPLAGLDSTLRRAHELVVSCQERSAAYQFFMASRTAERFREVESKIDSYLILFPVISYIGITRRLERIY

SEQ ID NO: 5676 - protein, 505 aa, Triticum aestivum
  misc_feature (204)..(204): Xaa can be any naturally occurring amino acid
  misc_feature (219)..(219): Xaa can be any naturally occurring amino acid
  misc_feature (379)..(379): Xaa can be any naturally occurring amino acid
MSTCAASLAPLLGTAAANATDYLCNQFADTTTAIDSTYLLFSAYLVFAMQLGFAMLCAGSVRAKNTMNIMLTNVLDAAAGALFYYLFGFAFAFGTPSNGFIGKHFFGLRDVPQVGFDYSFFLFQWAFAIAAAGITSGSIAERTQFVAYLIYSAFLTGFVYPVVSHWIWSADGWASASRTSGPLLFNSGVIDFAGSGVVHMVGGXGRALGRAHRGPPHWXRFDHAGRAVALRGHSASLVVLGTFLLWFGWYGFNPGSFLTILKSYGPPGSIHGQWSAVGRAAVTTTLAGSTAALTTLFGKRLQTGHWNVLDVCNGLLGGFAAVTAGCSVVDPWAAIICGFVSAWVLIGLNKLAARFKFDDPLEAAQLHGGCGAWGVIFTXALFARREYVEQIYGAPGRPYGLFMGGGGRLLGAHVVLILVIAAWVSCTMGPLFLALNKLGLLRISAEDQMAGMDQTRHGGFAYAYTDEDSSSRPGRGAGGSVGGFMLKSAQTSQVAADATSPSSSV

SEQ ID NO: 5677 - protein, 49 aa, Triticum aestivum
RVRNVKCVRYDIDGECHVLLVACRDIARGEKLYYDYNGHLVACPTRHVV

SEQ ID NO: 5678 - protein, 156 aa, Triticum aestivum
GPLEAGPAWFYLHIACQISGYALGVAGWGLGLKLGSESKGLTYTTHRSIGIAIFCLATLQVFALFLRPDKKNKYRVYWNAYHHSVGYSVIVLAAVNIFKGLNILKPATGWKTSYVVILATLAGVVLLLEAITWAVVLRRRKRNRAHAGANGTGVQL

SEQ ID NO: 5679 - protein, 388 aa, Triticum aestivum
  misc_feature (177)..(177): Xaa can be any naturally occurring amino acid
  misc_feature (206)..(206): Xaa can be any naturally occurring amino acid
  misc_feature (214)..(214): Xaa can be any naturally occurring amino acid
  misc_feature (219)..(219): Xaa can be any naturally occurring amino acid
MARPGHSTAWLPLLVLLFAAGAAAQSGCLSATFTGGRTFLKCNQLPVLGASLHWTYHAGNGTADIAFRAPSGADGWVGWGINPSGSGMAGSNVFVASQSGGAVSVLTTILRTTAPTLDNTALSFDVPVPASAEYAGGAYTIYATVALPGNTTSQNTVWQAGPISGGRISPHPVSGHXPNVHTIQSLSFLSGTEHRNSPMSRLNRRXNLHGVLNXACWGXLIPLRAMIARYLRVFEAADPAWFYLHIACQISGYALGVAGWGLGLKLGSESKGLTYSTHRNIGIAIFCLATLQVFALFLRPDKKNKYRVYWNAYHHSVGYSVIVLAAVNIFKGLNILKPVTGWKTSYIVILATLAGVALVLEAITWAIVLRRRKRNQAHGGANGTGVQL

SEQ ID NO: 5680 - protein, 221 aa, Triticum aestivum
MDRPTTGGRRQEARPSEREREMEASSSRSRSGSLPSKRRSGGGGGGGGGSGYGLTGQSLNDDTLRSIFSRVDDHFDLAHCSAVCKSWHTIISTAHVMRDLYYKRNPQARGSSSTISVKSYFEALAMNEHASTLARGSAEVHQWIGHDMRATLCRMKSGSVLTGMGDKVLRLWSAESCKYMNEYNVPNSKMLVDFDFDENKIVGLTSSQVCIWKRSGAQKKS

SEQ ID NO: 5681 - protein, 372 aa, Triticum aestivum
LVDIANTSIHSPNRPEGRSLCRTAPRRTGASMTVGGEATGHGQTVCVTGAGGYIGSWIVKLLLEKGYAVRGTVRNPDDAKNAHLRGLAGAAERLVLCKADLLDGDALRAAIAGCHGVFHTASPVTDDPEEMVEPAVRGTRYVIDAAAESSTVRRVVLTSSIGAVAMDPSRAPDAVVDESCWSDLEFCKKTKNWYCYGKTVAEREAWEAAAARGVDLVVVNPVLVQGPALQPAVNASLTHVLKYLDGSAKTYANAVQAYVHVRDTAAAHVLVFESPAAAGRYLCVADGAVLHREDVVTILRKFFPEYPIPSRCSDEVNPRKQPYKMSNQRLRELGLEFTPVAQCLYDTVVSFQEKGVLPAPPAPAQPATKEIN

SEQ ID NO: 5682 - protein, 360 aa, Triticum aestivum
  misc_feature (98)..(98): Xaa can be any naturally occurring amino acid
HGSPSPSAFPQASRAPTLLLVLVGVVAAARIIVRASLPRPPTAPPQERATQRFDSGRREWRRRRPSPPPTSPASPPPPRPRSTTTRTTSSASAAPAAXAQRLVAMAGSGKFFVGGNWKCNGTKESISKLVSDLNAATLESDVDVVVAPPFIYIDQVKSSLTDRIEVSAQNTWIGKGGAFTGEISAEQLVDIGCQWVILGHSERRHVIGEDDQFIGKKAAYALSQNLKVMACIGELLEEREAGKTFDVCFKQMKAFADNITDWKNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 5683 - protein, 366 aa, Triticum aestivum
  misc_feature (103)..(103): Xaa can be any naturally occurring amino acid
  misc_feature (305)..(305): Xaa can be any naturally occurring amino acid
TVAARVALARPLSRRPPVRLPSSWFWLVWWLLRASSSEPPSLAHQPHHHRSARRRERFDSGRREWRRRRPSPPPTSPASPPPPRPRSTTTRTTSSASAAPAAXAQRLVAMAGSGKFFVGGNWKCNGTKESITKLVSDLNAATLESDVDVVVAPPFIYIDQVKSSLTGRIEVSAQNTWIGKGGAFTGEISAEQLVDIVVESVILGHSERRNVIGEGDQVIGKKTAYALRGDLKVVACIGELLEEREAGKTFDVCFKRMNVFADDKTVWKKDAIAYEPECAIGTGKVASLEETQEVHAAVRDWLKTXNVSADVASTVRIIYGGSVNAANCAELAKKEDIDGFLVGGASLKGSDFATICNSVTSKKVTA

SEQ ID NO: 5684 - protein, 305 aa, Triticum aestivum
MDGGGGVGGGMGPVGGGVGGMVGPVGVGGGGGGSDVELVSKTLQFEHKLFYFDLKENPRGRYLKISEKTSTTRSTIIVPIAGVAWFLDLFDYYIRTDERDVFSKELRLDTKVFYFDIGENKRGRYLKVSEASVNRNRSTIIVPAGSSGEEGWEAFRNVLLEINDEASRLYVLPNHPSQQHLEPPERLPGLSDDVGAGFIAGHGSQSASVPEVDVDGPPIEEFSGMGLSKVIRADQKRFFFDLGSNNRGHYLRISEVAGADRSSIILPLSGLKQFHEMVGHFVDIMKDRLEGMTGANVRTVEPSQR

SEQ ID NO: 5685 - protein, 509 aa, Triticum aestivum
MAAAGHLMLLSCVLLHALLAGPAEGLVRVPLTKRPVDEVDGPVVAGEDAQRLLAWRHGLVYNADAAPTTGEKGHAVALKNHLNAQYYGEVGVGTPPQNFTVIFDTGSADFWVPSSKCFLSIGCYLHASYKASKSATYKKNGKRVALRYGTGAISGYLSQDNVQVGGVVVKNQDFIEATREPSITFMFRKFDGILGLGFKEIARGGVEPVWYNMVNQHLVGSPVFSFWFNRHAGEGHGGEIVFGGIDPKHHKEEHKYVPVTKKGYWQFDMGDVLIGGKSTGLCTSRCAAIADSGTSLLVGPTAIITQINEKIGAPGIFSQECKEVASQYGQRILDLLLNEIDPTKICPSVGLCTHSGTQGVSNGSFGIRTVVDDETGRSNDAVCHVCEMAVMWAKNQLAQDQTRDLILKYINTLCGYIPSPMGESSVDCKRLASMPDVAFSIGGKKFALTPEQYILKIGEGDATKCISGFVAMDIPPPRGPIWILGDIFMGAYHTVFDYGKMKVGFAKAA

SEQ ID NO: 5686 - protein, 519 aa, Triticum aestivum
MAVAGAPPVLQLLPQQWQLILAILLVPLGFLLLRGRSGSGLKLPPGPMRLPFVGNLHQIGPLPHRSLAALARRHGPVMMLRLGMVPTVVLTSPEAAREALKTKDDDCSSRPLSAGPGLLSYGYKDVAFSPWSDYVREMRKLFIIELLSRRRVQSAYYARDAQIDKLIETLTVVGPNPVPLEAHIFATMDRIVGLFAFGESYAGEQFKGQFVPLLNATMDMLGSFSAQDFFPNAVGRLIDRITGVKAHRQRVFRQLDRFFEHIIEQCDGRKATGGGGSDLVQELLDIMKRPAASAAGTFTRDHVKAILMNTFIGSIDTTTVTITWAMAELIRKPRVLQRAQLEIRTAAGGGSRVHQADMPKMSYLRMVLSETLRLHPPATLLVPRETLRPIQVAGYDIPAKTQVIVNAWAISRDPSAWKDPEEFNPERFQDTDVDFNGSHFEFIPFGAGRRICPGLAMGVANAEYILANLLYCFNWALPNGVSREGVNMEEEGVLTYRKKTSLMLVPTPYHPAQEKEEEY

SEQ ID NO: 5687 - protein, 316 aa, Triticum aestivum
MELRTLGGTGLRVSPVGFGASPLGNVFGDVPRDVARATVRRALDLGINFFDTSPYYGGTVSESVLGDCLRFSGVPRDSFVVATKCGRYKEGFDFSATRVTRSIDESLARLGLDYVDILHCHDIEFTSLDQIVNETIPALQKIKESGKARFIGITGLPLSIFTYVLDRVPPGSVDLVLSYCHYGINDTALVDLLPYLKSKGVGVISASPLAMGLLTDNGPPEWHPAPEELKLACRTAADHCRKKGKHITKLAMKYSLMNNEISTVLVGMNSPEQVEENVAAAVELSTSGIDEELLHEVEAILEPVKNLTWPSGIQQA

SEQ ID NO: 5688 - protein, 191 aa, Triticum aestivum
MALAAAAVAAARPSPTGLPRPLCRASAHPCRPRRFRLEASLSASTPAPAPATADEGAAAGPCPVVRFDMADFTVADRVSVGLHGRSDEMIFEATVRDPSSELYGSTVVLRQLTSSQAKRRGRRALEVLKKLARRQMMYHSYAMQVHGYVTPSKAMEEGDSPLVLVHGYHGSYSLRHWLQLSDWLPTLEATL

SEQ ID NO: 5689 - protein, 544 aa, Triticum aestivum
MAHFQGQHHGHPATRVDEYGNPVTAGHGVTGTEGLGHFQGHGQQHGHPTTRLDEYGNPVTAGHGVGLGSTGTGVHGAGHGGYGSTGTGAHDTGGHGRQVGYGATGTGTHDAGGYRGSGIAPRHGATDAGFHDAGGLDTRHAATGTHGTGHTAGLGGTGTGMTGTHGTGHTAGLGGTGTGMTGTHGTGHTGTGMTGTHGTGHTAGLGGTGTGITGTHGAGHTGIGMTGTHGTGHTAGLGGTGTGITGTHGTGHTAGYDATGTGITGTHGTGHTPGYGATGTGITGTHGAAGTHPHGGLPEHKTRGILHRSGSSSSSSSSSEDDGMGGRRKKGMKQKIKEKLPGGNKEQTTATGGYGPGYTGTTGTGGPGYTGTTGTGGTYGTTEGTHEKKGVMEKIKEKLPGGHKDTQPHTAATGGYGHGTTGTGGGYGTGTHPHGGLPEHKTRGILHRSGSSSSSSSSSEDDGMGGRRKKGMKQKIKEKLPGGNKEQTTATGGYGPGYTGTTGTGGPGYTGTTGTGGTYGATEGTHEKKGMMEKIKEKLPGGHH

SEQ ID NO: 5690 - protein, 212 aa, Triticum aestivum
  misc_feature (189)..(189): Xaa can be any naturally occurring amino acid
MSVTKFIKCVTVGDGAVGKTCMLICYTSNRFPSDYIPTVFDNFSANVSVDGNIVNLGLWDTAGQEDYSRLRPLSYRGADVFVLAFSLISSASYENVLKKWMPELRRFAPNVPIVLVGTKLDLRDHRAYLADHPGASAITTAQGEELRKQIGAAAYIECSSKTQQNVKAVFDTAIKVVLQPPRRREVSPXRKKTRRSSGCSIMHLMCGSTCAA

SEQ ID NO: 5691 - protein, 514 aa, Triticum aestivum
  misc_feature (437)..(437): Xaa can be any naturally occurring amino acid
MLASCYLLERLDVSGNRFVGPFPAALLSLPSMEYLSIAGNRFTGRLSGNASCGENLRFVDLSSNLLTGSLPGCLAASSDSGKTVVLFSANCLSSGSGDESQSQHPSPFCRNQALAVGIVPEQGRKKSGAKAGVVAGIVLVGALVVSAAVVFVVRKASAPKARPARRLVEHASGPHPPRVRARARYISQTVKLGALGIPAYRSFSLVELEAATDNFQVSSLMGQDAHGQMYRGRLSNGTPVTIRSLKVNKSQSFTRHIEMISKLRHRHLVSALGHCFQYNLDDSTVTHLYLVFEYVHNGNLRGRISQGTEGRKLSWGQRISTAIGVAKGIQFLHGGIIPGLFANNLKITNILMDQNQVPKIGSYNIPILSETMKSEGGAGSKYPPDRICRVPNGDKIDMYDFGVILLEVISGRPISSIYEVEIMKEQLQSALTAQGTXKRSNFVDPAVSKGCSDDSMRTVMEICLRCLAKEPTQRPSVEDVLWNLQFAAQVQDDSRSSDESPLSPSQPHAQSAHG

SEQ ID NO: 5692 - protein, 388 aa, Triticum aestivum
  misc_feature (167)..(167): Xaa can be any naturally occurring amino acid
  misc_feature (192)..(192): Xaa can be any naturally occurring amino acid
MTSLNQFDLLGDVDNDDPSQLLAAAAAAAAKKAQANKTEAAPAGKAAQTAAAAKLPTKSAPPAQAGRDARSGGPPSRGGFGRGEPGRGRPLVRAVRAMTTLNQVRSPRRRRQRRPLAAACCGGGRRGKEGPGEQDGGSACWKGGPDCGVGQVDDQIRSPGTGWEGCXSGGPPSRGGFGRGEPGRGRSGRSDXLAQETDEALKIEDNAPIAEKQGEQDDAPPTTVEKKDHKDGAAKEEEENEEDKEMTLEEFEKIREEQRKALLALKTEERKVEVDKDLQSLQPLSTKKANDEVFIKLGSDKEKKKESTERDERAKKSLSINEFLKPAEGERYYGGRPTLGALAPPRGRGEGRGDRGGFRGGFGGGYQRGQAAAPSIEDQSQFPTLGGK

SEQ ID NO: 5693 - protein, 232 aa, Triticum aestivum
  misc_feature (143)..(143): Xaa can be any naturally occurring amino acid
  misc_feature (158)..(158): Xaa can be any naturally occurring amino acid
RSLRIELPAGELGMDDGVLLKWKADFGSTLAPGGILGAASASASPSSAAKDGATAAPPPPTADCAESDDSGSIPESFYTNGGLKLRVLWTISSLIAASARHYLLQPIISDHALLESLDLTDADGQGALTMDKWQLQELRVRPXSASGDSHRTLMPALXMRLWYAPHIELPGGTVLCGATLLAVGPSEEAMMDAVGNATAGSAGGILGFKMLLRTISDGRVLLLKAEDVIPLR

SEQ ID NO: 5694 - protein, 227 aa, Triticum aestivum
MSMRDLVAGRAGCAAAGSSSSANPLTALADAVLGSSKSEQQIKELSGSAVRGKASFDSMPIPLSTLPGSEDEIKLGQGPIRSMKGTDFINGCHGDACGDNFQASIPSVPEHIVVEPHLGEPEQVDSATRLHFKPKFEGPPEMAAQAFLPQSSFEPYSIPGNGPEEYSGGKDGLLDHIDGLYDDEMRTSGNISTEIDRCLAAFEQGIHPRSMNDDQLAGDGWLPFLRI

SEQ ID NO: 5695 - protein, 526 aa, Triticum aestivum
  misc_feature (95)..(95): Xaa can be any naturally occurring amino acid
  misc_feature (118)..(118): Xaa can be any naturally occurring amino acid
  misc_feature (155)..(155): Xaa can be any naturally occurring amino acid
  misc_feature (176)..(176): Xaa can be any naturally occurring amino acid
  misc_feature (193)..(193): Xaa can be any naturally occurring amino acid
  misc_feature (219)..(219): Xaa can be any naturally occurring amino acid
  misc_feature (425)..(425): Xaa can be any naturally occurring amino acid
LSPPSLITPSPARPLRSLHSPNLPGQGGAAATCAACPAALRGAAGATATNSPCYRCTGSTAAVASTDPTFSAFPAFRVSARLLPFSTPCAASARXTMNIMIINVLKRARRRRPSALLXLFRFPFAFRSNGFVGKDFFGLRDMAQPGFDYGFFFFXLWAVVRAPDGMTYGVLLSVKXHLICDLIIGRCFPGTVXPMLCRSCVRWQDCKIGTQVRGASLLXSVIDYTRSGVVHIVGMVTCWWGVFTLGTRIDRFDHACRSVALKGHSASLVVLGTFLLWFGWYGFNPGSFVTILKSYGPPGSINGQWSGVGRTAVTTTLAGSVAALTTLFGKRLQTGHWNVVDVCNGLLGGFAAITAGCSVVDPWAAVICGFVSAWVLIGLNALAGRLKYDDPLEAAQLHGGCGAWGIIFTALFAKKQYVEEIYGAXGRPYGLFLGGGGRLLAAHIVQILVIAGFVSCTMGPLFLALKKLGLLRISAEDEMAGMDLTRHGGFAYVYHDDDEHDKSVGGFMLRSAQTRVEPAAAANSQV

SEQ ID NO: 5696 - protein, 298 aa, Triticum aestivum
YQLYRHDNSWHSSLAPMVGTMVADACFAARPSDIIVATLPKSGTTWIKALLYSTVHRGEHPADSSDHPFNTHGPHECIKFLEYQLYTQNRIPDLDELPDPRLFATHVPFVSLPRSVVASGCKIVYVCRDPKDTLISHWNFANKFRLRDGLEPLSVETAADYFCHGVSPFGPYWDHVLGYWRAHSANPELVLFFRYEEMNRDPAAHVRRLAEFVGCPFSVEEEEDGAVDAIVKLCSFEHMTGLEATKGGKTELTFGVVENSSFFRRGQVGDWENHLSPETARKIDAITEAKFRGSGLSV

SEQ ID NO: 5697 - protein, 167 aa, Triticum aestivum
  misc_feature (102)..(102): Xaa can be any naturally occurring amino acid
MALWTGLGQAATVAQLVGADVGGLISMIVQSALTARQNRSECEQLARRALMIAQLLPHVQEPEAAQPLAGLGDTLRDAHELVLSCQGRGAAYQFVMASRTAXKVREVQAKIDSYLILFPVISYIGITRRIERIYNVLVPDDSTRVEPSTLLQLQESTEDGQGVPLHG

SEQ ID NO: 5698 - protein, 467 aa, Triticum aestivum
  misc_feature (65)..(65): Xaa can be any naturally occurring amino acid
  misc_feature (86)..(86): Xaa can be any naturally occurring amino acid
  misc_feature (293)..(293): Xaa can be any naturally occurring amino acid
MGTGRLVFHLLLLSNVLLHALLATPAEGLVRIALKKRPVDENGVVLVGCRLTGDDAEAKGHVVGXKNYHNAQYHGEIGIGTPPQKXFTVIFDTGSSNLWVPSSKCFLSIACYFHASYKAKRSSTYKKNGKIVAIQYGTGAISGYVSQDNVQVGDVVVKNQDFIEATREPSITFMFRKFDGILGLGFKEIARGGVEPVWYNMVNQHLVGSPVFSFWFNRHAGEGQGGEIVFGGIDPKHHKEEHKYVPVTKKGYWQFDMGDVLIGGKSTGLCTSRCTAIADSGTSLLVGPTATTXRINEKIGAPGIFSQECKEVASQYGQRILDLLLNEIDPTKICPSVGLCTHGGTPGVSFGIRTVVDDETGRSNDAMCHVCEMAVMWAKNQLAQDQTRDLILKYINTLCGYIPSPMGESSVDCKRLASMPDVAFSIGSKKFALTPEQYILKIGEGDATKCISGFVAMDIPPPRGPIW

SEQ ID NO: 5699 - protein, 99 aa, Triticum aestivum
MAGKLYQLMARLHLAKGRASADVPKGHFAVYVGEQRKRFVIPTAYLRHPSFLVLLKRVEDEFGFDHRAGGGLTIPCSEGDFADIVGGCSSSSSPAVDYH

SEQ ID NO: 5700 - protein, 721 aa, Triticum aestivum
  misc_feature (412)..(412): Xaa can be any naturally occurring amino acid
  misc_feature (418)..(418): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFAEWNKGELLSFLVEITADIFSIKDDQGEGYLVDKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEXGDMQLXAEAYRRSSKSVGKLTNGELQPVFAEWNKGELLSFLVEITADIFSIKDDQGEGYLVDKVLDKTGMKGTGKWTVQQAAELSVAAPTIEASLDSRFLSGLKDERVAASKIFQGDYSSGETVDKAQLIEDVRKALYASKICSYAQGMNIIKAKSTEKGWGLNLGELARIWKGGWSLPHPHRTTTLLLPPRTHARRTSSRPRQAGSYQKGPCRAGRPGLAPSGQHPGHKLPDHWLPHPDLQGRCARPERNVTGHPSPRKPPSLRFPRTLHPYATLRQRTCRPPARQSSSTLGRGPGHVRRGECIVGRN

SEQ ID NO: 5701 - protein, 75 aa, Triticum aestivum
  misc_feature (20)..(20): Xaa can be any naturally occurring amino acid
PQEVVGPVPPKGSVLGFFPXPMQAVKQGFQDLGAPPWRPAHDLFRAGTFRLKVGPGPPQVEGGTPGLVSAEKKSF

SEQ ID NO: 5702 - protein, 146 aa, Triticum aestivum
EDGLASFYGGLGPSLIGIAPYMAVNFCVFDLMKKSVPEKYKSRPETSLATALLSATFATLMCYPLDTVRRQMQMKGTPYNTIFDAIPGIVERDGLVGLYRGFVPNALKNLPNSSIKLTAFDTMKILISTGQKELEKIMQENQEKTS

SEQ ID NO: 5703 - protein, 151 aa, Triticum aestivum
  misc_feature (115)..(115): Xaa can be any naturally occurring amino acid
MLPYSTAAEAEAALGRAMSYAEGAWFRYSAGMPDYYLYCHIVPMLLLVYTLSSVPLALFELGAPSIALRYKLQPRVKLSPSAFLRCYMDTMGLLLVTIAPLHLVSYPAMAGIRTXLPLPSVGETVAQLVVYLLVDDYLGYWIHRLLHAKWG

SEQ ID NO: 5704 - protein, 232 aa, Triticum aestivum
  misc_feature (4)..(4): Xaa can be any naturally occurring amino acid
FSKXQLIFGGKSYYGALLCCTWSSDGKYLLTGGEDDLVQVWSMDDRKTVAWGEGHNSWVSGVAFDPYWSPPNADGTGENAVYRFGSVGQDTQLLLWDLAMDEIVVPLRHPSGGSPTFSSGSPSAHWDSACPPTGILQPSPRMRDVPKLSPLVAHRVHADLLSGVVFSTESIVTICREGLIKIWARPGHSENNQQSNSSELALSNTVSKDRAITSFSKASGSSFKQPSLLGLT

SEQ ID NO: 5705 - protein, 614 aa, Triticum aestivum
MASISGAAAPPSSSSACRLRLRRQLLMRPSHLRLRAPHSIADLSRSSGSPHAPAPPLASRAPGQGGGAAVEKDPIKLWDRYVEWLYQHKQLGLFVDVSRMGFTDDFLLQMEPLMQRAFVAMGELEKGAIANPDEGRMVGHYWLRDPGLAPNSFLRTKIEKTVDHILAFSQDVVSGKIKPPSSQAGRFTQILSIGIGGSSLGPQFVSEALAPDNPPLKIRFIDNTDPAGIDHQIAQLGEELKSTLVIVISKSGGTPETRNGLLEVQKAFRDAGLDFSKQGVAITQENSLLDNTARIEGWLDRFPMFDWVGGRTSELSAVGLLPAALQGIDVKEMLVGAALMDEETRNTVVKENPAALLALSWYWATDGIGSKDMVVLPYKDSLLLLSRYLQQLVMESLGKEYDLDGNRVNQGLTVYGNKGSTDQHAYIQQLREGVHNFFVTFIEVLRDRPPGHDWELEPGVTCGDYLFGMLQGTRSALYSNDRESISVTVEEVTPRAVGALVALYERAVGIYASLVNINAYHQPGVEAGKKAAGEVLALQKRVLTVLNEASCKDPAEPLTLEQIADRCHCPEDIEMIYKIIQHMAANDRALIAEGSCGSPRSVKVYLGECNVDDL

SEQ ID NO: 5706 - protein, 182 aa, Triticum aestivum
  misc_feature (133)..(133): Xaa can be any naturally occurring amino acid
GIHKCNMAGKPVIITRVVDSMIDNLRPTRAEATDVANAVLDGTDGILLGAETLRGQYPVDAVRTVGRICAEAETVYNQSLHFKKVVRHVGEPMVHEESVASSAVRSAMKVKAAAIVVFTFSGRAARLIAKYRXPMPVLAVVFPREGSDPSKWRSYGTTQARQCFSGRGVYPLMGSTDDGCTS

SEQ ID NO: 5707 - protein, 330 aa, Triticum aestivum
YNKFVQKSRLVPVRNSRDIVDPRVRAKLPPAELRNMAAVSRSMRERCRSDHLWERHMSDKWGSVLGTAARDEWRSYLSSSTAAGGGASGCGSAGSGKHRRWLAALSCVCPGRPAGRPRADGGAGTSAGPVLDDSIMSWYLHLESGKFWFPAQVYNREHGHVGFMMSCYDAELSYDFRTDTFHARYPPHGRRTVVLEDGVQWDRIRAPRVETLAHDLHASDCLHELRPGDNIEIQWRRNKEFPYGWWYGVVGHLESCDGNEHFCRCHLSDTVVLEFNQYTPGSRWRQSLVNRKDHREEGNESDGFYGGIRKLQDKDEISKWKQLWPTDILE

SEQ ID NO: 5708 - protein, 172 aa, Triticum aestivum
  misc_feature (92)..(92): Xaa can be any naturally occurring amino acid
MAAAAESDNGSEVGPTGDSGAFASPVKARERAPESEAGASAATASESSETRVDDGNIQEAESSLREGLSLNYEEARALLGRLEYQRGNVEGXALRVFDGIDLQAAIQRFQPPLSEKPSSKRNNKLRSDSSNSGSQHAASLVLEAIYLKAMSLQKLGKAIEAAQQCTSVLDAV

SEQ ID NO: 5709 - protein, 65 aa, Triticum aestivum
LHAYDQHLNMILGDVEEIVTSIEIDDETYEEIVRVSNFSFLKNCALHADVSLFKFGLSITRFFSN

SEQ ID NO: 5710 - protein, 496 aa, Triticum aestivum
MARKMLKDGEAPVVADDGGSYDYDLFVIGAGSGGVRGSRTAAGFGAKVAICELPFHPISSEWLGGHGGTCVIRGCVPKKILVYGASFRGEFDDAKQFGWEINGDINYNWKKLLENKTQEIVRLNGVYKRILGGSGVTMIEGAGSIVDAHTVEVTQPDGSKQRHTTKHILIATGSRATLVNIPGKELAITSDEALSLEELPKRALILGGGYIAVEFASIWKGLGAEVDLFYRKELPLRGFDDEMRTVVASNLEGRGIRLHPGTNLTELSKTADGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAETKNDLLIYTSSFNPMKNSISKRVEKSTMKLVVDAETDKVLGAAMCGPDAAEIMQGIAVALKAGATKATFDSTVGIHPSAAEEFVTMRTLTRRVSPPSKPKTNL

SEQ ID NO: 5711 - protein, 194 aa, Triticum aestivum
  misc_feature (174)..(174): Xaa can be any naturally occurring amino acid
SLLLLDQDGLFVPNLTIGAPVIESLRKHTKAYLDCHLMVTNPSDYVEAFGKAGASGFTFHIEVARDNWKELTQSIKAKGMRPGVSLKPGTPVEDVFPLVEAETPVELVLVMTVEPGFGGQKFMPEMMDKVRTLRKKYPSLDIEVDGGLGPSTIDAAASAGANCIVAGSSVFGAXDPGEVISALRKSVEASQIKS

SEQ ID NO: 5712 - protein, 335 aa, Triticum aestivum
  misc_feature (8)..(8): Xaa can be any naturally occurring amino acid
  misc_feature (240)..(240): Xaa can be any naturally occurring amino acid
GGRGGATXWGEAPPDPFNCIHVADTPTLDALKKGAPERWRLIKAHGTAVGLPTDDDMGNSEVGHNALGAGQIYAQGAKLVDLALASGKIYEGEGFKYIQQSFETGTLHLIGLLSDGGVHSRIDQLQLLLKGASEHGAKRIRVHILTDGRDVLDGSSVTFVETLENDLAKLREKGVDARIASGGGRMYVTMDRYENDWQVVKRGWDAQVLGETPHKFPSALEAVKKLRDDPKANDQYLPPXFVVLDESGKPVGPIVDGDAVVTFNFRADRMVMLAKALEYEDFDKFDRVRFPRIRYAGMLQYDGELKLPSHYLVAPPEIERTSGEYLARNGVRTYA

SEQ ID NO: 5713 - protein, 218 aa, Triticum aestivum
MAPRVPSSLLLVGAALLLGLAAGAARASNEEGDALYALRMRLSDPNGVLQSWDPTLVNPCTWFHVTCDTASRVVRLDLGNSNVSGSIGPELSRLVNLQYLELYRNNLNGEIPKELGKLKNLISLDLYANKLTGRIPKSLSKLSSLRFMRLNNNKLAGSIPRELAKLSNLKVIDLSNNDLCGTIPVDGPFSSFPLRSFENNSRLNGPELQGLVSYDFGC

SEQ ID NO: 5714 - protein, 170 aa, Triticum aestivum
KYAVLTSLISMKRVDIKKRVLDAPEVLEVISDIPHLEDYMNSLYNCQYTQFFRSLAAIEQAHLRSSRYLLPHMRYYIREMRILAYAQLLESYRSLTVTSMAQAFGVSEDYIDRDLYKFIAAGRLNCVIDKVNGIIETNRPDAKNAQYQSVIKHGDVLLNRIQKLSRVIDV

SEQ ID NO: 5715 - protein, 98 aa, Triticum aestivum
MASADEEIAVKEPLDLIRLSLDERIYVKLRSDRELRGKLHAYDQHLNMILGDVEEIVTTVEIDDETYEEIVRTTRRAIPFLFVRGDGVILVSPPLRTA

SEQ ID NO: 5716 - protein, 346 aa, Triticum aestivum
MAVERDIFGISGPTYLNPVNWNCENNRRSVAACLVQAVYVLERDRQLNRQSVDAAAPPWWEFFHFEMIRKLVDDVDLSIFGAIFEFNPPSSKEASARDAPRFVIAFRGTITEKETISRDLSLDLQLVQNGLHKTSRFAIAMQAVQNVASAFPGSPIWLAGHSLGAGTAILTGRNMVKKGALLDSFLFNPPFVAAPIEGIRDERVKHGFRIARSVITAGLTIAMKAKTEGNNQRSVAEESFNILSSWTPYLFVNPGDHVCSEYIGYFQHRRNMEDLGAGFIEKLATQNSIGDLFYKALGWESEPLHLLPSADLIVNVSPSLDFKYAHGISQWWQPDLNLQCNKYRYS

SEQ ID NO: 5717 - protein, 517 aa, Triticum aestivum
  misc_feature (410)..(410): Xaa can be any naturally occurring amino acid
MLSRLAARRPRPGSARAAAYRSSAAASSSVLPDALDRGSDAYARNAAAVGGLLSDLRSRVSQVLGGGGAGAVKRNEGRGKLLPRDRIDRLLDPGASFLELSQLAGSDVYEEALPSGGIITGIGPVHGRLCMFVANDPTTKGGTYYPITVKKHLRAQEIASECKLPCIYLVDSGGANLPKQAEVFPDRDNFGRIFYNQAKMSADGIPQIAVVLGSCTAGGAYIPAMADESIIVKGNGTIFLAGPPLVKAATGEEISAEDLGGASVHCKVSGVSDHFAQDERHGLALGRNIVKNLHLAAKETSIHNSACDYQEPLYDVQELRSIAPADTKQSFDIRSIIARIVDGSEFDEFKKLYGTTLVTGFARICGQPVGIIGNNGILFTESALKGTHFIELCAQRNIPLIFLQNISGFXRVGSKSEASGIAKAGAKMVMAVSCSKVPKITIIVGGSFGAGNYGMCGRAYSPNFLFMWPTARISVMGGIQVRPLDLSLASNCLTLLLVSLPGKDATNVTLGINSLEA

SEQ ID NO: 5718 - protein, 336 aa, Triticum aestivum
MAPPRRVCVTGGGGFIASWLVKLLLSRGYAVHATLRDPCDPKNVHLKQMDEARENLHLLKADVLDYDALTRAFEGCEGVFHLATPVPEDKIADPESEVLAPAVKGTSNVLKACSAMKVQKVIVLSSNAAVDFNPNWPQDRLKDESSWSDKDFCQENEDWYSVAKIVAEQASLEYSEKHGLNVVTLCPPLVFGPLLQPTVNTSSKFLIYVINGGPDVMSNKLWHIVDVRDVADALLLVYEKAESSGRYICAPNSVCTKDLVDLLRKMYPQYSYVNNIDADRKAPLSSQKLKDLGWKPRKLEETLSDSVGCYEKAGLLQGSAARHCRLPHLFRLAGDQ

SEQ ID NO: 5719 - protein, 223 aa, Triticum aestivum
  misc_feature (139)..(139): Xaa can be any naturally occurring amino acid
AGHLGDRMDLRIVLTIGMISTAIFTALFGAGYWLNIHNFYYFLVFQMIAGLFHSSGWPSVVAVVGNWFGKSKRGLIMGIWNAHTSIGNISGSLLAASLLKFGWGWSFAIPSIIMALAGLVVFFFLPVSPDVMEIDIDDXEVNSDKDTAKEPLLEPGQEVKHKAIGFLEAWRIPGVAPFALCLFFSKLVAYTFLYWLPFYISHTPIGNEYLSDAMAGSLSTAFD

SEQ ID NO: 5720 - protein, 575 aa, Triticum aestivum
  misc_feature (230)..(230): Xaa can be any naturally occurring amino acid
  misc_feature (255)..(255): Xaa can be any naturally occurring amino acid
MSKEDVLKIQTCVLKVNIHCDGCQKKVKKILSKIDGVYQSTIDPEEGKVMVSGLAHPDTMRNKLNKGGNPAVLWGSKRARVGNQCQKLHLDGNGGGRKGAAPKDRGKGHPKDAGGKAHKGGGKDAKMAMPQPTPQQIQQMQQQMQMKGAPTPQQLQQLQQQMQMKGAPTPQQLQQLQQQMQMKGAPTPQQMQQLQQQMQMKGAPTPQQLQQLQQQMQMKGLKLPPQFMGXPRPRCRSRRVRRPRTPSPVKFNLPXDGWGDDGGSEFDDEFDEFDDDEDFDDEGFEDDYYDDPKMMMKQMAMPPNAGGGDKKGAGNGGKKGGGGNEIPVQIKGNGNNGGGKKDAGGKQQHQGGNGNGNGNGGGKNGGGGGQPNNVKGGGAPVQGKKGGGAGGPAPGMGGPMGGGMPPQQQAMFRPNMMGGAGFPGMGGPMGHPHAASGAQAGRAMQGMPPAGLYQGAGGGMPPGAAIGAASLQAAAAAGNPMAQQQYMQLIQQQQQQQQMAMLQQQQQQQQQMMMMNGGHGGGAGGYPQMGYGPGYGRPPMGSYPMPTAYAMPPQPPAGEPYNYFSDEDPNSCSVM

SEQ ID NO: 5721 - protein, 69 aa, Triticum aestivum
  misc_feature (12)..(12): Xaa can be any naturally occurring amino acid
MAAPAIHPFAQXITGPPGSPDHSMIAFCPNTTEVHIYKFFTDKWEKLHVLAKHDQIVSGIDWSRSSNKM

SEQ ID NO: 5722 - protein, 351 aa, Triticum aestivum
  misc_feature (97)..(97): Xaa can be any naturally occurring amino acid
MTVVAAAAAAAAQELPGHGQTVCVTGAAGYIASWLVKLLLERGYTVKGTVRNPDDPKNAHLKALDGAAERLVLCKADLLDYDAICAAVEGCHGVFHXTASPVTDDPEQMVEPAVRGTEYVINAAADAGTVRRVVFTSSIGAVTMDPNRGPDVVVDESCWSDLEFCKKTKNWYCYGKAVAEQAAWEKAAARGVDLVVVNPVLVVGPLLQPTVNASAAHILKYLDGSAKKYANAVQAYVDVRDVAAAHVRVFEAPGASGRHLCAERVLHREDVVHILGKLFPEYPVPTRCSDEVNPRKQPYKMSNQKLQDLGLQFTPVNDSLYETVKSLQEKGHLPAPRKDIILPAELDGATA

SEQ ID NO: 5723 - protein, 791 aa, Triticum aestivum
MTMMAMAKAPCLCARPSLAARARRPGPGPAPRLRRWRPNATAGKGVGEVCAAVVEAATKAEDEDDDEEEAVAEDRYALGGACRVLAGMPAPLGATALAGGVNFAVYSGGATAAALCLFTPEDLKADRVTEEVSLDPLMNRTGNVWHVFIEGELHDMLYGYRFDGTFAPHCGHYLDISNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVMEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFTLGDLVTYNNKYNLPNGENNRDGENHNLSWNCGEEGEFARLSVKRLRKRQMRNFFVCLMVSQGVPMFYMGDEYGHTKGGNNNTYCHDSYVNYFRWDKKEQYSDLHRFCCLMTKFRKECDGLGLEDFPTAERLQWHGHQPGKPDWSENSRFVAFSMKDERQGEIYVAFNTSHLPAVVELPERAGRRWEPVVDTGKPAPYDFLTDDLPDRALTIHQFSHFLNSNLYPMLSYSSVILVLRPDV

SEQ ID NO: 5724 - protein, 264 aa, Triticum aestivum
  misc_feature (230)..(230): Xaa can be any naturally occurring amino acid
MHPTRWELSHMVDLQAAALVISVVAAEVTTNSPIRLLACGLICFKVPRERSANPASNPMAASAGSKIRNAKLVLLGDVGAGKSSLVLRFVKGQFVEFQESTIGAAFFSQTLAVNDETVKFEIWDTAGQERYHSLAPMYYRGAAAAIVVYDISNQASFTRAKKWVQELQAQGNQNTVVALAGNKADLLEAREVQIEEAKTYAQENGLFFMETSAKTATNVNDIFYEIAKRXLLQGQAAQNPQAAGMVLSQRPNERVVSAASCCSS

SEQ ID NO: 5725 - protein, 346 aa, Triticum aestivum
  misc_feature (19)..(19): Xaa can be any naturally occurring amino acid
MEETPLPLIPRVRLGTQGXLEVSKLGFGCMGLTGSYSAPLSDDAGASVVAHAFRRGVTFFDTSDFYGPHTNETLLGKALKQLPREHVHVATKFGIHEYAYDEGRGAVCGRPEYVRACCEASLRRLGVDYIDLYYQHRIDTTTPIEDTIGELKKLVEEGKVRYIGLSEASPDTIRRAHAVHPVSAGQMEWSLWARDIEPEIVPLCRELGIGIVPYSPIGRGFFGGRGVTEQVSAESNLKRHPRFSAENLEKNKHLYLKMEELAKKHQCSPAQLALAWVLHQGDDVVPIPGTTRIKNLDSNIDSLKIKLTEDDLEEISSQIREEDVAGGRSYTSLAHTNWNHADTPKK

SEQ ID NO: 5726 - protein, 180 aa, Triticum aestivum
MLEVECRGLDHADALGLIAIGNRLRCISNWLVVAMQKLRHPHPEHGGGKQLVRVYGPRVKFERGPSLAFNVYDWKGEKVAPALVQKLADRQAISLTCGFLRNIWFADKYEADRSAVLEQASDGDGGGEVGIHVVNASLGFLSNFEDAYKLWAFVAKFLDADFVEKERWRYTALNQKTVEV

SEQ ID NO: 5727 - protein, 442 aa, Triticum aestivum
MSNYHDDHVEDMEDDYDMDDPAEDMVDAHHERGLRDSDSEDDEYAHSNDKIPDTSAADARKGKDIQGIPWERLAITRENYRQTRLEQYKNYENIPNSGEAAAKECKPTVKGGMYYEFRQNTRSVKSTILHFQLRNLVWATSKHDVYLMSHYSVLHWSALSGVDTELMNVQGHVAPREKHPGSLLEGFSQTQVSTLAVKDNLLVAGGFQGELICKHLDREGISFCCRTTYDDNAITNAVEIFNTASGAVHFMASNNDSGVRDYDMERFQLCKHFQFDWPVNHTSLSPDGKLVVIVGDDPNGLLIDANSGKTLHSMKGHHDFSFASAWSPDGRTFATGNQDKTCRIWDARNLSKAVHVLKGNLGAIRSIRFTSDGQFLSMAEPADFVHIFDVKSDYNRRQELDFFGEISGMSFSPDTDALFVGVWDRTYGSLLQFGRLYNKLVP

SEQ ID NO: 5728 - protein, 120 aa, Triticum aestivum
LTTPTTKAERMNEITSASEGFVYLVSIPRLTGARPSVRPHVKSWCREIKQVTDKAVAVGFGISTPDHVRQVAQWGADGVIIGSAMVKQLGEANSPREGLKRLEVYARSLKDALHAVICTI

SEQ ID NO: 5729 - protein, 384 aa, Triticum aestivum
MSTAGKTITCKAAVAWEAGKPLSIEDIEVAPPKANEVRIQIYYTGVCHTDAYTLSGKDPEGAFPIVLGHEGAGIVESIGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCVGLSVVQGAAARKAGKIIVVDVNPSKKEWGEKFGATDFVNPTELGDQSIQDKLIEMTDGGCDYTFDCTGNVGVMRAALEACHKGWGESIVIGVAAAGQEISTRPFQLVTGRVWRGCAFGGVKGRSQLNDLVADYKKGDLKVDEFITHRKTLGEINNAFDTMKQGDCIRAVVDMQKLEPKI

SEQ ID NO: 5730 - protein, 154 aa, Triticum aestivum
MDGSKAKKVAAKKFGGPRKKSVTKSIKAGLQFPVGRIGRYLKKGRYAQRVGSGAPVYLAAVLEYLAAEVLELAGNAAKDNKKTRIVPRHLLLAIRNDQELGRLLSGVTIAHGGVIPNINPVLLPKKAAEKAEKAGAAPKSPKKTTKSPKKATKA

SEQ ID NO: 5731 - protein, 476 aa, Triticum aestivum
  misc_feature (240)..(240): Xaa can be any naturally occurring amino acid
ENGREEVGVMGVSSGGADGDEEQHGGGKFSVTSFLWHGGSVWDAWFSCASNQVAQVLLTLPYSFSQLGMLSGILLQLFYGFLGSWTAYLISVLYVEYRSRKEKEGVSFKNHVIQWFEVLDGLLGPYWKAAGLAFNCTFLLFGTVIQLIACASNIYYINDRLDKRTWTYIFGACCATTVFIPSFHNYRIWSFLGLGMTTYTAWYLAIAALINGQVEGVTHTGPNKLVLYFTGATNILYTFXGHAVTVEIMHAMWKPAKFKYIYLLATLYVFTLTLPSASAMYWAYGDELLAHANAFSLLPKTAWRDAAVILMLIHQFITFGFACTPLYFVWEKVIGMHDTKSVCLRALARLPIVVPIWFLAIIFPFFGPINSAVGALLVSFTVYIIPALAHMLTYRSASARANAAEKPPFFLPSWTGMFVLNAFIVVWVFVVGFGLGGWASMVNFIRQINTFGLFAKCYQCPKPGAAVAPGPSSLHH

SEQ ID NO: 5732 - protein, 380 aa, Triticum aestivum
MGLDYYKILGVDKAASDDDLKKAYRKLAMKWHPDKNPTSKKEAESKFKQISEAYEVLSDSQKRAVYDQYGEEGLKGQVPPPGAGGGAGGPGGATFFSTGADGPTAFRFNPRNAEDIFAEFFGSSSPFGGMGGAWGRRHGRHWGGGGHGMPSGGIRFSPSMFGGMGGGGDHTFTQTFGGGGGGGQGYPGMFGSGGGGGAPVKAAPIERKLPCSLEELYKGTTKKMKISREIADASGKTIPVEEILTIDVKPGWKKGTKITFPEKGNEQPHTIAADLVFFFDEKPPPVYPRDGNDLVATQKIPLAEALTGYTVHLTTLDGRSLTVPISSVIHPGYEEVVRGEGMPIPKDPSRKGNLRVKFDIKFPARLTADQKSGVKRLLGQ

SEQ ID NO: 5733 - protein, 132 aa, Triticum aestivum
  misc_feature (29)..(29): Xaa can be any naturally occurring amino acid
  misc_feature (65)..(65): Xaa can be any naturally occurring amino acid
  misc_feature (72)..(72): Xaa can be any naturally occurring amino acid
SGGDQRGWGYAMTPGALFLCMAGWIGRVXQNYLIRRQAPSKKPAIREIMIDGELAARIIRRGFMXPVTTYRXLINGDLCGYNPTHWILRSVPYHARLDQQRQLTQPADDRGLVAVICVRLEYELKGSLRNGS

SEQ ID NO: 5734 - protein, 58 aa, Triticum aestivum
CLSVNRDLSIPGRELSGVHPAMEFLHANSKSLLDSNLEDGRCISAQGKKAVVIGGGDT

SEQ ID NO: 5735 - protein, 188 aa, Triticum aestivum
  misc_feature (40)..(40): Xaa can be any naturally occurring amino acid
RIITHKESEQAQSWSKIYSEDTKEQSIPVITAWQLNERMXRVCLLLLLFSLPVRFGKEQVHEWRRSYDTPPPNGESLEMCADRAVSYFKDQVVPHLTAGKHVMVAAHANSLRSIIMHLDKLTSQEVISLELSTGIPMLYIFKEGEFIRRGSPVGPSEASVYAYTRVRVYSIFYPSTEQFVSTVYIKTN

SEQ ID NO: 5736 - protein, 191 aa, Triticum aestivum
MDEKTQDKVEAAVLEILRGSDMESLTEYKVRTAAAERLGIDLDLPLHKRFVRRLVEDYLKSLAEEEDEKQKGGSRKEGKKKQQRQEEEEQEEDEEKEGEEEEEEEEDKGGEGKKEFDDNGDLILCRLSKNRRVTLQEFKGKTLVSIREYYFKDGKEMPTSKGMSMTVEQWETFSKSVPAIEDAIKTLGESD

SEQ ID NO: 5737 - protein, 371 aa, Triticum aestivum
  misc_feature (227)..(227): Xaa can be any naturally occurring amino acid
  misc_feature (240)..(240): Xaa can be any naturally occurring amino acid
  misc_feature (247)..(247): Xaa can be any naturally occurring amino acid
  misc_feature (268)..(268): Xaa can be any naturally occurring amino acid
MAKAVAKEVGAQEAAQGSAALGWAARDASGVLSPFDFSRRAQKDDDVTIKVLYCGICHTDLYTIKNEWGTAMYPVVPGHEILGVVTSVGSGVSKFKAGDTVGVGYFVGSCRSCESCGNGYENYCSSMVLTSNGIDPEHGGAVTQGGFSDVMLVNEDYVVRVPDGLPLDKAAPLLCAGVTVYSPMMRFGLNAPGKHLGVVGLGGLGHVAVQFGKAFGMRVTVISNSPXKRQEALDRLGADXFLVNRDXNKFRGGWGTMDGILQQGFGVXHPIPPWSPLIKPMGQMVFVGGPTKPLELPAFAIVPGGKGIAGNCVGGMRDCQAMLEFAAKHGITAEVEVIKMDYVNTALERLAKNDVRYRFVIDIAGSLGSTS

SEQ ID NO: 5738 - protein, 479 aa, Triticum aestivum
  misc_feature (103)..(103): Xaa can be any naturally occurring amino acid
MASSLLRRAAAGCGRCPSPAEAPRRPVSSEAAPEQALPRRLPDLPPFDHGASTFPGMGGAEILEKRKKFLGPSLFYYYQKPLNIEEGKMQYLYDEQGKRYLDXFGGIVTVSCGHCHPDIVKAVQEQTKLLQHTTTIYLHHAIVEFAEALASKMPGNLKVVYFVNSGTEANELAMLMARLYSGNLGMVALRNGYHGGSAGTIGLTGLQTWKYPIPQGEIHHVMNPDPYRGAFGSDAAAYAREVEEHINFGSSGRVGGFIAETFQGVGGTVELAPGYLKSVYDTVRKAGGVCIADEVQSGFGRTGSNYWGFQTQDVIPDIVTMAKGIGNGLPLGAVVTTPEIASVMAQKIQFNTFGGNPVCSAGGLAVLKVLDKEKRQAHCADVGAHLVERLKSLQQKHEIIGDVRGRGLMLGVELVTDRTEKTPAKAETAVLFEKLKDLGVLVGKGGLHGNVFRIKPPMCFSKDDADFLVDAMDYAMSGF

SEQ ID NO: 5739 - protein, 479 aa, Triticum aestivum
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFAEWNKGELLSFLVEITADIFSIKDDQGEGYLVDKVLDKTGMKGTGKWTVQQAAELSVAAPTIEASLDSRFLSGLKDERVAASKIFQGDYSSGETVDKAQLIEDVRKALYASKICSYAQGMNIIKAKSVEKGWGLNLGELARIWKGGCIIRASFLDRIKKAYDRNGELANLLIDPEFAQEIMDRQAAWRRVVCLAINNGVSTPGMSASLAYFDSYRRERLPANLVQAQRDYFGAHTYERVDMPGSFHTEWYKIANSKI

SEQ ID NO: 5740 - protein, 507 aa, Triticum aestivum
  misc_feature (134)..(134): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGXKEGARHGPSMMPGGSLEAYQYIEDILLKVSAQVPDSGPCVTYIGKGGSGNFVKMVHNGIEYGDMQLIAEAYDVLKSVGKLTNGELQQVFAEWNKGELLSFLVEITADIFSIKDDQGEGYLVDKVLDKTGMKGTGKWTVQQAAELSVAAPTIEASLDSRFLSGLKDERVAASKIFQGDYSSGETVDKAQLIEDVRKALYASKICSYAQGMNIIKAKSTEKGWGLNLGELARIWKGGCIIRASFLDRIKKAYDRNGELANLLIDPEFAQEIMDRQAAWRRVVCLAINNGVSTPGMSASLAYFDSYRRDRLPANLVQAQRDYFGAHTYERVDMPGSFHTEWVQDRQLEDLSCCSTKDGPSSFVLGPFVAAIMSPFL

SEQ ID NO: 5741 - protein, 325 aa, Triticum aestivum
  misc_feature (242)..(242): Xaa can be any naturally occurring amino acid
  misc_feature (259)..(259): Xaa can be any naturally occurring amino acid
  misc_feature (272)..(272): Xaa can be any naturally occurring amino acid
  misc_feature (284)..(284): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFTEWNKGELLSFLVEITADIXSIKDDQGEGYLVDKVLXQTGMKGTGKWTVXQAAELSVAAPTXEASWDSGSSTGCKINVSRFPKLPRWILQGLNCSKGQLFRGC

SEQ ID NO: 5742 - protein, 163 aa, Triticum aestivum
  misc_feature (154)..(154): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQXIEDILLKVS

SEQ ID NO: 5743 - protein, 234 aa, Triticum aestivum
  misc_feature (172)..(172): Xaa can be any naturally occurring amino acid
  misc_feature (178)..(178): Xaa can be any naturally occurring amino acid
  misc_feature (223)..(223): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPXVTYIGXGGSRNFGKMVQNGIEYGDMQLIGEGDEVLKAVGRLTNGGLEQVFXEWNKGKLLNFL

SEQ ID NO: 5744 - protein, 444 aa, Triticum aestivum
MATVSFSSPASFAGDNSGALTSATSAAAAAEVGAIPNAKLAQPSAAALAERALLGSDASLAVHAGERLGRRIATDAITTPVVNTSAYWFSSSQELIDFKEGRHASFEYGRYGNPTTEALEKKMSALEKAESTVFVASGMYASVAMLSTLVPAGGHIVTTTDLYRKTRIYMETELPKRGITMTVIRPADMDALQDALDNNNVSLFFTETPTNPFLRCIDIELVSNMCHNKGALLCIDSTFASPINQKALTLGADIVVHSATKYIAGHNDVIGGCISGRDELVSKVRIYHHVVGGVLNPNASYLILRGMKTLHLRVQCQNSTALRMAQFLEEHPKIARVYYPGLPSHPEHHIAKSQMTGFGGVVSFEVDGDFDSTRKFIDSVKIPYHAPSFGGCESIIDQPAIMSYWDSKEQRDIYGIKDNLIRFSIGVEDFEDLKNDIVQALNKI

SEQ ID NO: 5745 - protein, 507 aa, Triticum aestivum
  misc_feature (235)..(235): Xaa can be any naturally occurring amino acid
  misc_feature (252)..(252): Xaa can be any naturally occurring amino acid
  misc_feature (270)..(270): Xaa can be any naturally occurring amino acid
  misc_feature (275)..(275): Xaa can be any naturally occurring amino acid
  misc_feature (293)..(294): Xaa can be any naturally occurring amino acid
  misc_feature (298)..(298): Xaa can be any naturally occurring amino acid
  misc_feature (300)..(301): Xaa can be any naturally occurring amino acid
  misc_feature (306)..(306): Xaa can be any naturally occurring amino acid
  misc_feature (312)..(312): Xaa can be any naturally occurring amino acid
  misc_feature (316)..(316): Xaa can be any naturally occurring amino acid
  misc_feature (335)..(335): Xaa can be any naturally occurring amino acid
  misc_feature (337)..(337): Xaa can be any naturally occurring amino acid
  misc_feature (389)..(389): Xaa can be any naturally occurring amino acid
  misc_feature (400)..(400): Xaa can be any naturally occurring amino acid
MEVQAGSHADAAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLXKKGDMAKDKFSKVLWGXVTNYRTWIFVLLYGYCMXVELTXDNVIAEYYYDHFHLDLRXXGTIXAXXGMANXVARPMXGYLXDLGARYFGMRARLWNIWIXQXAGGAFCIWLGRASALPASVTAMVLFSICAQAACGAVFGVAPFVSRRSLGIIXGLTGAGGNVGXGLTQLLFFTSSQYSTGRGLEYMGIMIMACTLPVALVHFPQWGSMFFPASADATEEEYYASEWSEEEKNKGLHIAGQKFAENSRSERGRRNVILATSATPPNNTPQHV

SEQ ID NO: 5746 - protein, 506 aa, Triticum aestivum
MAAPPAIPRRGLFIGGGWREPTLGRRIPVINPATEDTIGDIPAATAEDVELAVAAARSAFLLDGGSRWARASGATRAKYLNAIATKIKEKISYLALLETVDSGKPKDEAVADMDDVAACFEFYAGLAEALDGKQHAPISLPMEEFKTYVLKEPIGVVGLITPWNYPLLMATWKVAPALAAGCTAVLKPSELASLTCLELGAICEEVGLPSGVLNIITGLGPDAGAPIASHPHVDKIAFTGSTATGKTIMTAAAQMVKPVSLELGGKSPLVIFDDVADIDKAVEWAMFGCFFNSGQVCSATSRLLLHEKIAERFLDRLVEWAKNIKISDPLEEGCRLGSVISKGQYEKIKKFISTARSEGATILHGGDRPKHLGKGFFIEPTIITDVSTSMQIWREEVFGPVICVKVFKTESEAVELANDTHYGLAGGVISDDLERCERIAKVIHSGIVWINCSQPTLVQAPWGGNKRSGFGRELGEWGLENYLSVKQVTRYCKDELYGWYQRPSKL

SEQ ID NO: 5747 - protein, 348 aa, Triticum aestivum
  misc_feature (117)..(117): Xaa can be any naturally occurring amino acid
  misc_feature (130)..(130): Xaa can be any naturally occurring amino acid
  misc_feature (198)..(198): Xaa can be any naturally occurring amino acid
RTRGRTRGSTFQKFKSFLNKGNDPSCLREFLLPILSQNSPSGNIGLQMLDRHWGAGWNLLALLLATKSDKRPRGRDARRHPFLGGPKGRISPTGNVVRGGWGSTAVRLAEDYIYRAXQRRRLAYFIELMXEVLNPNSSTENWLRLLPGRWCLLYCTGRHIGLTLRQPTPRVLISDAFLTFAEAPESVDPILSLTSDIXFKIMPESDWPHDKSGTEGNLSVTTSARITPGRIYTNAEDGKESSSRITSSRYLGGKWGKAAKMKQLPASLPTASVNVDENDVDVSMSCGSTLKVKSARKVLQEVRTQTPPEMFDLSKIVCGTYIDSRLMVLRGVNGSALLFVRSNRTSDP

SEQ ID NO: 5748 - protein, 143 aa, Triticum aestivum
VRCHGFVRVARYSEVSNRTEPFKLQKGSGRRRTVERDLDQLQQSRLGEADGFEVIHVTGKHPFLWPDHWPVKDYARIFDCLAVAPEIETEDVRVIFKIKDAGKKARHDAAVSHNTKRIDGLKNLPVQYIAVHMRIEKDWMIHC

SEQ ID NO: 5749 - protein, 216 aa, Triticum aestivum
MAYRADDDYDYLFKVVLIGDSGVGKSNLLTRFTRNEFSLESKSTIGVEFATRSIRVDDKVVKAQIWDTAGQERYRAITSAYYRGAVGALVVYDVTRHVTFENVERWLKELKDHTDANIVIMLVGNKADLRHLRAVSVEDAKAFAEREYTFFMETSALESMNVEDAFTEVLTQIYRVVSKKALDIGDDPAAPPRGQTINVGSKDDVSAVKKAGCCSS

SEQ ID NO: 5750 - protein, 131 aa, Triticum aestivum
NPKDMTGATGTLGYMAPEVLDGKPYNRKCDVYSFGICLWEIYCCDMPYPDLSFADVSSAVVHQNLRPDIPRCCPSAFANIMRKCWDGNPDKRPDMDEVVQLMEALDTSKGGGMIPDGQSSGCLCFTRARGP

SEQ ID NO: 5751 - protein, 134 aa, Triticum aestivum
TPATDHAVGHIGDANDDDNKDYDKDDDKDDGDDKDDKDDDDKDDKDDDDKDDDDDDDKDDDDDDDKDDDDDDDDDDDDSGGSDWGKYFKCKKKCIMDCYRSLRHHRRRRRRHRPSPGPKPPSPKPPKPKKFPPN

SEQ ID NO: 5752 - protein, 423 aa, Triticum aestivum
MARKKIREYDSKRLLKEHLKRLAGIDLQILSAQVTQSTDFTELSNQEPWLSSMKLVVKPDMLFGKRGKSGLVALNLDRAQVRQFVKERLGVEVEMGGCKAPITTFIVEPFVPHDQEYYLSIMSDRLGCTISFSECGGIEIEENWDKVKTIFLPTEKPMTLDACAPLIATLPLEVRTKIGDFIRGSFSVFQDLDFSFMEMNPFTLVNGEPYPLDMRGELDDTAAFKNFKKWGDIEFPLPFGRVLSPSESYIHELDEKTSASLKFTVLNPKGRIWTMVAGGGASVIYADTVGDLGYASELGNYAEYSGAPKEEEVLHYARVVLDCATADPDGRKRALLIGGGIANFTDVAATFSGIIRALREKESKLKAARVNIYVRRGGPNYQTGLAKMRALGSELGLPIEVYGPEATMTGICKQAIDCVMAEA

SEQ ID NO: 5753 - protein, 177 aa, Triticum aestivum
  misc_feature (121)..(121): Xaa can be any naturally occurring amino acid
MDSGSDSDGAPEELTAVQGVEKHEEISKVEKDSAVRATQEEKDRRKRWAQRKTSSKPNKKKPLKVEDKDTEVDEETHAMPGTLPKSVIEMLAAREKQTFSSDSEEENVNQNVQKKKKRLKXATTGPETILVKDVRSTEHIKKALEFLSRRKNQVPRSNAVLKNPNAMRLFNKHNFTS

SEQ ID NO: 5754 - protein, 560 aa, Triticum aestivum
  misc_feature (149)..(149): Xaa can be any naturally occurring amino acid
  misc_feature (205)..(205): Xaa can be any naturally occurring amino acid
  misc_feature (239)..(239): Xaa can be any naturally occurring amino acid
MAAAALANGDVRAGGGGAVPRPTNPMVTPLLTDLYQFSMAYAYWKAGKHLDRAVFDLYFRKSPFAGEFTVFGGLEECIRFIANFKFKEEEINFLRTALPTCEDGFFEYLSSIDCSDVEVYAIPEGSAVFPKVPLMIIEGPVAVVQLLEXSFLSFVRTVSLVTTNAAWHRLVAGKPKNLLEFGLRRAQGPDGGISASRYSLHGGGXATSGVAAGRLFGIQYWDSPHAFVSSFLGLDETLXQTLSSSDGSNKCENFVSLVQNWLVKIQGASSLRASFGETNQSELAAFTSYALAFPNSFLALVDTYDLARSGVPNFCALALPLNDMGYKAVGIRLDSGDLAYLSIETRKFFCAIEKEFGVVGFGKTNITASNDLNEETIDALNKQGHEVDSFGIGTYLVTCYAQAALGCVFKLVEINKQPRIKLSEDVTKVSIPCKKRCYRLYGKEGYPLVDIMTGQDEPSPKVGERILCRHPFIESKRAHVVPQHVEELLKCYWPGHSSVQREELPSLNENRSRCMRQLERMRPDHLRKLNPTPYKVSVSAQLYDFIHFLWLNEAPVGELQ

SEQ ID NO: 5755 - protein, 163 aa, Triticum aestivum
MASLMDKAKGFVADKIAHMPKPEASLDKVTFKGMTREAITVHSHVNVTNPYSHRIPICDIAFNLKCGGKEVASGTIPDPGWIEDSGEVTKLEVPAKVPYDFLISLMKDLGRDWDIDYELLVKLTIDLPIIGNFTIPLQTAGEFKLPTLSDFFGGSAKTEEATA

SEQ ID NO: 5756 - protein, 239 aa, Triticum aestivum
QHILMYEYMSNGNLATLLYGDNTPSLSWQERLQIAHDVSHGIEYLHEGAVPPVIHRDLKSANILLDESMRAKVADFGLSKEEVFDGSKSGLKGTYGYMDPDYMSTNKFTKKSDVYSFGIILFELITAINPQQGLMEYIDLAAIGGEGKVDWDEILDKNLLGGSIPEEARVLADVAYRCINRSPRKRPWISEVTQAISRLRQRQMTLPRSETRTVLRRIEYQHVELSDLAGMKELTPVGA

SEQ ID NO: 5757 - protein, 194 aa, Triticum aestivum
LKDKRVLIRVDFNVPMKDGAITNNNRIVQALPTVKYALDNGASAVILMSHLGRPNGEAVAKYSLKPVAAEVEKLLGKPVEFLNDCVGTDVEKTCQSAKDGKVILLENLRFHIEEEGSAKVDGQKVKADAEAVKKFRASLTTLADIYINDAFGTAHRAHSSMVGVNLSQRAARFLMQKELEYFAKALENPSRPFL

SEQ ID NO: 5758 - protein, 422 aa, Triticum aestivum
  misc_feature (171)..(171): Xaa can be any naturally occurring amino acid
  misc_feature (314)..(314): Xaa can be any naturally occurring amino acid
MAADMAGCCCFSCFGFLRKLHHRPAAGDSDGAPSKDLLLPLPRSSDDGSFYAGDDPDNSSSFLGDESRSFYEREEEDYLLRQSDGDGDDEPPRKRSEDIILSRARNGFACRDSLVRDTRKLFRSEDETTGCKMINQYVHLGKIGAGSYGKVVKYRNIKDGRLYAIKVLSKXHMMKVRVVRSETAMTDVLREVSLMKMLGHPNIVNLIEVIDDPNTDKFYMVLEYVEGKMVCDNGIGLGEATCRKYLRDIISGVMYLHSHNIIHSDIKPDNLLVTSTGNVKIGDFSVSQIFEDDDDMLRRSPGTSVFTAPECCQXSYHGRALIHGSSCTLYCMITGRYPFLGETLQETYDKIVNDPADIPSNVSPQLVDLLERLLCKDPGDRITLEAAAAHPWVAGDEGPVPEYMCRCGFGRRKRNGSQEAVQ

SEQ ID NO: 5759 - protein, 212 aa, Triticum aestivum
  misc_feature (120)..(120): Xaa can be any naturally occurring amino acid
IASGRPRSRTAEDVIGPEVEKLVADLANGAVLLLENVRFYKEEEKNDPEFAKKLASLADLFVNDAFGTAHRAHASTEGVTKFLKPSVAGFLLQKVLDYLDGAVSTPRRPFAAIAGGSKVXSSKTGVIESLLAKVDILLLGGGLTFTFYKAQGLTAGQTIEEEDKLDLVTTLCDPEEAMAGQLMIPTVVVADVKDALDDTRTIVAATGIPARW

SEQ ID NO: 5760 - protein, 480 aa, Triticum aestivum
MASTAAPPAALVARRAASASVAAPLRGAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGKELPGVVALDEGVMTRSVTV

SEQ ID NO: 5761 - protein, 378 aa, Triticum aestivum
  misc_feature (95)..(95): Xaa can be any naturally occurring amino acid
LYISPPNAKRFQLPDGRHLAYEEKGISADRARFSLVAPHSFLSSRLAGIPGISSSLLEEFGARLVTYDLPGFGESDPHPGRNLNSSALDMLHLAXPLGIVDKFWVVGYSGGGMHAWSALRYIPDRVAGAAMFAPMANPYDSKMTKDEKRKIWDRWSTKRKLMHILARRFPSLLRLFYHRSFLSGKQGQPESWLSLSMGKKDKTLLEAPTFNTFWEKDVAESVRQGDAQPFVEEAVLQVSDWGFSLSDIQMQKKEDQGVFEFMKSLFSQAEREWGGFLGPIHIWQGMDDRVVPPSVTEFARRMVPGATVHKLLDEGHFSYFCFCDECHRQIFSTLFGTPQGPLNPALESSEVAPEPVEETSPAYDEEVAGQEQETSGVA

SEQ ID NO: 5762 - protein, 101 aa, Triticum aestivum
MTLVLSFTNGNEWDGAYTLMFKVPKPWFVTPLSLLNDGLADKLNMEGSCYQAILPDENIMMTSCDISWSYEAGGYPRTLDILSECIDPTSDMFHPIVIMED

SEQ ID NO: 5763 - protein, 377 aa, Triticum aestivum
  misc_feature (76)..(76): Xaa can be any naturally occurring amino acid
MATMNPFDLLGDDEGDDPTQLLAKAAALAQKAEAKKAAAPPAAGKGGAKTVANLPTKPPPPGQAGNDSRGGGPPSXRGGYGRGERGSGRGGRGGYGQNRDYGSEDTNGYRGGYGARTGGEEGAQDRERAPRQPYQGGGRRGGYREGEFGDDSERPPRRNYERHSGTGRGYEIKREGAGRGNWGTTSDEFVARETEALKQDEKAPAPEKQGAPEDAPQADENKPTKDGATVVEEEKEEDNEMTLDEFEKVMEEKRKALAALKKSEERKVEIDKDLQAMQLLSTKKGNDEVFIKLGADKEALKKKENAEREERAKKSVSINEFLKPAEGERFYGGRGRGGRGRGDRGGFRGGFGGGGYHGPPPAPAIQDQNQFPTLGGK

SEQ ID NO: 5764 - protein, 509 aa, Triticum aestivum
  misc_feature (36)..(36): Xaa can be any naturally occurring amino acid
HASPVHPSRRQPTERAVRLPNAHEGLPLAVPGGKPXRRCGWLLPLLVGVAFVGEIAFLGRLDMSKNAAAVESWTTSFYRLSSTWGADAPPGSGDDDDECEERLEREDAVPYDRDFERDPVLVGGAAKDWNRCSVGCEFGFPASKTPDATFGIAPDPSVESILRSMESSQYYSENNINAARGRGYQIVMTTSLSSDVPVGYFSWAEYDIMAPVPPKTEEALAAAFISNCGARNFRLQALEMLESLDVKIDSYGSCHRNRDGKVDKVETLKRYKFSLAFENSGEEDYVTEKFFQSLVTGAIPVVVGAPNIQEFSPGEGAILHIKELDDVISVAKTMKHIASNPDAFNQSLRWKYDGPSDSFKALIDMAAVHSSCRLCIHIATKIHEKEERTPKFMNRSCSCSSKRGTVYHLFVRERGRFKTESIYLRSDQLTLGALESAVHGKFRSLKHVPVWKDERPSSIRGGDELKVYKIYPIGLTERQALYKFQFSDDAEVARYIKGHPCAKLEVIFV

SEQ ID NO: 5765 - protein, 145 aa, Triticum aestivum
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSQKAAAKSPKKKTAATKE

SEQ ID NO: 5766 - protein, 88 aa, Triticum aestivum
MTEGRIQCVRAQQAPMHMVLGVKHRSALYSASEEAPDGDGSLKSALSVFNGNEEHIARKILGVRDTDFVQVDRVQEQSKRLALMRQEL

SEQ ID NO: 5767 - protein, 479 aa, Triticum aestivum
MGKKRKLEPKSTLAANSPAAKAPAAAKIAEPAAPPPQPETLAEYYPTSSQTVAQESGSIAGGAAVKQEVGGEEDEWEEVEEEVEEEEEEEVEEEEQQQAEEGDSDPASIQALLEVFPKEQLVELLRDAAVRHGDVLESVRRAADADPAQRKIFVHGLGWDTTVDILTEAFRPYGEIEDLKLVSDRNTGKCKGYGFILFSRLSGARAGLLEPHKKIGNRTTSCQLASLGPVPPGGAANNPMLATDPAPAPAALILPPVSEYTQRKIFVSNVGADIDPQKLLQFFSKYGEIEEGPLGLDKATGKPKGFALFVYRTLESAKKALQEPHKSFEGVMLHCQKAIDGPKPNKGGGYGATTTSGRKGAAGYGAGSHSLPGTVGAGYGMASPASLASMPGPVPGGPGMNPALGQALTAFLATQGGGLGLNNILGVGPNSSGVPNSGSSGALGGGGVPGMPGSYMGGYGGGGGYGGPPGGPGRNYMGH

SEQ ID NO: 5768 - protein, 262 aa, Triticum aestivum
GMAMVKPVFIPKAQRDTIAERERLEEEERQVEETIRKRLEARKIETRQIVVEEIRKDEHIQKALNEDASIEDVDTDDEQNEAEEYESWKNREMARIKRDREERYARLKEKEEIDKVRNMTEEERREWEKKNPKPSLQKSKQKWNFMQKYYHKGAFFQEGGDDVSQSAGRDAIYTRDFSAPTGEDKMDKSILPKVMQVKHFGRSGRTKWTHLVNEDTTDWDAPWATNGPLRTKYNAKMAGMNAPIAKPKGSKKMKDWDTKRDD

SEQ ID NO: 5769 - protein, 222 aa, Triticum aestivum
FVSPIPTFWRIVRSRSTEDFEAAPYVLTLLNTLLWLYYGFTKPDGLLIATVNGFGAVMETIYIVLFLVYGVDNAKRVKTAKLVAVLDIGFFGVVFAATTFAIGGLDMKIMVIGLICACLSVFMYGSPLTAVRTVIASRSVEYMPFFLSFFLFLNGGVWATYAILDKDVFLGVPNGIGCFLGGIQLVIYAIYRNSKVRSQSHDSDEAAYDASASLLSSDAGRH

SEQ ID NO: 5770 - protein, 139 aa, Triticum aestivum
LDLLVPASGGLYGTPSLDLRIEAFVTSESEPRTGNDTHKRPCQQVWFKPWPSDAPVWGGLGTNGWLWLGAVVSSSFAAFLLLVAVLQRFYIYPVDRDSYHVYPWAARTMLNLLFLGVSVAGVTGAAFLWSKRRSARVWT

SEQ ID NO: 5771 - protein, 221 aa, Triticum aestivum
  misc_feature (95)..(95): Xaa can be any naturally occurring amino acid
  misc_feature (122)..(122): Xaa can be any naturally occurring amino acid
MSDNSIQRALLPENPDANVLQRKPSQGAKRFRRCRSAPRSETDEKPQENGSSLPAKELFSVVRPSFRLVGFLLFLYLLVGVVVFYLVMDQLSGKXRTNRVLDALVLLHCHDDIGGLWRPCSXQRRVLDALYFCIVTMTSVGYGDLVPNTDTTKLLACVFVFTGMAIIALFVSKSADYLVEKQEVLFFKALHMNMKCGEAKMLRQIETNKTKYKFYTAALLL

SEQ ID NO: 5772 - protein, 244 aa, Triticum aestivum
  misc_feature (121)..(121): Xaa can be any naturally occurring amino acid
  misc_feature (132)..(132): Xaa can be any naturally occurring amino acid
  misc_feature (199)..(199): Xaa can be any naturally occurring amino acid
  misc_feature (237)..(237): Xaa can be any naturally occurring amino acid
MGLPSSRHRGRPLPPLQLQEATGPYHPNRQLGDGGFGTVYKGYLVDGRVVAVKRLYNNSYRRVERFVNEAASCGTRSTWPWWRSATSRSAGWRSCRELLLVYEFVQNGTVADHLHGPRVGXERALPWPLRLXFAVESAAALTYLHAIEPPIVHRDVKTNNILLDTDFHVKVADFGLSRLFPLDATHVSTAPHGTPWYRXDPEYHQCYQLTDKIDVYSFGVVLVELISSKPAVDITRXRNDINLA

SEQ ID NO: 5773 - protein, 211 aa, Triticum aestivum
  misc_feature (96)..(96): Xaa can be any naturally occurring amino acid
EEGEKKARGRRERREGAGAGSKRGEETEQDEGRKGYKEGGRSGILRGERRAEEEGRGEGRIAVDDNCVDAIYKHVFPVEVAPELSFIGVPWKVIPXLPLVELQSKWVAGILSGRIKLPSKDEMMEDVKAIYSRLETRGWPKRYTHNFSGGYQFEYDDWLAEQCGHPPIEEWRKLMYAANAKNKAARPERYRDEWDDDGLVALANEDFKKYF

SEQ ID NO: 5774 - protein, 681 aa, Triticum aestivum
  misc_feature (154)..(154): Xaa can be any naturally occurring amino acid
  misc_feature (320)..(320): Xaa can be any naturally occurring amino acid
  misc_feature (346)..(346): Xaa can be any naturally occurring amino acid
  misc_feature (400)..(400): Xaa can be any naturally occurring amino acid
MAGAAAAAAAVASGISVRPVAAPKISRAPRSRSVVRAAVSIGEKAYTVQKSEEIFNAAKELMPGGVNSPVRAFKSVGGQPIVFDSVKGSHMWDVDGNEYIDYVGSWGPAIIGHADDKVNAALIETLKKGTSFGAPCALENVLAQMVSSAVPSSXMVRLCKFRNTKLCMGALRLVRSISLGGEKILKFEGCYHGHADSFLVKAGSGVATLGLPDSPGVPKGATVGTLTAPYNDAEAVKKLFEDNKGEIAAVFLEPVVGNAGFIPPQPAFLNALREVTKQDGALLVFDEVMTGFRLAYGGAQEYFGITPDVTTLGKIIGGGXLPVGAYGGRKDIMEMVAPAGPMYQAXGTLSGNPLAMTAGIHTLKRLMEPGTYEYLDKVTGELVQGILDAGAKTGHEMCGXGHIRGMFGFFFAGGPVHKFSYPLLIFSPHPTTSREKEGSIMAGAAAAAAAVASGISIRTVAAPKISRAPRSRSVVRAAVSLGEKAYTVQKSEEIFNAAKELMPGGVNSPVRAFKSVGGQPIVFDSVKGSHMWDVDGNEYIDYVGSWGPAIIGHADDEVNAALIETLKKGTSFGAPCALENVLAQMVISAVPSIEMVRFVNSGTEACMGALRLVRAFTGREKILKFEGCYHGHADSFLVKGSGVATLGLPDSPGVPKGATVGTLTAPYNDAEAVKKLFEDNK

SEQ ID NO: 5775 - protein, 203 aa, Triticum aestivum
MSAAVGGAEFHGFGGAAQLPRSRMLGRPVRVAPPGATPAGSGPSAASIRAVSTPLKKDAKEVKRSKVEIIKEKSNFLRYPLNEELVSEAPNVNETAVQLIKFHGSYQQSDREVRGQKNYSFMLRTKNPSGKVPNQTYLAMDTLADEFGIGTLRLTTRQTFQLHGVLKKNLKHVISTVIKNMGSTLGACGDLNRNVLAPAAPYV

SEQ ID NO: 5776 - protein, 440 aa, Triticum aestivum
  misc_feature (134)..(134): Xaa can be any naturally occurring amino acid
MSTTKVKRRVGKYELGRTIGEGTFAKVRFARNTETGDPVAIKILDKEKLLKHKMVEQIKREIATMKLIKHPNVVRIHEVMGSKTKIYIVLEYVTGGELFDTIVNHGRMREDEARRYFQQLINAVDYCHSRGGVXTRDLKPENLLLDSCGNLKVSDFGLSALSQQLKDDGLLHTTCGTPNYVAPEVLEDQGYDGAMADLWSCGVILFVLLAGYLPFEDSNLMALYKKISDAEFTFPPWTSFPAKRLLTRILDPNPMTRITVQEMLEDEWFKKGYKRAEFDEKYDTTLDDVDAVFNDSEEHHVTEKKEEEPVALNAFELISMSAGLNLGNLFDSEQEFKRETRFTSKSSPKEILRKIEEAAKPLGFDIQKKNYKLRLEKVKAGRKGNLNVATEILRVGPSLHMVEVRKAKGDTLEFHKFYKNLSNTLKDVVWKSDDLQIQPS

SEQ ID NO: 5777 - protein, 148 aa, Triticum aestivum
MAGRKGGERKKSVTRSVKAGLQFPVGRIGRFLKKGRYAQRVGSGAPVYLAAVLEYLAAEVLELAGNAAKDNKKTRIVPRHLLLAVRNDQELGRLLAGVTIAHGGVIPNINPVLLPKKSAAAAEKEATKSPKKKAAAKSPKKKPAAAKE

SEQ ID NO: 5778 - protein, 174 aa, Triticum aestivum
MVFAAAEGGRGGTEWSPVRRRSSKKKMAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEATKSPKKKTAAKSPKKKTAATKE

SEQ ID NO: 5779 - protein, 221 aa, Triticum aestivum
  misc_feature (102)..(102): Xaa can be any naturally occurring amino acid
MPSRSRVAVIGAGAAGLAAARELRREGHAPVVFERAAAVGGTWRYEDSNAADPADPLGAGGAHSSLYASLRTNLPRESMGFLDFPFVADRSSADPRRFPGHXEVLRYLETFARRFDLLGLVRLQTEVVGVRRSRVDGVGAGAAGWTVSYCSRKLAGGELQEEEEQSEVFDAVVVCNGHFAEPLLADIAGIGGWPGKQLHSHSYRVPDPFHGQVVVVIGYHP

SEQ ID NO: 5780 - protein, 90 aa, Triticum aestivum
  misc_feature (19)..(19): Xaa can be any naturally occurring amino acid
ALPTGRKFYANLLDAGMSXVGGEESSVTGSDHIREKDGVGAGIAWLSILGYKNNDNVARDKIATGADIAFHHWATYWSPYSTPSDYENVD

SEQ ID NO: 5781 - protein, 401 aa, Triticum aestivum
MATKRSVGTLGEADLKGKKVFVRADLNVPLDDAQKITDDTRIRASIPTIKYLLEKGAKVILASHLGRPKGVTPKFSLKPLVARLSELLGLEVVMAPDCIGEEVEKLAAALPDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 5782 - protein, 362 aa, Triticum aestivum
  misc_feature (59)..(59): Xaa can be any naturally occurring amino acid
  misc_feature (182)..(182): Xaa can be any naturally occurring amino acid
  misc_feature (233)..(233): Xaa can be any naturally occurring amino acid
MEPIPLLTPYKMGQFDLAHRVVLAPMTRQRSYGNVPQPHAAVYYSQRATAGGLLTGQGXTPRIWTAEHVEAWKPIVAAVHAKGALFFCQIWHGARVSTFELQPGGAAPLSSTEKGVGPQMSFDGRLEEFSPPKRLTVEEIPAIIDDFGKAARSAVDEILDAAGNAIDDGFDGVEIHRVNAYXVPLSIEDVSNARTDELCGSIENRCRFALEVVDAVVKEVGGHRVGIRLSPFXDYMDCHDSDPHSLALHLSTKLNDYSIIYLHMVEPRMAIVDGRRVVPKRLLPYREAFKGTFMANGGYDREEGGKVVADGYTDLVSFGRSFLANPDLPKRFEIGAELNKYDRMTFYISDPVIGYTDYPFLD

SEQ ID NO: 5783 - protein, 176 aa, Triticum aestivum
MAPTVMSSAATAVAPFQGLKSTAGLPVSRRSSSAAGLGSVSNGGRIRCMQVWPIEGIKKFETLSYLPPLSTEALLKQVDYLIRSKWVPCLEFSKVGFIFREHNASPRYYDGRYWTMWKLPMFGCTDATQVINEVEEVKKEYPDAYVRIIGFDNMRQVQCVSFIAFKPPGCEESGKA

SEQ ID NO: 5784 - protein, 270 aa, Triticum aestivum
MATVAATMATPTRHRQFRVRAAWDMNPGAATVAVPKPSKAKPKPALGQSPATATTPARAPPPTHADLFARSSEDQAKKSTYMGFEKWWLPPAPEVKKPRSLYNAASLAYLGDCIYELYARRHFFFPPLSINEYNKRVMDVVKCESQDLLLNKLLGEDFLTEEERDILRWGRNIVSSKTRTRKRAGIAVYNRASSLETLIGYLYLTNFKRLEQMMFQLGFTASSQLLQVTRVVLRHRILQMSCSQASRKQPQLLYNLSNLQSDEQFQYVMN

SEQ ID NO: 5785 - protein, 264 aa, Triticum aestivum
MEAAVGGSWTRVRTLGRGASGAVVSLAADDLSGALFAVKSAPAAAADQLRREGDILSGLSSPHVLPCLGFRAAAGECQLFLEFAPGGSVADVAARSGGRLEECAVRAYAADVARGLAYLHGRSLVHGDVKARNVVVGADGRAKIADFGCARAVGSSDRPVGGTPAFMAPEVARGEEQGPAADVWALGCTVVEMATGRAPWSDMDDVLTAMHRIGYTDAVPEVPAWLSAEAKRFLAMCFARDARDRCTAAQLLEHPFLASAGCGV

SEQ ID NO: 5786 - protein, 636 aa, Triticum aestivum
  misc_feature (59)..(59): Xaa can be any naturally occurring amino acid
  misc_feature (109)..(109): Xaa can be any naturally occurring amino acid
  misc_feature (120)..(120): Xaa can be any naturally occurring amino acid
MSAAVGGAEFHGFGGAAQLPRTRMLGRPVRVAPRGATPAGGGAPSGASIRAVSTPLEKXQNKLSEAGWSIIREESKVVRYQVNEELASEAADVHDSPIQPINFQGSYQXANVQLRDQQTXAFMFLARITTGSGPCQILMAVDTQADEFGVSTLRPIRGRPVPPQSVREWNNLEVISTVIKNMGSTLGACGDLNRNVLAPAAPYVRKDILFAQETAENIAALLAPQSGAYYDLWVDGEKIMSAEEPPEVTKARNDNSHGTNFPDSPEPIYGTQYLPRKFKIAVTVAGDNSVDILTNDIGVVVVSDSAGEPVGFNLYVGGGMGRTHRIETTFPRLADPLGYVPKEDILYAIKAIVVTQRENGRRDDRRYSRMKYLLDSWGIDKFRAEVEKYYGKKFEDFHPLPEWQFNSYLGWQEQGDGKLFYGVHVDNGRLGGQAKKTLREIIEKYSLDVSITPNQNLILCGVDQAWREPITAALAQAGLLEPKDVDLLNITSMACPALPLCPLAQTEAERGILPILKRIRAVFDKVGIKDEESVVVRITGCPNGCARPYMAEVGFVGDGPNSYQIWLGGTPNQTTLAETFMNKVKLQDIEKVLEPLFSYWNSTRQEGESFGSFTNRMGFEQLKEVVNKWEGSASAA

SEQ ID NO: 5787 - protein, 164 aa, Triticum aestivum
  misc_feature (101)..(102): Xaa can be any naturally occurring amino acid
GLNALAGRLKYDDPLEAAQLHGGCGAWGIIFTALFAKKQYVEEIYGAGRPYGLFLGGGGRLLAAHIVQILVIAGFVSCTMGPLFFALKKLGLLRISAEDEXXGMDLTRHGGFAYVYHDDERARQVGWRASCSSRGHTRVEAGQAGGPTRPALTKSNPGVRLQEK

SEQ ID NO: 5788 - protein, 196 aa, Triticum aestivum
  misc_feature (114)..(114): Xaa can be any naturally occurring amino acid
  misc_feature (119)..(119): Xaa can be any naturally occurring amino acid
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTXAHGGXLPNIHSVLLPKKAAGKRRRAAEARSPIPKEGASPKKVKNRSHCRVRTCLSIGVDFSQNSGLVYEVLTKSSTLFKKGQ

SEQ ID NO: 5789 - protein, 392 aa, Triticum aestivum
  misc_feature (244)..(244): Xaa can be any naturally occurring amino acid
  misc_feature (267)..(267): Xaa can be any naturally occurring amino acid
MKPLYLRGSGSFKRLLLSLSPHRAKRVHAPPGDAHAESPQSPPPTERRPEWECFSYEEVRRATDGFRAANLVGRGGSSEVYRGELADGRAVAVKRLMGASACERRERDFLAELGTVGHARHPNVCPLLGCCVDRDLYLVFAFSARGSVSANLHDGEEGAPAMGWEARYGVAVGTARGLEYLHKGCRRRIIHRDIKASNVLLTDDFQPQISDFGLAKWLPTEWTHRAIAPIEGTFGCLAPEYYTXGIVDEKTDVFAFGVFLLELMAGXRKPVDGTHRSLLGWARPLLSEGKTEALLDPRILAGGNGGYDAEQARRLAFVASLCVRASATWRPSMTEVLDLLEGAETTEERWAMPEPAAGDDEGEEMWGFDDLDDYEEESGTPSPLSTSSASSA

SEQ ID NO: 5790 - protein, 140 aa, Triticum aestivum
  misc_feature (133)..(133): Xaa can be any naturally occurring amino acid
RGRVGNGTGINKPDYLATVDLDPSSPTYSQVIHRLPVTHIGDELHHSGWNSCSSCHGDPSAKRRFLILPSLLSGRVYVVDTATDPRAPSLHKVVESEDIAENTGLGFPHTSHCLASGDIIISCLVDKEGNAAXNGFLLVD

SEQ ID NO: 5791 - protein, 555 aa, Triticum aestivum
  misc_feature (61)..(61): Xaa can be any naturally occurring amino acid
  misc_feature (108)..(108): Xaa can be any naturally occurring amino acid
  misc_feature (131)..(131): Xaa can be any naturally occurring amino acid
  misc_feature (142)..(142): Xaa can be any naturally occurring amino acid
  misc_feature (459)..(459): Xaa can be any naturally occurring amino acid
MGRVAATTRARPRGAMPREEVATATVYRGLEPCRLPAVSPTVSVRVRRRLPDYLLCIDVKXARLADHYLVSGAADRGTIRVVVPGWGTDVATLDRGQLFRMLPGPGHXPLPRLCLALAVFAFTILFYITSXSRPTYLSDFDXTRPTHELKASKAEFIELARKSGKFDEESLRGQARLLAKSGIGDESYMPRCVFQPDANCATMKEGRAEASAAMFAALDELFDKCRVRPKDVGVLVVNCSLFNPTPSLSAMIVNHYKMRGNILSYNLGGMGCSAGVISIDLARDMLQASGAGLAVVVSTEAVSFTWYAGKRRSMLIPNAFFRAGAAAVLLSNRRRDFRRAKYQLEHVVRTHKGADDRAFRSVYQEEDEQRIKGLSISRDLVEVGGHALKTNITTLGPLVLPFSEQLLFFAGVLFRHLYPSKTSTPPPPAANGDTSAAAPYIPDFKRAFEHFCMHAASRXVLEHLQRNLGLRDADLEASRAALHRFGNTSSSSIWYELAYLEAKGRVRRGDRVWQLAFGSGFKCNSAVWRAVRRVRRPSRSPWLDCVDQYPARMDA

SEQ ID NO: 5792 - protein, 181 aa, Triticum aestivum
MLPLLLISTLPAFTLLLVAPASYKPWKLVRELGLVALLLARELLRHSASAAAGAGRKEQQGARMPPSKAKTPPPALAEDDADALPVLDLPELALERVLEELSPASLAAMACVCAGLRDRCSMDGLWARHVRRKWGRVLGAAARREWEAELAARAAAATLPRPARRRGWADSLACAWPLSWI

SEQ ID NO: 5793 - protein, 265 aa, Triticum aestivum
LDRTSLYKKAGWYRSGIPGISSTHASEEIKARLEAVSGLPNCCGAIDATHIIMTLPAVESSEDWCDPAKNYSMFLQGIVDNEMRFIDIVTGWPGSMTFSRLLKCSGFYKLCEAGKRLNGPVRTSGEDSEIREFIVGDMCYPLLPWLMTPYQGESLSTPMVNFNARQKTARMLGTRALARLKGSWKILHKVMWRPDKNKLPSIGLVCCLLHNIILDCNDKLLPDIQLPDHHDYGYNEENCQQENPNGKVIREIITGYLPTYEETSN

SEQ ID NO: 5794 - protein, 104 aa, Triticum aestivum
  misc_feature (30)..(30): Xaa can be any naturally occurring amino acid
  misc_feature (69)..(69): Xaa can be any naturally occurring amino acid
  misc_feature (83)..(83): Xaa can be any naturally occurring amino acid
MLGYQLARTELDTLLRTFQDGIHQLQTKFXEHPTPIDYQYFKKAIASKVVILHKGAHDNSEIPIHGDSXSPEYTPMCYPLLFXMHEADRTSVNGSERIKEDISE

SEQ ID NO: 5795 - protein, 147 aa, Triticum aestivum
  misc_feature (68)..(68): Xaa can be any naturally occurring amino acid
MAGRKGGDRKKAVTRSVKAGLQFPVGRIGRYLKKGRYAQRVGSGAPVYLAAVLEYLAAEVLELAGNAXAKDNKKTRIIPRHLLLAVRNDQELGRLLAGVTIAHGGVIPNINSVLLPKKSPAAAEKEAKSPKKKTTAKSPKKKVAAKE

SEQ ID NO: 5796 - protein, 146 aa, Triticum aestivum
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPATAEKEAKSPKKKTTTKSPKKKVAAKE

SEQ ID NO: 5797 - protein, 156 aa, Triticum aestivum
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSTKKAAKSPKKADKKA

SEQ ID NO: 5798 - protein, 340 aa, Triticum aestivum
MGGAAAATGAARWIQRLSAARISTEALERGQSRVIDASLTLIRERAKLKGELLRAMGGVKASATLLGVPLGHNSSFLQGPAFAPPRIREAIWCGSTNSSTEEGKELNDPRVLTDVGDVPIQEIRDCGVEDDRLMHVISESVKTVMDEDPLRPLVLGGDHSISYPVVRAVSEKLGGPVDILHLDAHPDIYDCFEGNTYSHASSFARIMEGGYARRLLQVGLRSITKEGREQGKRFGVEQYEMRTFSRDREKLENLKLGEGVKGVYVSVDVDCLDPAFAPGVSHIEPGGLSFRDVLNILQNLQGDVVAGDVVEFNPQRDTVDGMTAMVAAKLVRELSAKISK

SEQ ID NO: 5799 - protein, 353 aa, Triticum aestivum
MRVDDADKPDSADAGAEKPAELPSPHMESVCENTTTADFKQSNFGNFLPNVRSGGWSDIGSRQYMEDTHVCIADLAKNFGYPTVDKEVVSFYGVFDGHGGKDAAHFVRDNLPRVIVEDADFPLELEKVVSRSFVQIDSQFADKCSHQRTLSSGTTALTAMIFGRSLLVANAGDCRAVLSRCGIAMEMSMDHRPCSLSEKLRVESLGGYVDDGYLNGLLGVTRALGDWHLEGMKEASRPGGGPLSAEPEIKLTTLTKDDEFLVIGSDGLWDVFSNQNAVDFARRRLQEHNDVKRCCREIVEEAIRRGATDNLTAVLVSFHLVAPPQIRVNQPRRVARSISADGLNSLRILLGSQ

SEQ ID NO: 5800 - protein, 507 aa, Triticum aestivum
MEVEASAHGDTAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAAIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYYDHFHLDLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPVALVHFPQWGSMFFPASADATEEEYYASEWSEEEKGKGLHITGQKFAENSRSERGRRNVILATSATPPNNTPQHV

SEQ ID NO: 5801 - protein, 308 aa, Triticum aestivum
  misc_feature (295)..(295): Xaa can be any naturally occurring amino acid
LIQWKEVGIANLAGVISLAAGLLMWVTSLHPVRKRFFELFFYTHQLYVVFVVFLVLHVGDFVFSISAGAVFLFMLDRFLRFWQSRTKVDIVSAACRPCGTVELVFSKPPSLRYNALSFIFVQVRELSFLQWHPFSVSSSPMDGRYHMSILIKVLGTWTDTLKRIIADVQEQKTRSDSDSDQSQTGRITASIEGPYGHESPYHLMYENLILVAGGIGISPFLAILSDIIHRIGQGMPCAPKNVLVLWSAKKTSELSLLLAVDAQSISSSVCDKLHLDIQAFVTQESDPPLEDGIVXGDDQKAPGIFVKN

SEQ ID NO: 5802 - protein, 270 aa, Triticum aestivum
  misc_feature (105)..(105): Xaa can be any naturally occurring amino acid
  misc_feature (117)..(117): Xaa can be any naturally occurring amino acid
  misc_feature (224)..(224): Xaa can be any naturally occurring amino acid
MGSGNLVMKKVVKPSSFDLDIQLDKSWTEDVTCPICLDFPHNAVLLRCTSYEKGCRPFVCDTDKSRSNCLERFKSAHGQPVNVKVSAVNIAPRDSIPFHLVKHKXHPACPLCRGDVXRAWAVIGEARQHLNQKKRCCEESCCSYVGNFHELQKHTQQKHPNSRPSEIDPARRVDWENFQQSSDIIDLLSTIHAQVPNSIVLGDYVIEYGDDDAGDDYEVLHKVXGNWWTPGISCSPSGLKGRRRQKGKGVGRRNRNSLVRKLTSTFNKLT

SEQ ID NO: 5803 - protein, 429 aa, Triticum aestivum
  misc_feature (149)..(149): Xaa can be any naturally occurring amino acid
QHFEATIKSITTHNQGQAKASLPAGCRGRPRRMQRSAWGSLLGSCLGGGGGKTGKQVRPGPGPRKRESSAAAGAGQRLSFTDVMSAASEQELSVSLVGSNLHVFTVAELKAATQGFLDDNFLGEGGFGPVYKGAVDDKVKPGLKAQPIXAVKLWDPQGAQGHKGVAAGASARALLRHTNLVKLIGYCCEHENRLLVYEYMAKGSLENHLFKKFPPVLSWSTRLNIAVGAAKGLAFLHDAEKPVIYRDFKASNILLDPDYKAKLSDFGLAKDGPEGDETHVSTRVMGTHGYAAPEYILTGHLTAKSDVYSFGVVLLEILTGRRAVDKTRPSREHHLVQHMRSWLKDPEKLGKIMDPALEGKYATTAAHKAALVAYQCLSGSPKSRPDMSKVVEDLELLLNLVDDVPGEPVMHVASQDDTRKERTRRRNGE

SEQ ID NO: 5804 - protein, 494 aa, Triticum aestivum
MAAAVADAAVPAAARANDAGAGCCAAKGPGYATPREAMEKGPREGLLYVTCVYNGTGIDKPDYLATVDVDPNSATYSQVIHRLPATHIGDELHHSGWNACSSCHGDPSTSRRFLILPSLLSGRVYVVDTAKDPRAPALHTVVQAEDIAEKTGLGFPHTSHCLATGDIMISCLGDKEGNAAGNGFLLLDSEFNVKGRWEKPGHSPLFGYDFWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIEPLKVRNWMLPEMPGLITDFVISLDDRYLYLVNWLHGDIRQYNIEDPAKPVLAGQVFVGGLLQKGSDVVYVTDDDKEEQYAVPQVKGNRLRGGPQMIQLSLDGKRVYVTNSLFSRWDEQFYGPDLLKKGSHMLQIDVDTEEGGLAVNPNFFVDFGTEPEGPSLAHEMRYPGGDCTSDIWI

SEQ ID NO: 5805 - protein, 345 aa, Triticum aestivum
  misc_feature (72)..(72): Xaa can be any naturally occurring amino acid
  misc_feature (230)..(231): Xaa can be any naturally occurring amino acid
RRCTRETHCEFLTEQVTCMRNGRRDDSYQKWRWQPTDCDLPRFDARLLLEPPRGVRRRLGGAARVRCPGESXVCLVQSAIPKGHKTLTKFVNNGSSNVFYAHDYNATVEFYWAPFLVESNSDNPKVHSVPDRVIQWHSIAKHAKNWVGVDYLVFNTYIWWLSALDMKVLKKGSFDEGATEYEEVDRPVAYSEVLKTWAKWVDRNIDPNSTTVFFMGMSPNHITPEAWGNXXGIKCAMETQPIANRSATLDVGTDWRLYAGAQDVLKTFRRVPVHFVDITALSELRKDAHTSVHTLRQGKLLTPEQQANPKTYADCIHWCLPGLPDTWNQFLYARIVSSASTQRQE

SEQ ID NO: 5806 - protein, 219 aa, Triticum aestivum
TRGLAACGVMMSIVSTAADLMQDFKTGYLTLASPRSMFISQIIGAGMGSVVAPRDFWQFHPAVGGTGLRGGGPPAPAAVGYRNMAILGVDGFSSLPKHCLTLCYVFFAGAIIINLVRPTRPAKVARFIPLPMAMAIPFYIGSYFAIDMFVGTVIVFVWGIVNKAKADAFAPAVASGLICGDGIWTLPQSILALAKVKPPICMKFLSRSVNANVDAYLGN

SEQ ID NO: 5807 - protein, 477 aa, Triticum aestivum
MAMAPSLRTTVLLLLFLLAASSQAEAAQAAEDGIRVLSAEKRIDLTGPIVKVFLTLKVQNAATGADASHVLIAFTPAEADHLAIVKATRAEGKRKKKAYIPLPVTPADAATAAPNGARLYSISLPSPLKPAETTTVEVFYVLTHSLEPFPAEITQSESQLVYYRDSAVILSPYHVQEQGTYVKTPSSRVESFTRADPTSRSGPDVKYGAYSNQLPYAYSPIILHYENNHAFAVVEELVRKVEISHWGNVQVTEHYKLKHGGAKHKGVFSRLEYQARQSISGASSFKNLLARLPPRVHSVYYRDEIGNISSSHLRSDSYKSELEIEPRYPLFGGWHCTFTIGYGMPLQDFLFESADGRRFANLTFGCPLLNTVVDNLTIKVVLPEGSKSPQAVVPFETEQHLETSYSYLDVVGRTTVVIKKKNVVGEHNVPFQVYYEFSPIFMLAEPLMLVTAVLLLFAACIVYLHTDLSIAKSQASS

SEQ ID NO: 5808 - protein, 243 aa, Triticum aestivum
  misc_feature (108)..(108): Xaa can be any naturally occurring amino acid
SARGPARRRGLADSLACAWPFSWIGRRWLKEDAAAAARSAPAPPADTVAAWYRALECGDFWFPAQVYNREDGHVGFLLSCYDAHLRYDRRTDTFTARYPPHGRKPAKXEEGVPWCRVRAAPLSTPAQDLHASACLERPRPGDHFEIQWRKNKDFPYGWWYGVVGHLEPCNANEHLCRCHEDDTIMLEFKHYAAGSRWRQTTVSRKDHREKGDETDGFYGGIRKLQTKDEISTWRRFWPVDVLS

SEQ ID NO: 5809 - protein, 139 aa, Triticum aestivum
YRNMAILGVDGFNTLPENCLTLCYIFFAAAIVINLIRDLTPHKFSRFIPLPMAMAIPFYIGSYFAIDMFLGSFILFVWEKMNKAKADAYGPAVASGLICGDGIWTLPQSILALAKVNPPICMKFLTRGDNVKVDKFLGG

SEQ ID NO: 5810 - protein, 363 aa, Triticum aestivum
MNRKENPPSIPPPLLVPTLSLSLSLRLSVRARSAFLGREEMAAKRELVVSFGEMLIDFVPTVAGVSLAEAPAFVKAPGGAPANVAIAVARLGGGAAFVGKLGDDEFGRMLAKILRENGVDAGGVVFDSGARTALAFVTLRADGEREFMFYRNPSADMLLTADELKVDVIKRAAVFHYGSISLIAEPCRTAHLHAMKVAKEAGALLSYDPNLREALWPSLEEARTKILSIWDQADIVKVSEVELEFLTGINSVEDDVAMKLWRPTFKLMLVTLGDQGCKYYTKDFRGTVPSYKVQQVDTTGAGDAFIGSLLRKIVQDPSALQDKTKLEGAIKFANACGAITATKKGAIPSLPKEDEVLRLMEKA

SEQ ID NO: 5811 - protein, 164 aa, Triticum aestivum
SKEPVVRDEDDYQNYRKAAKQHWDMMKQYYGKAVDAFREGNKKEAEYLMTEGKNYYRMARLSDEKSAAEITKSKQESKNELCLDLRSQDAANVANLLRLHLRQLANIPSFENLRVIIGVDDGTFKMGQRRRKVEKFLEKKSVEWTEDEANPGTILIPINQVKDQ

SEQ ID NO: 5812 - protein, 170 aa, Triticum aestivum
MLGHLVGLVKVRVTRGVNLAIRDLRSSDPYVVVRMGKQKLKTRVVRKSINPEWNDELTLSIEDPTIPVKLDVFDKDTFFDDPMGNAELDIGPLVEAARMRVQLQGVADNTVVKKLVPNRQNCLAEQSAIYLSEGTVKQDVVLRLRNVECGEVELQLQWIDIPGSKGVSGF

SEQ ID NO: 5813 - protein, 415 aa, Triticum aestivum
MANVGDLANIAQLTGLDAVRLIGLIVKAAATARMHKSNCRRFAQHLKLIGGLLEQLRVSELKKYPETREPLEQLEDALRRGYLLVNSCQDRSYLYLLAMGWNIVYRFRTAQTEIDNYLRLVPLITLVDNARVRERIEYIERDQCEYSLDEEDKEVHEALLNPDPSTNPSIVLKKTLSCSYPNLPFNEALRKESEKLQVELQRSQSNMDMAQCEVIHHLLGVTRTVESSIPDESTDAKVTKKTKSKCTKVNEDSAKSYDDDSPKKQKDAYVAPRSSSPVPYNHDLVSSTASYSDEWHADLLGCCSEPALCLKTFFFPCGTFSRIASIAKNKPMSSGEACNDIMAYSLILSCCCYTCCVRRKLRQRLNIAGGCCDDFLSHVMCCCCALVQEWREVEIRGAYGGKTKITPPAHQYMEH

SEQ ID NO: 5814 - protein, 113 aa, Triticum aestivum
LVVAEAARRGGAHVAEAGCYVGPAVNVLVELGLSLLLSCWVGYPNPGAIPWEPRLYQTLGWVATGLFWAFVMLPRRGMNVDRTLGFGLLAIYTRCLSTTPCLFAQFKGSNGFS

SEQ ID NO: 5815 - protein, 363 aa, Triticum aestivum
  misc_feature (170)..(170): Xaa can be any naturally occurring amino acid
  misc_feature (233)..(233): Xaa can be any naturally occurring amino acid
  misc_feature (296)..(296): Xaa can be any naturally occurring amino acid
  misc_feature (317)..(317): Xaa can be any naturally occurring amino acid
  misc_feature (327)..(327): Xaa can be any naturally occurring amino acid
MEPIPLLTPYKMGQLNLAHRIVLAPLTRQRSYGNVPQPHAALYYSQRASAGGLLITEATGVSDTAQGYRDTPGVWTAEHVEAWKPIVDAVHAKGALIFCQIWHVGRVSTYEYQPGGAAPLSCTDKGVGPLSSSDRVRRQPRLPLSRGRVEGRPPVSEATISTTHVSFHVXIGGRYDARKSHVLLLSSMPNDHCHGDDYGGSIENRCLFALEVVDAVVKEDGGHRVGIRLSPCXDYMDCHDSDPHALALHMSTKLDNYNLIYLHMVEPRMAIVDGRRVVPKRLLPYREAFKGTFMAXAGYDREEGGKVVADGYTDLVXFGRSFLANPXDCQTRFEIGAELNKYDRMTFYISDPVIGYTDYPFLD

SEQ ID NO: 5816 - protein, 140 aa, Triticum aestivum
PCAVEPSRSLPRQTLRPQISPGEKRDFAAMAAAGGTSSDDVPVIQAENLTSNVRSILYSRTFLSIISGVVAGIWGFTGLTGFVFYFLIMMVASIGLLAKSKFSVHTYFDSWSRILVEGVLAGLMSFVLFWTFAYDIVHIF

SEQ ID NO: 5817 - protein, 295 aa, Triticum aestivum
  misc_feature (202)..(202): Xaa can be any naturally occurring amino acid
MEHLPVEVIGNILAHLSAARDVMVSSAVCRKWREACRKHLHSLSFNSDDFPRDMTTRQLEIIITQTIFQTMGLQCLSIHIDNTHEFSAAPVIAWLMYTRETLRCLYYNIQTNPNVNILEKCGRQKLEVLDLDHNTITGVEPSYQRFTCLKSLYLRHVSISALDLSLLVAACPKIESLALDVLEIVTSDSQSTMELTSHTLKXSIFVKTVGVDKIILDADNLEVLHLNALNLDLFELSGKGTLKHLKIDDVSVTHLDIGESTDHLEVMDVSNFMIVWPKFYSMISRACNLRVLRFW

SEQ ID NO: 5818 - protein, 165 aa, Triticum aestivum
KIAGASRIIGIDIDAKKFDVAKNFGVTEFVNPKDHDKPIQQVLVDLTDGGVDYSFECIGNVSIMRAALECCHKGWGTSVVVGVAASGQEIATRPFQLVTGRVWKGTAFGGFKSRSQVPWLVEKYMNKEIKVDEYITHNMNLTDINKAFDLLHEGGCLRCVLAMEH

SEQ ID NO: 5819 - protein, 381 aa, Triticum aestivum
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECRDCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSIVAVFGLGTVGLAVAEGAKSAGASRIIGIDIDTKKFDVAKNFGVTEFVNPKDHDKPIQQVLVDLTDGGVDYSFECIGNVSIMRAALECCHKGWGTSVVVGVAASGQEIATRPFQLVTGRVWKGTAFGGFKSRSQVPWLVEKYMNKEIKVDEYITHNMNLTDINKAFDLLHEGGCLRCVLAMEH

SEQ ID NO: 5820 - protein, 384 aa, Triticum aestivum
MALLKAARVADVPSLDVVVPDHLAAAARVLDAESAAAMKRQQRGAGRRFAVIGHRGKGMNALASPDRRLQEVKENSIRSFNEAARFAVDYVEFDVQVTKDVCPVIFHDNFIITEEHGKISEKRVTDLQLEDFLQYGPQNKQGKNGKPLLRKMKDGRVLNWSVQSDDPLCTLQEAFEKVNPRLGFNVELKFDDNLVYQDEELTHILQAILKVVFECAKDRPIIFSSFQLDAAQLMRKLQSTYPVYFLTNGGTEVYADVRRNSLEEAVKLCLATGMQGIVSEARAVFRFPTAIPKIKEADLSLLTYGTLNNVPEAVYMQHLMGVNGVIVHLVPEITGAVSDLIALPETDAEINDLSGQVAKDAASTPNFTQREISFLLRLMPELVQ

SEQ ID NO: 5821 - protein, 65 aa, Triticum aestivum
  misc_feature (24)..(24): Xaa can be any naturally occurring amino acid
  misc_feature (40)..(40): Xaa can be any naturally occurring amino acid
NLTARLLKPQALNSWGHYPLIPIXSWAFGTINRIHDFIEXGLKIFWLSLLDFGTVELMVAHLSNK

SEQ ID NO: 5822 - protein, 265 aa, Triticum aestivum
  misc_feature (111)..(111): Xaa can be any naturally occurring amino acid
  misc_feature (174)..(174): Xaa can be any naturally occurring amino acid
HWSALSGVDTEIMNVEGHIAPSEKHPGSLLEGFSQTQVSTLAVKDNLLVAGGFQGELICKNLDQEGISFCCRTTYDDNAITNAVEIFNTSSGAVHFIASINDSGVREYDMXERYQLCKHFRFDWPVNHTSLSPDGKLVLVVGDDPDALLIDANSGKTIHSMKGHLDFSFASAWXPDGRTFATGNQDRTCRVWDARNLSQSLHVLRGNLGAIRSTRYTSDGQFLTMAEPADFVHIFDVKSDYNKRTYGSLLQYGRLYNYSYLDSLF

SEQ ID NO: 5823 - protein, 675 aa, Triticum aestivum
PRVRITGLTGTVFLFFSGPILLIAALAYVYIFAFPGDHVQKKKLRSLSFRLWTFPVLVPRVRGVVSAVEFIGIVLFIVYIVFSMTYYVVDSVSFISKAHLPPTTRSELLLALIGLRFGSVGLFCMIFLFLPVSRGSVLLRLIDIPFEHATRYHVWLGHLTMALFTLHGLCYVISWSLLGRLIEELIQWKEVGIANLAGVISLAAGLLMWVTSLHPVRKRFFELFFYTHQLYVVFVVFLVLHVGDFVFSISAGAVFLFMLDRFLRFWQSRTKVDIVSAACRPCGTVELVFSKPPSLRYNALSFIFVQVRELSFLQWHPFSVSSSPMDGRYHMSILIKVLGTWTDTLKRIIADVQEQKTRSDSDSDQSQTGRITASIEGPYGHESPYHLMYENLILVAGGIGISPFLAILSDIIHRIGQGMPCAPKNVLVLWSVKKTSELSLLLAVDAQSISSSVCDKLHLDIQAFVTQESDPPLEDGIVGDDQKAPGIFVKNGTAMSGLVGTGDNFWAAMYFAASTLGSVLAFVLVQLYYVKRYNVYAWWYLGLLLLLCMAAGITLPGGLVVLLWHLSEKRRMQDDRWDVNARAGADAEQTTNAAGGADASGASLAAMRTTRYGCRPKFHAEFAAFAERAGGAAADVGVLVCGPAGLQASVARECRSQNLRRGGAVFHFNSHSFDL

SEQ ID NO: 5824 - protein, 288 aa, Triticum aestivum
  misc_feature (179)..(179): Xaa can be any naturally occurring amino acid
  misc_feature (188)..(188): Xaa can be any naturally occurring amino acid
MADPSFFVGIVGNIISILVFTSPIATFRRVVRNKSTEEFRWLPYVTTLLCTSLWAFYGLLDPRGRLLIPLHAAGAALHATYVALYLAYAPRDTKVKMANVVVGVNICFFAAVVVVGLVALHGAVRLFAVGVLCSALTIAMYAAPMVAMRTVVKTRSVEYMPFSLSFFLFLNGGIWSVYXLLVKDYFIXIPNAMGFVMGTAHLALYMAYRNKKKLVVLKEEDEEKGAVAPDGTGRAGPGQGAVVEEGAEPADALVPAVAVARVWQPNQGLVRHPPGAALCLEPARARRC

SEQ ID NO: 5825 - protein, 388 aa, Triticum aestivum
  misc_feature (118)..(118): Xaa can be any naturally occurring amino acid
  misc_feature (130)..(130): Xaa can be any naturally occurring amino acid
  misc_feature (140)..(140): Xaa can be any naturally occurring amino acid
  misc_feature (147)..(147): Xaa can be any naturally occurring amino acid
DRKPSLTTPQPRTPALLLRFPPEPRPGLRLRRRGSRGGGRIGKKRGAEVWVSIIGMKDGPCLVEHNQSLACFNRTLRRGRAQGGEAAWGALASGLSDGTRPTGAPRSSKIQPRPQRTXDMIQNYKIPAGXVFNKVKITKXIEVKKLXRGRPVDDLEFMQWMKRYCDSVNGGFMTSYNASERRESSKGGKDTNRRTSGTSQAPAKSASATHKAQPPSHAAKRANGHASNAPQRCAKPPPAYDAQMTELKLLVDSAEKERDFYFSKLRDVEILCQSPEVEHLPIAKAIQKILYASEDDPSTVAEAQAEMVAQQNQMQQQPMLSPILEASEAPSITPKDSSEESLRQEAAAAHKRKSISDLEEFEMGSSSRMRLSDVSDVQLCGSPLMSFT

SEQ ID NO: 5826 - protein, 336 aa, Triticum aestivum
MGGRCFLNLLPCSTTPCKDSVGVGVGTPGSSSCRHSVHHHRARVRGPRRNAAARVSCSAAAAQAPPSQSTIKVVIVGATKEMGRAAIAAVSRARGMELAGAIDTQCIGMDAGELSGMEEALEIPVLNDLTMVLGSIAQTRATGVVVDFSEPSSVYDNVKQAAAFGLSSVVYVPKIEMDTVTELSAFCDKASMGCLVAPTLSIGSVLLQQAAIQASFHYNNVEIVESRPNPSDLPSPDAIQIANNISDLGQIYNRQDMDSDESQQRGQVLGEDGVRVHSMVLPGLASSTSVVLSGPGEVYTLKHDVTDIQSLMPGLILAIRKVIRLKNLIYGLEKFL

SEQ ID NO: 5827 - protein, 240 aa, Triticum aestivum
  misc_feature (201)..(201): Xaa can be any naturally occurring amino acid
  misc_feature (221)..(221): Xaa can be any naturally occurring amino acid
ARGGTAHRAHASTEGVTKYLKPAVAGFLMQKELDYLVGAVANPTKPFAAIVGGSKVSTKIGVIESLLSKVDILILGGGMIYTFYKAQGHAVGKSLVEEDKLELANSLIEKPKLTGVSLLLPTDIVVADNFAADAESKIVPASAIPDGWMGLDVGPDSIKKFSETLDTTKTVIWNGPMGVFEFEKFAAGTDAIAKKLADITXKGVTTIIGGGDSVAAVEKAXLVSKMSHISTGGGASLELL

SEQ ID NO: 5828 - protein, 392 aa, Triticum aestivum
ITRTFQKFSVACALTLGRVGSASPAASLLPPFRSPLHSPTYPSSPSESPPIPSRRRRKEHGEMSSGMGKVVCVTGGSGYIASWLVKLLLHRGYTVRATVRDTADPKKTLHLQALDGAKDRLHLFKASLLEEGSFDAAIAGSDCVFHTASPFYHNVKDPKAELLDPAVNGTLNVLRSCKKASIKRVIITSSMAAVAYNGKPRTPDVVVDETWFSSAEVCEKNEQWYVLSKTLAEEAAWKFANDNGFEIVTINPAMVIGPLLQPTLNTSAEAILKFINGSSSTYPNFSFGWINVKDVALAHILAYEVPSANGRYCMVERVAHHSEIVKIIHEMYPNFPVPEKCADDAPFVPIYQVSKDKIRSLGMELIPLETSLKETIESLREKGFVTSESSHL

SEQ ID NO: 5829 - protein, 107 aa, Triticum aestivum
  misc_feature (54)..(54): Xaa can be any naturally occurring amino acid
QGLDCGEQSTKLFREEILKSKPIVWNGPSGVFEFEAFSNGTKAVLDAVIEATKXGATTIIGGGDPATAALKWGAEGQVFHISTGGGAPLELLEGKELPGVTALSRKN

SEQ ID NO: 5830 - protein, 57 aa, Triticum aestivum
ALNPQQYILKLGEGAPSQCISGFSAMDISPPCGPLCILGHFFFAHSYTMFRYDKLPL

SEQ ID NO: 5831 - protein, 156 aa, Triticum aestivum
  misc_feature (124)..(124): Xaa can be any naturally occurring amino acid
MALARRFIFLFPAAVLAGLASASASPFLSDRVSQASTGLTGRRSLLRTKNDCPMDFEFQNYTIITSRCKGLQHPTMECCAAFKEFSCPFAAYNNMQSTNCAATMLTYINLHGTYPAGLFDECLXGMEGVSCEAIPAIETGMSNGGQRVQGHKSRNS

SEQ ID NO: 5832 - protein, 384 aa, Triticum aestivum
MALRAASPPCAAGRCLPSSPPPRVGGRHFFRPLSSAAPAPLRKSAVCTKAISNSDGTPGTSDSPHVVCFGELLIDFVPTVSGVSLADAPAFKKAPGGAPANVAVGIARLGGSAAFIGTSAHASVGYMLSDMLKENNGNKEGLLFDTHARTALAFVTLRSDGEREFMFYRNPSADMLLEEKELDLDLIRKAKIFHHGSINLITEPCKTAHIAASKAAKDAGVLISYDPNLRLPLWTSADDARDGILSIWDTADLIKVSAEEISFLTNGEDPYDDSVVKKLIHPNTKLLLVTEGPDGCRYYSKEFSGKVGGLKVTAVDTTGAGDAFVAGILSQLAADFSLLQDEARLREALKFANICGALTVTERGAIPALPTRQQVADALTNVVA

SEQ ID NO: 5833 - protein, 183 aa, Triticum aestivum
  misc_feature (123)..(123): Xaa can be any naturally occurring amino acid
AAASTVHKNGRFSGEAFVVFPSSMQAEFALHRNRQNMGRRYVEVFRCKKQDYYSAIAAEVNQGGPLLEPEHRHSSPPLRSRRLSEDKSSMEYTEVLKLRGLPYSATIEDIIKFFCGVRAVGGXVHIAYRGDGKATGEAFVEFPTAEVAKTAMCKDKMTIGTRYVELFPSTPEEASRAKPRGRQ

SEQ ID NO: 5834 - protein, 159 aa, Triticum aestivum
MLARPPPMSSRRVAVIGAGAAGLVAARELRREGHVPVVLERAAAIGGTWRYDAGVDAHSSVYASLRVNSSRECMGFLDFPFVAGTEGDPRRFPGHGEVLRYLEAFALRFDLHELVRLQTEVVSVRRRVHNAGVAGWSVSYCSTKLAGVGNEVEEEVFDS

SEQ ID NO: 5835 - protein, 194 aa, Triticum aestivum
  misc_feature (132)..(132): Xaa can be any naturally occurring amino acid
MATNIYCSRSDVHPQRITYCTEPPNPPLAGVPARSKQATMDGSKLKKVAGKKFGGPRKKSVTKSIKAGLQFPVGRIGRYLKKGRYAQRVGSGAPVYLAAVLEYLAAEVLELAGNAAKDNKKTRIVPRHLLLXAIRNDQELGRLLSGVTIAHGGVIPNINPVLLPKKAAEKAEKAGTAAKSPKKATKSPKKATKA

SEQ ID NO: 5836 - protein, 154 aa, Triticum aestivum
MDGSKAKKVAAKKFGGPRKKSVTKSIKAGLQFPVGRIGRYLKKGRYAQRVGSGAPVYLAAVLEYLAAEVLELAGNAAKDNKKTRIVPRHLLLAIRNDQELGRLLSGVTIAHGGVIPNINPVLLPKKAAEKAEKAGTAAKSPKKATKSPKKATKA

SEQ ID NO: 5837 - protein, 154 aa, Triticum aestivum
MDAGKLKKVAGKKFGGPRKKSVTRSVKAGLQFPVGRIGRFLKKGRYAQRVGSGAPVYLAAVLEYLAAEVLELAGNAAKDNKKSRIVPRHLLLAIRNDQELGRLLSGVTIAHGGVIPNINPVLLPKKAAEKAEKAGTAAKSPKKATKSPKKATKA

SEQ ID NO: 5838 - protein, 496 aa, Triticum aestivum
  misc_feature (79)..(79): Xaa can be any naturally occurring amino acid
  misc_feature (90)..(90): Xaa can be any naturally occurring amino acid
  misc_feature (293)..(293): Xaa can be any naturally occurring amino acid
  misc_feature (325)..(325): Xaa can be any naturally occurring amino acid
MASLADDGFSAARLFSQGVSYTYDDVIFLPGFIDFPADAVDLSTRLSRRVPLSIPCVASPMDTVPEAAMAAAIGSLGGXAVVHSNTEPRXQASIVRAAKSRRLPFVSSVPIFSPASAPTLNDFAGHDYALGTGQGYSHSMLLGVAVASNAASLEAPAPVSEYMRPAPRSASASFDFEQAAAFLADEGMDYAPLLSEDGEVIDLITSKDVERIRSYPKLGKPSLGADGKLVVAASIGTREDDKLRLEQLIQAGANDSVIDCSQGNSTCLLYLCLRAASQLVRVGGAIDLPLPLXGCNIIIFPPWPWLKTFGHRNGCNNKSDVSVCXKKKTCPGGRASYAKDHNVPVIADGGISYSGHIVKALSLGASTVMMGSFLAGSHEAPGAYEYKDGHRVKKYRGMGSLEAMTKGSDARYLGDTLKLKVAQGVVGAVADKGSVLRFIPYTMQAVKQGFQDLGASSLQSAHDLLRAETLRLEVRTGAAQVEGGIHGLVSYEKKSF

SEQ ID NO: 5839 - protein, 368 aa, Triticum aestivum
  misc_feature (147)..(147): Xaa can be any naturally occurring amino acid
ARSNDFKGLYGYKVFVSISLILGDGIYNLVKIIYSTIKETMNARSNQGRLPLVWVQEGDKISKLPAKEKLLNEVFVKDNIPPWLAASAYVGLAAISTAIVPIMFSQLKWYLVLSAYVVAPLLAFCNSYDTGLTNWSLASTYGKIGLXFIFASWVGQRGGVIAGLAACGVMMSIVSTAADLMQDFKTGYLTLSSPRSMFVSQLIGTALGCVIAPLTFWLYWSAFDVGNPDGMFKAPYAVIFREMAILGVEGFSALPQHCLAICSFFFFAAIAINLLRDVTPDSVSKFIPLPMAMAVPFYIGAYFAIDMFVGTVILFVWEKINRKESEDFAGAVASGLICGDGIWSVPSAILSIMRIDPPMCMYFKPSLA

SEQ ID NO: 5840 - protein, 166 aa, Triticum aestivum
WTRGFLSCFCLSPSSSLTPPPSHSQVTASPVCYLLGELGAEERRRPTQRRRRAKAARQQGALRLKSSDSDSDIVPLVDYLNTQYYGVIGLGTPPQNFTVIFDTGSSNLWVPSSKCYFSIACYLHPKYKSSKSSTYKADGEICKITYGSGAISGFFSNDNVLAGDLV

SEQ ID NO: 5841 - protein, 498 aa, Triticum aestivum
MGQRLLLLVTTCLWALSCAVPHHASSLDGLLRINLNKRSLTYESLAAAKAARQHGALRLKSSDLDSDIVPLVDYLNTQYYGVIGLGTPPQNFTVIFDTGSSNLWVPSSKCYFSIACYLHAKYKSSKSSTYKADGETCKITYGSGAISGFFSNDNVLVGDLVVKNQKFIETTRETSVSFIVGKFDGILGLGYPDISVGEAPPVWLSMQEQKLLADDVFSFWLNRDSDALSGGELVFGGMDPDHYKENHTYVPVSRKGYWQFNMGDLLIDGHSTGFCAKGCAAIVDSGTSLLAGPTAIVAQVNHAIGAEGIISMECKEVVSQYGEMILELLIAQTQPQKVCSQIGLCLFDGTHSVSNGIESVVGKENVGSDVMCTACEMAVVWIENQLRENKTKELILQYANQLCERLPSPNGESTVSCHEMSKMPNLAFTIANKTFVLTPEQYVVKLEQSGQTVCISGFMAFDIPPPRGPLWILGDVFMGAYHTVFDFGKDRIGFAESA

SEQ ID NO: 5842 - protein, 169 aa, Triticum aestivum
  misc_feature (70)..(70): Xaa can be any naturally occurring amino acid
MAALPLATAEACDANSHMITSGELRALQPVFRIYGGRRLFAGPVVTVKVFEDNVLVRGILEEKDEGRVLXVVDRGGSLRRALLGGNIAMLAQNNGWAGIMINGCVRDVDEINECDIGVRALGSHPMKSDKRGVGEKHAPVTVAGARICDGECLYANADGILVSKTELSV

SEQ ID NO: 5843 - protein, 169 aa, Triticum aestivum
  misc_feature (80)..(80): Xaa can be any naturally occurring amino acid
  misc_feature (113)..(113): Xaa can be any naturally occurring amino acid
MAALPLATAEACDANARMITSGELRALQPVFRMYGGRRLFAGPVVTVKVFEDNVLVRGILEEKGEGRVLVVDGGGSLPAXALLGGNIAMLAQNNGWAGIVINGCVRDVDEITXCDIGVRALGSHPMKSDKRGVGEKHAPVTVAGARICDGECLYANADGILVSKTELSV

SEQ ID NO: 5844 - protein, 169 aa, Triticum aestivum
  misc_feature (83)..(83): Xaa can be any naturally occurring amino acid
MAALPLATAEACDANSHMITSGELRALQPVFRVYGGRRLFAGPVVTVKVFEDNVLVRGILEEKGQGRVLVVDGGGSLRRALLXGGNIAMLAQNNGWAGIVINGCVRDVDEINGCDIGVRALGSHPIKSDKRGMGEKHVPVTVAGARICDGEWLYADADGVLVSRTELSV

SEQ ID NO: 5845 - protein, 447 aa, Triticum aestivum
MPLYCTPQEMIALLCWHKIALLRSHICIPYWTANRWRWSMNTSKLTSSVNITSPPGALVPNSATELKSSFLPKKAEWGATRQAAAPKPMTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAEASENMFVKNYSY

SEQ ID NO: 5846 - protein, 389 aa, Triticum aestivum
  misc_feature (109)..(109): Xaa can be any naturally occurring amino acid
  misc_feature (377)..(377): Xaa can be any naturally occurring amino acid
MASATLLKSSFLPKKAEWGTTRQAAAPKPMTVSMVVRASAYADELVKTAKTIASPGRGILAMDESNATCGKRLASIGLENTEANRQAYRTLLVTPPGLGNYISGAILFXRETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAXAKENMFVKNYSY

SEQ ID NO: 5847 - protein, 90 aa, Triticum aestivum
  misc_feature (60)..(60): Xaa can be any naturally occurring amino acid
LGLTNPTHDAKVKELLVSVCNGAVETLVKTSHQVISKANSKLDNNANGNSNGSGTGSSRXGKGWVETVSSTLAVPSNRNFVLDVTGRGDI

SEQ ID NO: 5848 - protein, 317 aa, Triticum aestivum
  misc_feature (244)..(244): Xaa can be any naturally occurring amino acid
MLPWIFSRKGASGFSWASTADQVTAGISAAGLTAIVTGASSGIGAETARVLAARGAHVVMAVGNLAAAEAVRQAVLAETPGGSVEVMELDLSSLASVRNFAADFAATGLPLNILVNNAGVMATPFSLSKDGIEMQFATNHVGHFLLTNLLLETMKKTSRESNVEGRIVNVSSDGHRFAYKEGIRFAKLNDEEEYSTIAAYGQSKLANILHANELAKTFKEEGDNITANSLHPGAIITNLLRHHXSIIDALHRTLGKLVLKNAKQGAATQCYVALHPDAKGVSGKYWCDSNLYEPSDKAKDAELGKKLWDYTLDLVAA

SEQ ID NO: 5849 - protein, 418 aa, Triticum aestivum
  misc_feature (210)..(210): Xaa can be any naturally occurring amino acid
  misc_feature (214)..(219): Xaa can be any naturally occurring amino acid
  misc_feature (271)..(271): Xaa can be any naturally occurring amino acid
MADQSPAPIRCKAAVSRAKGAPLVIEDIVVDPPKAYEIRMKVICTSLCHTDITFWRGKEDFPLPPVFPRILGHEAYGVVESVGERVEGFAVGDTVVPTFLGQCDSCAGCASAGSNMCSALPFVVGPGMRRDGTTRFRDSQGEPLHDFLAVSSFSQYTVVDVNQVVKVDPAVPPKLACLLGCGAGTGVGAAWRLAKVQPGSSVVIFGLVLXTIKXXXXXXQGAKMCGAAKIIGVDLNPDKEELGKSSFLRGTRHGENIWLISKCYLLVLQAXKFGVTDFVNPSKLGESPLSQVIIEMTGGGADYCFECIGVASVMTEAFRSAKQGNGKTVILGLEKDGKPISLPSIEFLFGKCVMGSLFGGIKPKTDIPILAKKFMIKELELEKLITHEVGLQEINTAFDLLLQGKSLRCIIWMDKLAA

SEQ ID NO: 5850 - protein, 377 aa, Triticum aestivum
MAPTATATAAAAEQSQQHTKKAVGLAALDASGHLSPLAITRRSTGDDDVVIKILYCGICHSDLHSIKNDWKNAKYPMIPGHEIAGEVTEAGKNVTKFKAGDRVGVGCMVNSCQSCESCDKGFENHCPGMIFTYNRVDRDGTLTYGGYSSMVVVHERFVVRFPDAMPLDKGAPLLCAGITVYTPMKYHGLNAPGMHLGVLGLGGLGHVAVKFGKAFGMKVTVISSSPGKKQEALERLGADGFVVSKNADEMKAAMSTMDGIINTVSANIPMAPLFGLLKPNGKMVMVGLPEKPIEVPPFALVAKNKTLAGSFIGGMRDTQEMLDLAAKHGVTADIEVIGAEYVNTAMERLAKADVRYRFVIDIGNTLDKAAAAATTTE

SEQ ID NO: 5851 - protein, 176 aa, Triticum aestivum
PRVRSTVFDVGGVLGGVLAGHISDRLNARAITAASFMYCATPALFLYRTYGSMSMRSNICLMFITGMFVNGPYALITTAVSADLGTHSSLNGNSRALATVTAIIDGTGSVGAAIGPLLTGYISTESWSAVFTMLMAAALLAGLLLTHLVCAELRGKLSSNVSKVVANAQTTCSDQV

SEQ ID NO: 5852 - protein, 431 aa, Triticum aestivum
  misc_feature (238)..(238): Xaa can be any naturally occurring amino acid
MAHFQGQQHGHPATRVDEYGNPVPAGHGVTGTEGLGHFPGQAQQHGHNTTRLDEYGNPVTAGHGVGLGSTGTGVHGGYGSAGTGTHDTGGHGRQVGYGATGTGTHDAGGFGGSGIAPRHDTTGTGLHDAGGLGTRHAATGTHGTGHTAGLGGTGTGMTGTHGAGHTAGLGGTGTGMTGTHGAGHTAGLGGTGTGMTGTHGTGHTAGLGGTGTGITGTHGTGHTAGYDATGTHGTGHTXAGYGATGTGITGTHGAAGTHPHGGVAEQKTRGILHRSGSSSSSSSSSEDDGMGGRRKKGMKQKIKEKLPGGNKEQTTAAGGYGPGYTGTTGTGGPGYTGTTGTGGAYGATEGTHEKKGVMEKIKQKLPGGHKDTQPHTTATGGYGPGTTGTTGTGGYGTGTTGTAGTHGATEGTHEKKGMMEKIKEKLPGGHH

SEQ ID NO: 5853 - protein, 385 aa, Triticum aestivum
  misc_feature (89)..(89): Xaa can be any naturally occurring amino acid
  misc_feature (113)..(113): Xaa can be any naturally occurring amino acid
  misc_feature (149)..(149): Xaa can be any naturally occurring amino acid
MAHFQGQQHGHPATRVDEYGNPVPAGHGVTGTEGLGHFPGQAQQHGHNTTRLDEYGNPVTAGHGVGLGSTGTGVHGGYGSAGTGTHDTXGGHGRQVGFGATGTGTHDAGGVWXASGIAPRRDTTGTGLHDAGGLGTRHAATGTHGTGHXMTGTHGTGHTAGLGGTGTGITGTHGTGHTAGYDATGTHGTGHTAGYGATGTGITGTHGAAGTHPHGGVAEQKTRGILHRSGSSSSSSSSSEDDGMGGRRKKGMKQKIKEKLPGGNKEQTTAAGGYGPGYTGTTGTGGPGYTGTTGTGGAYGATEGTHEKKGVMEKIKQKLPGGHKDTQPHTTATGGYGPGTTGTTGTGGYGTGTTGTAGTHGATEGTHEKKGMMEKIKEKLPGGHH

SEQ ID NO: 5854 - protein, 472 aa, Triticum aestivum
  misc_feature (224)..(224): Xaa can be any naturally occurring amino acid
  misc_feature (316)..(316): Xaa can be any naturally occurring amino acid
  misc_feature (346)..(346): Xaa can be any naturally occurring amino acid
ARRIHVKLEIKGIRFWHPWGGCVTRLLGYLESSNHVFMEKLQQASNKTKQMRLNDVWIRPPFGGRGRKLTGTLEAHVNGFRYSTSRADERVDIMYGNIKHAFFQPAEKEMITLLHFHLHNHIMVGNKKTKDVQFYVEVMDVVQTVGGSRRSALDPDEIEEEQRERDRKNRINMEFQNYINKVNDHWSQPQFEGLDVEYEIPLRELGFHGVPYKASAFIIPTSTXSVEWIETPFLVVTLGEIEIVNLERVGFGTKNFDMAIVFKDFKKDVLRIDSIPSTSLDAIKEWLDTTDLKYYESRLNLNWRPILKTIIDDPVXFWDDGGWEFLNMEASDSDTRFCSSFARRIXPSDAEPESESVCCYYLACVTESQDVVVVGVSAGGSVGGVGVAGVLLGREATNADRDHGAESDSEEERRRRKVKTFSKSGAPPQRGGPSSSKHAPLPQRGGSSSGNKSRPPPISSKGGPPSKKPKFR

SEQ ID NO: 5855 - protein, 197 aa, Triticum aestivum
  misc_feature (80)..(80): Xaa can be any naturally occurring amino acid
  misc_feature (101)..(101): Xaa can be any naturally occurring amino acid
TENMLLDKTRTVKIADFGVARVEASNPSDMTGETGTLGYMAPEVLNGHPYNRKCDVYSFGICLWEIYCCDMPYPDLSFSXEVTSAVVRQNLRPEIPRCCPXSALANVMNRCWDANPDKRPEMAEVVAMIEATDTSKGGGLSPRHPSLAPVPCSRPDPGPRPPGLTPSPPDLIPLCSSPPLPMSGTANLADARFPASP

SEQ ID NO: 5856 - protein, 189 aa, Triticum aestivum
MMSSKKLAQLSKKWQGISAIGRRRVTTTDKDVHPSCSSVAGKGHFVVYSSDGRRFEIPIACLRTMIFEELLRMSQEEFGFTSEGRITLPCDTTMMEYVMCLLRREASEDVERALLSSIITTCHHPSRMMQAATGLHQQFSVRSSSRVNVSRFFFLFSCSIFFPGCTFGAHLLCNVFPRVPYCGCTDGCM

SEQ ID NO: 5857 - protein, 181 aa, Triticum aestivum
MSASVLDYTKALEVLKEYKQRDGLDIHELMDTTKHGGLTYNDFLLLPGYIGFAASEVTLDSPITKRITLRTPFVSSPMDTVTEHEMAIHMALQGGLGVIHHNCSPEAQADMVRKVKRYENGFINDPIVIDQNTTVGEAKALKEKWGFGGFPVTEDGKLGSKLVGIVTNRDLQFEEDLDQAV

SEQ ID NO: 5858 - protein, 366 aa, Triticum aestivum
  misc_feature (244)..(244): Xaa can be any naturally occurring amino acid
PPPTCDLAHGRWVFDNESLPLYREKECNFLTKQLTCLANGRNDDLWQYWQWQPNNCSLPTFDARRFMERMRGKRLMFVGDSLNRNQFYSLVCMVQSILSKGRKKVVKRGSNTIFHAKEYRATLEFYWAPFLVESNSDDPNIHSIEHRIIRPERIEGHAQYWRGVDYLIFDTYIWWMNTADIKVRRPDSRSWSEHDEVPRIEAYGRVLKTWSDWLNENIDPARTSVFFMTISPIHISPDKWGNPXGIKCAKETLPVLNYTEPLDLNHDMRLYDMVASTARSMKKVPVTLIDITRMSDYRKDAHTSVYSVRRGYLLTPKQKNDPEKFADCIHWCLPGVPDVWNTVLYTRIFSKSPPSSPPALALPPPQ

SEQ ID NO: 5859 - protein, 599 aa, Triticum aestivum
  misc_feature (285)..(285): Xaa can be any naturally occurring amino acid
  misc_feature (294)..(294): Xaa can be any naturally occurring amino acid
RRKTRSQWDAPPMPLHAVSLLMEAIYLKARALHVRGTFKDAAQECRMILDIVEAAVPEGLPAGFGKGCKLNEIICKAVEFLPELWKLAGFSLEAISEYRRSLLNNWNLDGETIAKIQKEFAVFLLYSGCEARPPNLHSQLDGSFVPRNNMEEATLLLMILLRKFNLRRVERDPTVMHHLTFALSISGQLKPLAVQFEELLPGLLDKREWSYNVALCYLAEKDDSTALNLLKRMLKFGQDSDNLKELLLASKVCVEKGAHAEGAAYARRAITNIQGGCKQLAGVAXFCLGVSLSXSARYAISDTERASWQCEALEVLGSAEKNMHGQDCRIMYNLSLENAEQRKLDAAVFYAKKLVKLEAGSELRSWLLLARILSAQKLFTDAETVVDAALDQTGKWNQGDLLRTKARIQAAQGQLRDAVGTYTQLLALIQLRTKSFGAGISLAKGGEDDKSLETETWYDLALLYLGMSQWRDAEVCVSKIRATNCYSAFAWHATGKLCEAKDLPKEALGAYFRALDFDSKHVPSLISSATILRQLGDRPLPSVRCFLTDALQLDRTNHMAWFNLGLLYKEEGGRSAAEAAECFQAAALLEETAPVEPFR

SEQ ID NO: 5860 - protein, 65 aa, Triticum aestivum
AVVPGIRRRTSVQVLPLVSTLWGVLLFGEYRRSSRRTYTLLGSMLFMFVVAMAVLMASSAHRKPL

SEQ ID NO: 5861 - protein, 257 aa, Triticum aestivum
  misc_feature (203)..(203): Xaa can be any naturally occurring amino acid
LFTRPPTRPPTRPSTRPPTRPPTRPRTRGFMAGSFRANPYETCTTSQQYKHLAYVISFLPYYWRAMQCLRRYIEEHDINQLANAGKYVSAMVAAAVRFKYNVTPTPFWMWMVLISSSGATVYQLYWDFVKDWGFFTPKSKNLWLRDDLILKNKFTYYISMMLNLVLRLAWAQSVMKIRINKNETRLLDFSLASLEIIRRGHWXNFYRLENEHLNNVGKFRAVKTSTFRELETDDDKTREECTRPIQGIRSKSRMVTL

SEQ ID NO: 5862 - protein, 100 aa, Triticum aestivum
PVSADLGTHSSLNGNLGALAPVTAIIDGTGSIGAAVGPLLTGYISAKSWSGVFPMLMASALVPGLLLSRLVVAEIPAKMAASQRPVDSAGDLPVSSLEVP

SEQ ID NO: 5863 - protein, 414 aa, Triticum aestivum
RKSIAFLRYEAPVPGPKPGQCDVAWRFRNRREKSWRRYRDYRRFELAPGDGCALDITKVGKFRSGKNAARPPRPKGPKKPRVAPPPVDAEINDTIPLVGSEAEFRRGKYLYYMRGGDHCKSMNQFIWSFLCGLGEAKFLNRTFVMDLNMCLSGAHTEDGKDVDGKDFRYYFDFEHLKESVSLVEEGDFLKDWRRWDKKKGPGRISVRKVPTYKVTPMQLKRDKSNIIWRQFDGHEPENYWYRVCEGRAAKVIQRPWYAIWKSKRLMNIVTEIAGRMDWDYDGLHVVRGWKAMNKKMYPNLDADTSPDAIVDKVTKLIKPWRNLYIATNEPFYNYFDKLRSHYHVHLLEDYKELWSNTSEWYNETTAINSGKDVPFDAYMKVIVDTEVFYRSKAKVETFNNLTRDCKDGINTCNL

SEQ ID NO: 5864 - protein, 156 aa, Triticum aestivum
MDASATGAGAKAKKGAAGRKAGGPRKKSVARSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKAAKSPKKADKKA

SEQ ID NO: 5865 - protein, 202 aa, Triticum aestivum
MAANAGAGAGGSKIRNAKLVLLGDVGTGKSSLVLRFVKGQFVEFQESTIGAAFFSQTLAVSDETVKFEIWDTAGQERYHSLAPMYYRGAAAAIIVYDITNAASFTRAKKWVQELQAQGNPNTVMALAGNKADMLEARQVPVEEATTYAQENGLFFIETSAKTAINVNDVFYELAKRLLAGQQTQNPQGGDGAFPKKRAEKDW

SEQ ID NO: 5866 - protein, 209 aa, Triticum aestivum
MAANAGAGAGGSKIRNAKLVLLGDVGTGKSSLVLRFVKGQFVEFQESTIGAAFFSQTLAVNDETVKFEIWDTAGQERYHSLAPMYYRGAAAAIVVYDITNAASFTRAKKWVQELQAQGNPNTVMALAGNKADMLEARQVPVEEATTYAQGNGLFFIETSAKTAINVNDVFYELAKRLLAGQQAQNPQAGMVLSQRPAERMVSSTSCCSS

SEQ ID NO: 5867 - protein, 322 aa, Triticum aestivum
  misc_feature (61)..(61): Xaa can be any naturally occurring amino acid
KAGASVKKIPLYQHIANLAGNKQLVLPVPAFNVINGGSHAGNKLAMQEFMILPTGAASFKXEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 5868 - protein, 513 aa, Triticum aestivum
  misc_feature (97)..(97): Xaa can be any naturally occurring amino acid
  misc_feature (189)..(189): Xaa can be any naturally occurring amino acid
  misc_feature (207)..(207): Xaa can be any naturally occurring amino acid
  misc_feature (226)..(226): Xaa can be any naturally occurring amino acid
  misc_feature (265)..(265): Xaa can be any naturally occurring amino acid
  misc_feature (294)..(294): Xaa can be any naturally occurring amino acid
  misc_feature (343)..(343): Xaa can be any naturally occurring amino acid
WYFTCAREGSHLSYTSQVISQSRTRVRTRTPLALRSIWSDSIRFDLGFLSKPRDARPELRPWRRTIQSVKARQIFDSRGNPTVEVDVCCSDGTFARXAAVPSGASTGVYEALELRDGGSDYLGKGVSKAVDNVNSIIAPALIGKDPTAQTELDNFMVQQLDGTKNEWGWCKQKLGANAILAVSLAVCKXAGASVKKIPLYQHIANLXAGNKQLVLPVPAFNVINGXGPMLGNKLAMQEFMILPTGAASFKEAMKMGVEVYQQLEXSLLKKKYGQDATNVGDEGGFAPNIQENKXGLELLKTAIEKAGYTGKVVIGMDVAASEFYNDKDKTYDLNFKEENNDGXSQKISGDSLKNVYKSFVSEYPIVSIEDPFDQDDWVHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 5869 - protein, 463 aa, Triticum aestivum
  misc_feature (158)..(158): Xaa can be any naturally occurring amino acid
MAATIQSVKARQIFDSRGNPTVEVDVCCSDGTFARAAVPSGASTGVYEALELRDGGSDYLGKGVSKAVDNVNSIIAPALIGKDPTAQTELDNYMVQQLDGTKNEWGWCKQKLGANAILAVSLAVCKAGASVKKIPLYQHIANLAGNKQLVLPVPAFNXSSMGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGEQVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPGGAILDGTCIRDMITLHLFL

SEQ ID NO: 5870 - protein, 300 aa, Triticum aestivum
MLPSTFQDKMKEEEALKRKLKARMEYAKFLQEPAKEMAKEVKASYSGETKQTAGDLDEFLNKDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 5871 - protein, 260 aa, Triticum aestivum
  misc_feature (183)..(183): Xaa can be any naturally occurring amino acid
  misc_feature (192)..(192): Xaa can be any naturally occurring amino acid
  misc_feature (209)..(209): Xaa can be any naturally occurring amino acid
MWRRAGPILGLCGIAGRRVRRPPQPPAPTATCSTSAFASSSFHHNLGTFRDSIGVPPSRSLSNQAGGDGGIGGECWSCGAKGAFLSCGSCRSVQPVDPAVDYFRIFGLDRGYDVKDTNLEGKYKDWQKKLHPDLVHSKSEKERDFAAGQSALVIEAYRTLSKPLPRALYLLQLEGIHVDEEKXINDPELLMXMMEIREAVSEAGDSETXKKIQSQMKRKLETWSKAFQEAFDKRDFDGAVEATQRMRYYERAMEETVKKL

SEQ ID NO: 5872 - protein, 447 aa, Triticum aestivum
MAASVREGAAAAAAAGHAADDYDVSDGEMDVDVEAGSELQRAGDDRRDGDGDGDDEYALLTRITDTSAAEARAGKDIQGIPWERLQITRQDYRKARLEQYKNYENFPQSGELMDKLCKQVESSSKYYEFQYNTRIVKPSILHFQLRNLLWATSKHDVYFMSNSTVGHWSSLSHKMTDVLDFSGHVAPAKKHPGCALEGFTGVQVSTLAVNEGLLVAGGLQGELVCKSLGERDVKFCTRTTLSDNAITNAMDIHRSTSGSLRITVSNNDSGVREFDMERFQLLNHFRFNWPVNHTSVSPDKKLLAVVGDDRDALLVDSRNGKVTSTLVGHLDYSFASAWHPDGVTFATGNQDKTCRVWDIRNPSTSLAVLRGNIGAIRCIRYSSDGRFLLFSEPADFVHVYSAAECYRKRQEIDFFGEISGISLSPDDESLFVGVCDRVYASLLNYRM

SEQ ID NO: 5873 - protein, 131 aa, Triticum aestivum
MARKGVSYVTAAQLVSMARDPRVAIIDVRDEERICDAHIAGSHHYASDGFADRLPEIAEATRAKETLVFHCALSQVRGPSCARMFLDYLSEAKEESAVKSITVLERGFNGWELSGRAVCRCKDAPCKGVCS

SEQ ID NO: 5874 - protein, 605 aa, Triticum aestivum
MTQGPTSLLPVWARTTARRPSSRRQSLHATTAEAMDGEDAHHRPSSSSSSGGPFLSGLCAAALRRKPISARASAAASGEGLVRQLGVLELVLLGIGASIGAGIFVITGTGARDAGPGVTISFALAGAACVLNALCYAELASRFPAVVGGAYLYTYAAFNELTAFLVFTQLMLDYHIGAASIARSLASYFIQFLELIPSVKGNVPSWIGHGEEFFGGVVSVNILAPILLVILTVILCRGVKESSAVNTFMTTLKIIIVIVVVFAGVFEVDVSNWSPFMPNGFKAVVTGSTVVFFAYVGFDAVANSAEEAKNPQRDLPIGILGSLLACVILYVAVCLVITGMLPYTLLGEDAPLAEAFSAKGLKFVTVLISIGAVAGLTTTLLVGLYVQSRLYLGLGRDGLLPSIFSKVHPTLHTPLHSQIWVGCVAAVLAGLFNVHALSHILSVGTLTGYSVVSACVITLRWSDKATNSRSLGKFSIWQEGVFCLVIVALCGFIAGISYRFSYSIAFIIIAFLIATVGSFSLLFRQVYVPVDPPRFSCPGVPMVPIVSVFFNMFLFAQLHEEAWYRFVILSLIAVGVYAGYGQYNAVPSTSDHSSVAYHGVPSEAP

SEQ ID NO: 5875 - protein, 157 aa, Triticum aestivum
IKNTLFSPFGLGRSKLSSLTMPWVTYTDPEIAHVGLNETMAEALDIGYKIIKIPFSQVDRAIAADETEGFLKIIHVANSDEILGATIVASHAGEMISEITTAIVNKIGLSKLAGVIHPYPTQAEAIKKAADTYRRTLLTNNTKNLLKLLTKFPSKLF

SEQ ID NO: 5876 - protein, 443 aa, Triticum aestivum
LYISPPNAKRFQLPDGRHLAYEEKGISADRARFSLVAPHSFLSSRLAGIPGISSSLLEEFGARLVTYDLPGFGESDPHPGRNLNSSALDMLHLADALGIVDKFWVVGYSGGGMHAWSALRYIPDRVAGAAMFAPMANPYDSKMTKDEKRKIWDRWSTKRKLMHILARRFPSLLRLFYHRSFLSGKQGQPESWLSLSMGKKDKTLLEAPTFNTFWEKDVAESVRQGDAQPFVEEAVLQVSDWGFSLSDIQMQKKEDQGVFEFMKSLFSQAEREWGGFLGPIHIWQGMDDRVVPPSVTEFARRMVPGATVHKLLDEGHFSYFCFCDACCHRQIFSTLFGTPRGGLQRGGAGSGGGPEPGEERSRGRAGAGAGRAGVTMFSLRIMRAGGRGEQIQEYKKTERRGRLIETMGPAEQGGRGGRPAERGEEKTTQRGGGWGGGGSAGGG

SEQ ID NO: 5877 - protein, 159 aa, Triticum aestivum
SIVWFYIIANELVALLVAFGVILGINPSILGLTVLAWGNSMGDLMSNVALAMNGGDGVQIAMSGCYAGPMFNTLAGLGISMLLGAWSTAPNSYVLPQDPSLIYTMSFLVAGLIWALVTLPRSGMRPNKTLGVGLIVLYSVFLFIRVSSAMGILPLPGLN

SEQ ID NO: 5878 - protein, 458 aa, Triticum aestivum
  misc_feature (264)..(264): Xaa can be any naturally occurring amino acid
FVGLSGAVYTQLYLAFYGDDTKSLILLIAWLPAAISVVFVHTIRIMPYPRRRGGQETSGDPFFCFLYISIALACYLLVMIVVQKQFTFSHGAYSIAAAALLIVLFLPLCVVIKQEYKIYRERELEAALLANDPPPTITVAGEPAQVEMSTGAKAEQQASSEQPPPSSCSFGGCVKNMFRPPARGEDYTILQALVSVDMLVLFVATICGVGGTLTAIDNMGQIGQSLGYPAKSINTFVSLISIWNYAGRVTSGFASEVLLERYKXPRTLMLTGVLLLACAGHVLIALGVPQSLYVASVIIGFCFGAQWPLVFAIISEVFGLKYYSTLYNFGGMASPVGSYILNVLVAGRLYDAEADKQPGGGFSAGGGRDKVCLGVECFKRSFLIITAATVFGALVSLVLVWRTWSFYKGDIYARFRDGAGERHDGRLPVGQGRKPEAEESTPGQCHSTKVRTQKALQA

SEQ ID NO: 5879 - protein, 200 aa, Triticum aestivum
MTTACIASLTRCQRSMPANPLFFLSCHSPHRLRSPQRNPGDPRRLLPGASGKMAEHLFEDIFHVTRIDPDGKKFDRVNRIEARSEQLEMYMQLDIATDVYPMHMGDKFTMVLAPTLNLDGTPDTGYYTQAGRKTLADKYDYVMHGKLYKISEDNSSKDKGPTKVEIYASFGGLLMLLKGDPSSAANLELDQRLFLLIRKV

SEQ ID NO: 5880 - protein, 278 aa, Triticum aestivum
MAAASFGLMDKAYFVGRGEILSWVNATLQLSLNKVEEAASGAVQCQLLDMVHPGSVPMHKVNFDAKTEYDMIQNYKILQDVFNKLRIGKNIEVNKLVKGRPLDNLEFLQWLKRYCDSVNGGIMNENYNPVERRSKGCKERTHKGPNKSSKSLQANRLSSANSADGGALNSNTDLASPVGKVCNAVNEEHYMEQIQQLSEKIADLKVAVDNTEKERDFYFSKLRDIEILCQRPELEHLPMTKGIRKILYAADAKDSSLPEANEIITRSPGMFSVSDEAE

SEQ ID NO: 5881 - protein, 344 aa, Triticum aestivum
MGTRHLITGQNNCAPDGASSSNPFGALANTLLGQSNKAESLRGLPGASVNVPTTSDYSGAPLSTLPGSENEFKQDQRPFAWGADFSRGGPANDWVESFRPPGHSAFGGPEANFAEFEQIYNNAGPTLGPALDGPPQRVLSGVLHSFILSGRAGVPFQAVPVPALGLSEADKQCIRDRSFIMAHHILADQPEEYIQAQVNTLLHSLDIDNSDRMTDPRHGPYPEMEEYWNQSQSALRSGPMHNAANNWITEFGKQNNNPEGWITEFGKQNNNPEGWAHSFEQQYGPNGWASEFEQHQSQMAMDQMGGANMANLAAMQQSRMLAETLSSNNDPKFQNSKFFQFVSK

SEQ ID NO: 5882 - protein, 521 aa, Triticum aestivum
MWAWGLAERAVAGLLGPAGANGGRWNTAVAVGVTAAAGIALVAIVVSSRRGGIKSPWRRRRKPALGPKEWRSLFTPEGKFYDGGVKLLKRVRNGGVEPSIRAEVWPFLLGVYSLNSSEAEREAIKAHNRKGYLLLRKHCLRKNNKESVDDHITSEEENPCVISEQEMQDKTGKAIPENQADESLCSSSSRDEDESEKSDVTDVEASRDDVASVDQSSVEDEEESMPLPKYSNTGGNIETETKLSKVARPVKSARTVEDFETWQRIIRLDAVRANNEWVSYSPSQAAVTREKAIHAAAAVCLKDYEHLEAHRIHHASRLVAILEAYATYDPEIGYCQGMSDLLAPLLAVLEEDDEAFWCFAGFMRKARHNFRLDEVGIRRQLNMVSKIIKTKDFHLYRHLEMLEAADCFFVYRMVVVMFRRELTFEQTLSLWEAMWADQAARRAGITRSSWRKLQLGAPPTDDLLLYAIAASVLEKRKLIIESYSSMDEIIRDCNSMAGQLDIWKLLDDAHDLVVTVQDRIE

SEQ ID NO: 5883 - protein, 187 aa, Triticum aestivum
  misc_feature (173)..(173): Xaa can be any naturally occurring amino acid
KKVLANKLNTWSKLQEHYDAEGKNLVIKELFEKDPQRFEKYHRVFKGSDKTKSSILFDFSKNRVTDETLKLLLELAKEAKVEEMRSKMFTGEHINFTEDRAVLHIALRNLSDRPIYDNGADVMPEVREVLAHMKQFSEAVRSGEWKGYTGKTITDIVNIGIGGSDLGPVMVTXEALKPYAQEGLKGS

SEQ ID NO: 5884 - protein, 160 aa, Triticum aestivum
LWGSCVIDGKCDLSEDSTTIDSQDTKAFSLFGSGVSTDLQTSYAARIMAISVLPFIVVQIPQILKLKSGHRLTLLLGLIVAVLLLLTYCLYQIFQPWIQRRKLEYSKLKHVMSGLLKHAQMHTFGHLIDDDGTPNVSVIEKLFHKIDLDNDGRIGRGELQ

SEQ ID NO: 5885 - protein, 230 aa, Triticum aestivum
ADIIGGTHDGHHLFLQPPVRRRQQHRLPPPPQPACAGRRRHLPEVLRRRPPAPGEGLKIFYNPGTTKLTPNEQFGIAFNGGFNQPIMCGGEPRQMTLQERGKACPPIYTIRIRVPQHAMTLVFSFTNGNEWDGAYTLKFKVPKPWLDKPLSFFNEGLADELNMEGACDRAIFPDENIVITSCDIGGFYEEGGDRCKLDIVSGCMDPTSHMFDPLATIDDGSCPLDSDTEE

SEQ ID NO: 5886 - protein, 193 aa, Triticum aestivum
  misc_feature (63)..(63): Xaa can be any naturally occurring amino acid
  misc_feature (172)..(172): Xaa can be any naturally occurring amino acid
VIHLSATLGAGVEVVVIATGATVARDLPIKGRQLEGIHYAMEFLHKNTKSLLDSELGDNAYVXAKDNHVVVIGGGDTGNDCIGTSLRHGAKSVTNFELLPQPPPERANDNPWPEWPRIYRVDYGHTEVRQHTGKDPREYCIMSEEFMDDGSGKVKGINTIRVEWTKSPSGGXDMKKDKGSQQEFPANLGLLTM

SEQ ID NO: 5887 - protein, 233 aa, Triticum aestivum
SARPRFAESPEAPGLTFAFAKFDGIFGLGYDTISVKHTIPPFYHMVNRDLVDEPLFSFWLNDANKDQENGGELIFGGVDEDHFEGDIHWSDVRRKGYWEITMENIKFGDDYVDIDPVGAAIDTGSSLLVAPTTVAALINKELGAEKNWAGQYTVDCNKVPSMPEFCFVFNGKDFCLEGKDYILEVQGQCISGFMGMDIPEPAGPLWIVGDVFLRKFYSVYDLGNNRVGLAPSK

SEQ ID NO: 5888 - protein, 80 aa, Triticum aestivum
MAPTVMGSKDTYDAPFQGLKSTDGLPVRRRSNGASLGSVSNGGRIRCMQVWPMEGIKKFETLSYLTPLSTEALLKQVEYL

SEQ ID NO: 5889 - protein, 428 aa, Triticum aestivum
MDVAVAKQLRRIRTLGRGASGAVVWLASDEASGELLAVKSAGAGGAAQLEREGSVLTGLCSPHIIPCLGSRAAECGEYQLFLEFAPGGSLADEAARSGGCLPEPAIRAYAGDVARGLEYLHARSLVHGDVKARNVVIGGDGRARLTDFGCARAVDSLLPMGGTPAFMAPEVARVEEQGPASDVWALGCTVVEMATGRAPWSDMNDLLAAVHRIGYTAAVPEVPGCLSAEAKDFLDGCFRRQPSDRSTAAQLLDHPFVASAAAAGDYKAAPAKQQYTSPKSTLQDALWDSDTDDEADEMSATPAERIGALACGNSALPDWNSDDGWIDVCEEVHRVPDSPPADAGYDLVWPEESDAEREPFAVAADDSNDIPRNAVVTDSSIWQDSYVRPVHLGSCRNQFHPFQSDGDENLRFDRRCNKDRVMEFIFLL

SEQ ID NO: 5890 - protein, 292 aa, Triticum aestivum
  misc_feature (104)..(104): Xaa can be any naturally occurring amino acid
  misc_feature (131)..(131): Xaa can be any naturally occurring amino acid
MAKDIEAAPPGGEYGAKDYSDPPPAPLFDAEELTKWSLYRAVIAEFVATLLFLYITVATVIGYKHQADPAGPSAADAACSGVGILGIAWAFGGMIFVLVYCTAXGVSGGHINPAVTFGLFLARKVSLVRAXWLYIIAQCLGAICGVGLVKGFQSAFYVRYGGGANELSSGYSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRASATKLGSSASFGRS

SEQ ID NO: 5891 - protein, 216 aa, Triticum aestivum
MSADELRLDLEELRRLEGLAKRPRVVSLLSNEIRSVDAKLASRAAPVQTPAPRAVAAAAAPAGLSYVTLGSFSWDQDNEKIRVYVFLENVDQEKVETTFKPMSVDIKFHDVKGKNYRCAIPKLNKEIVPEKCKIVVKPTKIVITLWKASSGNWLDLHYKEDKFKPSMDKEKDPMSGIMDLMKGMYEEGDEDMKRTIAKAWSDARSGKTADPMRGLP

SEQ ID NO: 5892 - protein, 240 aa, Triticum aestivum
MAPPPEGERGGGGCRARWLRREVLLALALGQLVSLLITSTGFSSSELARRGINAPTSQSLLNYILLALVYGGILLYRRQPLTTKWYYYLILGIIDVEANYIVVKSYQYTSLTSVMLLDCWSIPCVIVLTWIFLKTKYGFRKFFGVGVCVAGLILVVFSDVHASDRAKGPKPLKGDLLVIVGSMLYACSNVTEEYLVKKNNRIELMAMLGIFGAVISGIQISILEREELHSIKWNAGRGVP

SEQ ID NO: 5893 - protein, 140 aa, Triticum aestivum
GARLAFNIWDVAGDSQSADHVPIACKDAVAILFMFDLTSRCTLNNVTDWYERARKWNKTAIPILIGTKFDDFAQLPLEMQWTIVDEARAYARAMKATLFFSSATHNINVNKIFKFITAKLFNLPWTVERNLTVGEPIIDF

SEQ ID NO: 5894 - protein, 97 aa, Triticum aestivum
  misc_feature (59)..(59): Xaa can be any naturally occurring amino acid
  misc_feature (81)..(81): Xaa can be any naturally occurring amino acid
RHTQPNKPISDLATEKNNSGGWITEFGKENNNPEGWAHSFEQQYGTNGWVFEFEQHQSXIAMDQMGGANIVNLAAMQQSCXLAETLSSNNDPKVQNS

SEQ ID NO: 5895 - protein, 513 aa, Triticum aestivum
  misc_feature (7)..(7): Xaa can be any naturally occurring amino acid
SCTSQAXKYEKGSFITATGALATLSGAKTGRSPRDKRIVKDEAAAQELWWGKGSPNIEMDEHTFLTNRERAVDYLNSLDKVYVNDQFLNWDPENRIKVRIISARAYHSLFMHNMCIRPTEEELESFGTPDFTIYNAGKFPCNRYTHYMTSSTSVDINLGRREMVILGTQYAGEMKKGLFGVMHYLMPKRRILSLHSGCNMGRDGDVALFFGLSGTGKTTLSTDHNRLLIGDDEHCWSDNGVSNIEGGCYAKCIDLSREKEPDIWNAIKFGTVLENVVFDEHTREVDYTDKSVTENTRAAYPIEYIPNAKIPCVGPHPKNVILLACDAFGVLPPVSKLNLAQTMYHFISGYTALVAGTEDGIKEPQATFSACFGAAFIMLHPTKYAAMLAEKMQTYGATGWLVNTGWSGGRYGVGKRIKLPYTRKIIDAIHSGELLTANYQKTEVFGLEIPTAIEGVPSEILDPINTWTDKAAYKETLLKLAGLFGKNFEVFASYKIGEDSTLTEEILAAGPKV

SEQ ID NO: 5896 - protein, 196 aa, Triticum aestivum
MSLSNKLSIRDLDLKNKRVLIRVDFNVPMKDGAITNNNRIVQALPTVKYALDNGASAVILMSHLGRPNGEAVAKYSLKPVAAEVEKLLGQPVEFLNDCVGPDVEKACQSATGGKVILLENLRFHIEEEGSAKVEGQKVKADAEAVKKFRASLTALADIYVNDAFGTAHRAHSSMVGVDLPQRAAGFLMQKELEYFA

SEQ ID NO: 5897 - protein, 430 aa, Triticum aestivum
  misc_feature (110)..(110): Xaa can be any naturally occurring amino acid
  misc_feature (163)..(163): Xaa can be any naturally occurring amino acid
  misc_feature (322)..(322): Xaa can be any naturally occurring amino acid
NELVHQNRWREALDRLLETNNFPEFTGRVCPAPCEGSCVLGIIHPPASIKSIECSIIDKGFEEGWMVPRPPLQRTGKKIAIVGSGPAGLAAADQLNKMGHFVTVFERSDXIGGLMMYGVPNMNTDNIGVVQRRVNLMAEEGVTFVVNANVGSDPLYSIERLRXSENNAVILACGATKPMDLSIPGRELAGVHFAMEFLHANTKSLLDSNLEDGRYISAQGKKVVVIGGGDTGTDCIGTSVRHGCSSIVNLELLTKPPSKRAADNPWPQWPRVFRVDYGHQEASTKFGNDPRTYEVLTKRFIGDENGKLKALEVVRVKWEKVXGRFQFKEIEGSQEIIEADLVLLAMGFLGPEENIADKLGLEKDNRSNFKAQFGHFGTSVDGVFAAGDCRRGQSLVVWAITEGREAAAAVDKYLSRDEQNVARPYIGLWC

SEQ ID NO: 5898 - protein, 158 aa, Triticum aestivum
EIALVGTSSQGSSKIVKFEGARRLAFKHIEAFVLTFSDPQMFSTAASSSGAAALSQVAEALFIQEAGHLRCSRAEIARFVDTLRNPSSVLRACAAFALLQFTMPAGRHAVHHAALLQKAGASRVLRVAAAAATAPIEAKIFARIVLRNLELHQAGPST

SEQ ID NO: 5899 - protein, 371 aa, Triticum aestivum
ESAEALSCRPPYLQAGRARSRSVRPRVLRRRRPAAPEEMPRYDDRYGNARLYVGRLSSRTRSRDLEYLFSKYGRIREVELKRDYAFIEYSDPRDADEARYNLDGRDVDGSRIIVEFAKGVPRGSGGSREREYVGRGPPPGTGRCFNCGIDGHWARDCKAGDWKNKCYRCGERGHIERNCQNSPRSLRRERSYSRSPSPRRGRARSRSYSRSRSYSRSRSRSYSESPRGRRTERDERRSRSISYSRSPRRSLSPGGKEMDRSPTPDRSRSPRRSISPVAKDNGDSPRGRETSRSPSDGYRSPVANGRSPRSPANNGSPSPTRDNRGSPSPRGNNGSPSPKGNGDGGSPSPRGNGDDDGRRGSGSPRGRSVSP

SEQ ID NO: 5900 - protein, 255 aa, Triticum aestivum
  misc_feature (76)..(76): Xaa can be any naturally occurring amino acid
  misc_feature (106)..(106): Xaa can be any naturally occurring amino acid
LLVSRTLSPRPPYLQAGRARSRSVRPRVLRRRRRPPAPEEMPRYDDRYGNARLYVGRLSSRTRSRDLEYLFSKYGXGFSVFNTIRKWKLQDGDAFEYLSPDGLLFXGNRLRRIREVELKRDYAFIEYSDPRDADEARYNLDGRDVDGSRIIVEFAKGVPRGSGGSREREYVGRGPPPGTGRCFNCGIDGHWARDCKAGDWKNKCYRCGERGHIERNCQNSPRSLRRERSYSRSPSPRRGRARSRSYSRSRCYSRS

SEQ ID NO: 5901 - protein, 400 aa, Triticum aestivum
MVKAKLLAVLALVAVAAPFLRAAGQEEGEGGARPSELLPFAVGAAPAGCDVGQGEWVYDEAAAPAYDEEACPYIPAELTCQAHGRPDKSYQHWRWQPRGCSLPSFNATVMLEMLRGKRMLFVGDSLNRAQYVSLLCLLHRAMPEGSTSFETVDALSIFRAKAYDATIEFYWAPLLAESNADDGVEHQLNDRVIRGAPMDRHSRFWKGADVLVFNSSLWWMTGDKIQILRGADNDMSKDIVEMGAEEAYRLVLHQVVRWLDGNVDPKKSRVFFVTASPTHASGQLWGDEAEGSNCHGQTKPIADASYWGSTSRAMLRVTGEVLAASARVPVGVVNVTQMSEYRRDAHTQVYREQWAPPTKEQLADPKSYADCTHWCLPGVPDAWNELLYWKLFFPANDQAL

SEQ ID NO: 5902 - protein, 219 aa, Triticum aestivum
RSPGRPTRPPTRPRTRGVKFGHVTFFWNGNRSGYFNPNLERYEEIPSDTGIPFNVQPRMKAVEVAEKARDAILSGKFDQVRVNIPNADMVGHTGDLEATIVGCKAADEAVKIILDAIEQVGGIFVVTADHGNAEDMVKRDKSGKPIRDKDGNVQPLTSHTLNPVPIAIGGPGLAPGATFREDLPDAGLANVAATVINLHGFEAPHHYEPTLIQVSPVPF

SEQ ID NO: 5903 - protein, 115 aa, Triticum aestivum
MASPALISDTDQWKALQAHVGAIHKTHLRDLMTDADRCKAMTAEFEGVYLDYSRQQATTETIDKLFKLAEAAKLKEKIDKMFKGEKINTTENRSVLHVALRAPRDAVINSDGVNV

SEQ ID NO: 5904 - protein, 325 aa, Triticum aestivum
  misc_feature (151)..(151): Xaa can be any naturally occurring amino acid
MKDFPGVFPRIFGHEAFGVVESTGEHVEGFAAGDAVVPTFLAQCSECADCRSSRSNVCSKYRFAVRPGMPRDGTTRFRDGDGNPIHHLSSADAWGEYTVVDVTQVVKVDPAVPPATACLLSCGATTGVGAAWKLAKVEPGSSVAIFGLGAXGLAVAEGARICGASKIIGVDLNPDKEELGKKFGVTHFINPKELGEKTVSQVIIEMTDGGADYCFECIGLAALMNDAFQSSRAGWGKTIILGVERHGAPLTISSLEILHGKCVMGSLFGGVKPKQDIPILADKYLNKELELDKFITHEVGLKDINTAFDLLLQGKSLRCTIWMDK

SEQ ID NO: 5905 - protein, 330 aa, Triticum aestivum
  misc_feature (97)..(97): Xaa can be any naturally occurring amino acid
MATGVGEARGETVLVTGASGFIGSWTVRLLLARGYDVHAAVLNPDDKAETEHLLALAGGDEGRVRFFPCDLLDGAAMLAAARGCSGVFHLASPCTVXRVLDPQKELVVPAVEGTLNVLRAAKEAGGVRRVVVTSSVSAVVPSPGWPAGEVLDERCWTDIDYCDKNGVWYPASKTLAEKAAWKFAEENGLDVVVVNPGTVLGPMIPPRINASMAMFLRLLEGCTEEYKDFFIGPVHVEDVALAHITLFENPSASGRHLCVEPICHWSDFASKVAELYPDYKVPKFREDTQPGLVRAETVPKKLMALGLQFTPLEKIIRDAVESLRSRGCIA

SEQ ID NO: 5906 - protein, 377 aa, Triticum aestivum
  misc_feature (141)..(141): Xaa can be any naturally occurring amino acid
MADQSLAAPIRCKAAVSRAKGAPLVIEDIVVDPPKAYEIRMKVICTSLCHTDITFWRGKEDFPLPPVFPRILGHEAYGVVESLGEHVEGFAVGDTVVPTFLGQCDSCGGCASAGSNMCSALPFVVGPGMRRDGTTRFRDSXGEPLHDFLAVSSFSQYTVVDVNQVVKVDPAVPPKLACLLGCGAGTGVGAAWKLAKVQPGSSVVIFGLGAVGLSVAQGAKMCGAKKIIGVDLNPDKEELGKKFGVTDFVNPSKLGESPLSQVIIEMIGAASVMTEAFRSAKQANGKTVILGLEKDGKPISLPSIEFLFGKCVMGSLFGGIKPKTDIPILAEKCLNKELELEKLITHEVGLQEINTAFDLLLQGKSLRCIIWMDKLEA

SEQ ID NO: 5907 - protein, 415 aa, Triticum aestivum
  misc_feature (74)..(74): Xaa can be any naturally occurring amino acid
  misc_feature (214)..(214): Xaa can be any naturally occurring amino acid
MRAFLKGCFYPRGGATDPAAVADGDEATTATAKATAPPRASTKKPKKKSMRRAPSATARLRTLSFDDLSRTLAXSGMHAFTVAELRAATRNFSGSHFIGEGGFGPVYKGFLDDKVVPGMQPQHVAVKYLDAEGPQGHREWLAEVVYLGMQLSHPHLVKLVGYCYQEHHRMLVYEYMARGSLEHHLFKNLLASLPWATRLKIAVGAAKGLAFLHXEAETPVIYRDFKASNILLESDYTAKLSDFGLAKEGPSGDDTHVSTRVMGTHGYAAPEYILTGHLTARSDVYSFGVVLLELLTGRRSVDKRRRGREQNLVDWARPYLRRPDRLHRVMDPSLEGSYSAEAAAKAATVAYNCLHSVPKNRPTMREVVDSLEPLMRMSRDVPAGLFVYTAPSEPSPVAKAVADKADVAAEAVEET

SEQ ID NO: 5908 - protein, 226 aa, Triticum aestivum
MPGMASSKGLLVFALLLAAAAILVASTDEHTEAKKEENGPAGQDSSPLGRGRPGHGGGGGGYGGGGGGDGGGGGGGYPGGGGGYGGGGGYPGHGGEGGGGYGGGGGYPGGGGGYRGGGGYPGHGGKGGGGYGGGGCHWGCCGHGLFHHHGCRCCARADQVPEPMDRAPAEGHHWAHHPDQMEPWTPAYRKEYWWPVATLGRTLPGWRWSAPLPAYITIKLVRNKHG

SEQ ID NO: 5909 - protein, 335 aa, Triticum aestivum
MAFALKASASPALAAASSAASSPSFSAASAAPRGRAAAARRVSLRGAAHPVAAIRASATAAAPAPAVAGDKRTISGTFTNLKEQGKIAFIPFIVAGDPDLATTAKALKVLDACGSDVIELGVPYSDPLADGPVIQASATRALTKGTTFEDVISMVKEVVPELSCPLALFTYYNPILKRGVANFMSVVKEAGVHGLVVPDVPLEETDILRSEAAKNNLELVLLTTPTTPTERMERITKASEGFVYLVSTTGVTGTRANVSFKVEALLKEIKQVTDKAVAVGFGVSTPEQVKQIAGWGADGVIVGSAMVRQLGESGSPEEGLKKLEELAKSLKAAFP

SEQ ID NO: 5910 - protein, 342 aa, Triticum aestivum
ERGRLKDGAVLLGGLKEHLKTIRRSRRVVFIGCGTSYNAALAARTFVEELTGIPVTMEVASDLLDRQGPIYREDTAVFVSQSGETADTLLALDYALENGALCVGITNTVGSTLSRRTHCGIHINAGCEIGVASTKAYTSQIVVMAMMALAIGSDQISTQARREAIISGLFSLPSNASQVLKLDSEMKELASSLIDSESLLVFGRGYNYATALEGALKVKEVALMHSEGMFAGEMKHGPLALVDENLPIIVIATRDACFSKQQSVIQQLLSRKGRLIIMCSKGDASAVNPGGSCRVIEVPKVADCLQPVINIIPLQLLAYHLTVLRGFDVDQPRNLAKSVTTQ

SEQ ID NO: 5911 - protein, 288 aa, Triticum aestivum
  misc_feature (214)..(214): Xaa can be any naturally occurring amino acid
  misc_feature (219)..(219): Xaa can be any naturally occurring amino acid
  misc_feature (222)..(222): Xaa can be any naturally occurring amino acid
  misc_feature (235)..(235): Xaa can be any naturally occurring amino acid
  misc_feature (252)..(252): Xaa can be any naturally occurring amino acid
MCSDSKEVAAVPQSTDATCAPASPRSAHQSAHAPPRSSLVARLSSSSYARREKMGKRWIPLEANPDVMNQFIWGLGVTEGEAQFCDVYGLDDELLAMVPQPVLAVIFLYPLTSLDEKVEEYDASATSTAGGKDSSEKVYFTKQTVGNACGTVGVIHAIGNAASDIKLVEGSYFDRFYKQTADMDPVQRAVFLEEDDEMDPNNRSSLAATAGDTXDVNVXEVXNEHFVCFSCVDGXEFLYELDGRKSKPISHXPSSPETLLQDAAKSSRPELATNPNSLNFNVMVLSKQ

SEQ ID NO: 5912 - protein, 254 aa, Triticum aestivum
YNKFVQKSRLVPVRNSRDIVDPRVRTGASHGGVLAGLAACGVMMSIVSTAADLMQDFKTGYLTLASPRSMFISQVIGTAMGCVIAPCVFWLFYKAFDNIGISGTEYPAPNAAIFRSMAILGVDGFSSLPKNCLTLCYIFFVGAIVVNLIRDLVPKKVSNFIPIPMAMAIPFYIGSYFAIDMFIGTVILFVWQRLDRAKSETFAPAVASGLICGDGLWVLPQSVLALAKVKPPICMKFLSRGMNDKVDAFITTLS

SEQ ID NO: 5913 - protein, 172 aa, Triticum aestivum
  misc_feature (60)..(60): Xaa can be any naturally occurring amino acid
  misc_feature (76)..(76): Xaa can be any naturally occurring amino acid
  misc_feature (91)..(91): Xaa can be any naturally occurring amino acid
  misc_feature (104)..(104): Xaa can be any naturally occurring amino acid
MSGVKKVTDVAAKAGKAIDWDGLAKMLVSDEARKEFANLRRTFEDVNHQLQTKFSQEPKXPIDWEYYKKGIGIERXSNIVDMYKEAYDSIXIPKYVDTVTPEYXPKFDALLIEMKEAEKTSLKESERIEKEIAELKEMKKKISTMTADEYFAKHPELKKKFDDEIRNDYWGY

SEQ ID NO: 5914 - protein, 230 aa, Triticum aestivum
  misc_feature (153)..(153): Xaa can be any naturally occurring amino acid
  misc_feature (208)..(208): Xaa can be any naturally occurring amino acid
  misc_feature (215)..(217): Xaa can be any naturally occurring amino acid
  misc_feature (228)..(228): Xaa can be any naturally occurring amino acid
MAAAVVDAAVPVAAKANGAGARCCAAKGPGYATPREAMEKGPREGLLYVTCVYNGTGIDKPDYLATVDVDPNSATYSQVIHRLQATHIGDELHHSGWNACSSCHGDPSTSRRFLILPSLLSGRLYVVDTAKNPRAPALHKVVQAEDIAEKTGXLGFPHTSHFALQTGDIMISCLGDKEGNAAGNGFLLLDSEFNVTGRWEKPGHSPGXGYDSGTXXXSQTMISSSWGXRF

SEQ ID NO: 5915 - protein, 241 aa, Triticum aestivum
AADNPEIGLMGSCVLVMLMKGENVYVMNVGNSRAVLARRPEPNLDNILGKATEKDLQQLKAEIMDGLQSVQLNAEHSTSVEEEVKRIKAEHIDRNAIIHGRVKGKLNITRAFGAGYLKEPKWNSMLLACFKIDYIGKDPYINCIPSLHHHRIGPNDKFLVLSSDGLYQYFTNKEVVDEVEMFTAAYPKGNPAEHLIREVLLRAARKAGMDYHELLNISYDERRRYHDDVSIIVISFKAHAP

SEQ ID NO: 5916 - protein, 327 aa, Triticum aestivum
MRAVAIASPGGPEALQVREVDDLPAPGEGEVLVAVAAAGVNRADTVQRQGRYPPPPGASPYPGLECSGTILALGANVPPRWAVGDQVCALLTGGGYAERVVVPAGQLLPVPEGVSLTDAAGLPEVACTVWSTVFMTSHLSPGESFLIHGGSSGIGTFAIQIAKHLGVKVFVTAGSEEKLAACKGLGADVCINYKTEDFVARVKEETDGKGVDVILDNIGASYLQRNLNSLAVDGRLFIIGFMGGTTTEVNLQAMLARRLTIQAAGLRNRSLANKAQIVSEVEKNVWPAVVSGKVKPVIYKTFPLSEAAESHKLMETSSHIGKILLIP

SEQ ID NO: 5917 - protein, 359 aa, Triticum aestivum
  misc_feature (183)..(183): Xaa can be any naturally occurring amino acid
  misc_feature (251)..(251): Xaa can be any naturally occurring amino acid
MATAGKVIKCKAAVAWEAGKPLSIEEVEVAPPQAMEGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLXGAVGLAAMEGAKMAGASRIIGVDLNPAKYEQAKKFGCTDFVNPKDHTKPVQEVLVEMTNGGVDRAVEXPGHVDTMISAFECVHDGWGVAVLVGVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 5918 - protein, 379 aa, Triticum aestivum
MATAGKVIKCKAAVAWEAGKPLSMEEVEVAPPQAMEVRVKILYTALCHTDVYFWEAKGQTPVFPRILGHEAGGIVESVGEGVTELVPGDHVLPVFTGECKECAHCMSEESNLCDLLRINVDRGVMIGDGQSRFTIDGKPIFHFVGTSTFSEYTVIHVGCLAKIDPEAPLDKVCLLSCGISTGLGATLNVAKPKKGMTVAIFGLGAVGLAAMEGARMSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFLNERTLRGTFFGNYKPRTDLPGVVDMYMRKELELDKFITHSVPFSQINTAFDLMLKGEGLRCVIRMDE

SEQ ID NO: 5919 - protein, 399 aa, Triticum aestivum
  misc_feature (100)..(100): Xaa can be any naturally occurring amino acid
  misc_feature (219)..(219): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECXCAHCKSEESNLCDLLRINVDRGVMIGDGQSRFTIDGKPIFHFVGTSTFSEYTVIHVGCLAKINPEAPLDKVCVLSCGISTGLGATLNVAKPKKGDDPRRFCSTPCFCRLKRIMCYNQDXLPCASVSDHAAVEGAKMSGASRIIGVDLNPAKHEQAKKFGCTDFVNPKDHTKPVQEVIVEMTDGGVDRAVECTGNADAMISAFECVHDGWGVAVLVGVAHKEAVFKTHPMNFLNERTLRGTFFGNYKPRTGLPGVVDMYMRKELELDKFITHSVPFSQINTAFDLMLKGEGLRCVIRMEE

SEQ ID NO: 5920 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTISGKPIFHFVGTSTFSEYTVIHVGCLAKINPSAPLDKVCVLSCGISTGLGATLNVPKPKKGSTVAIFGLGAVGLAAMEGAKMAGASRIIGVDLNPAKYEQAKKFGCTDFVNPMDHTKPLQEVLVEMTNGGVDRAVECTGHVDAMISAFECVHDGWGVAVLVGVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 5921 - protein, 379 aa, Triticum aestivum
  misc_feature (251)..(251): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTXPVQEVLVEMTNGGVDRAVECTGHIDAMIAAFECVHDGWGVPVLVGVPHKEAVFKTSPMNLLNERTLKGTFFGNYKPRTDLPEVVEMYMRKELDVEKFITHSVPFSQINTAFDLMLKGEGLRCVMRMDE

SEQ ID NO: 5922 - protein, 162 aa, Triticum aestivum
MALALKASLSPSSSPLSSPQRSRARAAVAVATPGRPVVARALAAASVDPAVVMPTARRLAVRARAAATLLAPAPAGKSGMSVAKAMSQARHKGKTAFIPYITAGDPDLATTAEALRLLDTLGADVIEVGMPFSDPYADGPVIQASAARALSAGVTTDAVMSM

SEQ ID NO: 5923 - protein, 338 aa, Triticum aestivum
MAASALAASAAASQSMKNREILDAVGTTAAALSLAGSSFIVLCYLLFRELRKFSFKLVYFLAGADMLCSLFTIMGGPAGAFYCFAHDYSAHFFCVASFLWTTTIAFTLHRTVVKHKTDVEEFGFIFHLYVWGTSLVTPGVRARGGDYGRPGTWCWIQQGSTGKILHLITFYLPLWGAILYNGFTYYQVNRMLNNATRMAVGMSDRSSQSDVRADKKAFNRWGYYPLILIGSWAFATINRLHDFANPGHKIFWLSILDIGFAGLMGLFNSIAYGLNSSVRRAIAERIDMYLPERIKRSLPTLSRLRSQQENELTSLIVESNNTITETTMRVTPRSSLAG

SEQ ID NO: 5924 - protein, 256 aa, Triticum aestivum
  misc_feature (13)..(13): Xaa can be any naturally occurring amino acid
MTNIPVFLIGHVXKTGDIAGPRVLEHIVDVVLYMEGERCLSHRLLRSAKNRFGSTDELGVFEMSEHGLQAVLNPSEMFLTEHDSDSEILAGLAVAVVLDGSRTFAIEVQALSVPGSLGQGKVVGTKSKRVEMIISVLMKQAGLKLQDNVIYLNVVSGFELSETAGDLAIAASICSSFLEFPIPNDIAFIGEIGLGGELRTVPRMDKRVMAIAKLGYRKCVVPKTSEKLLKPLDLDIQILPCNNLKEFINTVFRPEV

SEQ ID NO: 5925 - protein, 454 aa, Triticum aestivum
  misc_feature (430)..(430): Xaa can be any naturally occurring amino acid
MRHLLLSRLLRRASSPSQPHHNLQLIRALSSSSPLPASDTDLRKYAVRALLVLGCGAATYYSFPFPPDALHKKAVPFKYAPLPDDLHTVSNWSGTHEVHTRVLLQPDSIPALEDALATAHRERRRLRPLGSGLSPNGLGLSRAGMVNLALMDKVLDVDVKKKTVTVQAGIRVAELVDALREHGLTLQNFASIREQQVGGIIQVGAHGTGARLPPIDEQVISMKLVTPAKGTIELSTEKDPDLFYLARCGLGGLGVVAEVTLQCVERHQLVEHTFVSNADEIKKNHQKWLSENKHIKYLWIPYTDTVVVVQCNPPSRWKTPKLASKYGEDEALQYVRDLYRESLKKYRTEADSKDPAIDQLSFTELRDQLIALDPLDKDHVIRINKAEAEYRKKSEGYRMGWSDEILGFDCGGQQWVSETCFPTGTLAKPXMKDLYYMEELLQLIEKEDIPAPAP

SEQ ID NO: 5926 - protein, 291 aa, Triticum aestivum
  misc_feature (175)..(175): Xaa can be any naturally occurring amino acid
MAKDIEAAPPGGGYAAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLGAICGVGLVKGFQSAFYVRYGGGANELSSGFSKGTGXLAAEIIGTFVLVYTVFSATDPKRSARDSHVPVLAPLPIGFAVFMVHLATIPITGTGINPARSLGAAVIYNNEKAWDDHWIFWVGPFIGAAIAALYHQYVLRASATKFGSSASFGSR

SEQ ID NO: 5927 - protein, 654 aa, Triticum aestivum
  misc_feature (157)..(157): Xaa can be any naturally occurring amino acid
  misc_feature (470)..(470): Xaa can be any naturally occurring amino acid
  misc_feature (479)..(479): Xaa can be any naturally occurring amino acid
MIPLCASSSPSTPAIIAPRPRRLRHRTTTPSLPHSRSPHRHLLLASPSSPAPTPRPLARAQRLAAAATAAEMVFSVTKKETKPYEGQKPGTSGLRKKVTVFQQPHYLANFVQATFNALPADQVKGATIVVSGDGRYFSKDAVQIIAKMAAANGVRRXVWVGQDSLLSTPAVSAIIRERISADGAKATGAFILTASHNPGGPTEDFGIKYNMGNGGPAPESVTDKIFSNTKTITEYLIAEDLPNVDISVTGVTSFTGPEGPFDVDVFDSATDYIKLMKTIFDFESIKKLLASPKFSFCFDGLHGVAGAYAKRMFVDELGASESSLLNCVPKEDFGGGHPDPNLTYAKELVERMGLGKTSNADPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREXDGIWAVLAXWLSILAYKNKDNLGGDKLVTVEDIVLQHWATYGRHYYTRYDYENVDAEAAKELMANLVKMQSSLSDVNKSIKEIQPTVADVVSADEFEYKDPVDGSVSKHQGIRYLFGDGSRLVFRLSGTGSVGATIRIYIEQYEKDSSKTGRESSDALSPLVDVALKLSKIQEYTGRSAPTVIT

SEQ ID NO: 5928 - protein, 366 aa, Triticum aestivum
  misc_feature (277)..(277): Xaa can be any naturally occurring amino acid
MSKTALLTPYKMGRFDLSHRVVLAPLTRERSFGNVPQPHAILYYQQRTTKGGLLIAEATGVSDTAQGYKDTPGIWTKEQVEAWKPIVNGVHAKGGIFFCQIWHVGRVSNHTFQPNGQAPISSTDKPLKPVVRANGIDVPTISTPRRLQTNEIPLVINDFRAAARNAIEAGFDGVEIHGAHGYLIDQFLKDQVNDRTDKYGGSLENRCRFALEVVQAVVDEVGADKVGIRLSPFANYSEASDSNPEALGLYMAHALNKFGILYCHMVEPRMVNIGEKXETPHSLRPIRDAFKGTFIVAGGYDRDDGNKAIADDYADLVAYGRLVLSIPDLPRRFEIGAPLNKYIRDTFYLSDPVIGYTDYPFLPSDV

SEQ ID NO: 5929 - protein, 357 aa, Triticum aestivum
  misc_feature (151)..(151): Xaa can be any naturally occurring amino acid
MALPPTAAPAAALRCAGAHVGRVPLPRHAGGAYLRSALPFRLGVLSSRRCRAGAGAVVSATRSPGLGNAGNLREGSNLAKNWDLSRQIGDEHGVLIECRDVHKSFGDKHVLQGVSFKIRHGEAVGIIGPSGTGKSTILKVMAGLLAPDRGXVFICGKKRQGLVSDEDISGLRIGLVFQSAALFDSLNVRENVGFLLYENSKLSEERIGELVTETLAAVGLKGVEERMPSELSGGMKKRVALARSIINDDTKETIEPEALLYDEPTAGLDPIASTVVEDLIRSMHVTGKDAMGKPGKIASYAVVTHQHSTIRRAVDRLLFLHEGKIVWEGMTEEFTTSTNPIVQQFASGSLDGPIRYF

SEQ ID NO: 5930 - protein, 330 aa, Triticum aestivum
MDPAGAGKATAAAAAVCVTGAGGFIASWLVERLLAGGDYAVHGTVRDPSDPKNKHLRALDGAGERLRLFKADVLDYASVASTVAGCAGVFHVASPCPAAQPTNPEVELLAPAVAGTLNVLRACREAGVRRVVVVSSVGAVFMNPNPPEGPTMDEHCWSNEEYCRATENWYCLSKTLVEREAWAYAEKAGLDVVTVCPPLVFGPLLQPTVNTSSLFLIRYLKCDGVNAMDDRVRNMVDVRDVADALVLAYESPEAAGRYICSAHARKVSEMVSVVRSLHPSLNCANKFVQLVGDEKVFSTEKLQRLGWKFRTLEETLKDSVESYMSAGILS

SEQ ID NO: 5931 - protein, 301 aa, Triticum aestivum
MLPWATAAEAEAALGRAMTAAEALWFRWTAETSDYYLYCLNILFLLVVFTLAPLPVALLELRAPRAVGPYKLQPRVRLSRAEFLKCYGDVMRIFFLVIGPLQLVSYPAVKMVGIHTGLPLPSLGEMAAQLLVYFLVEDYLNYWIHRLLHGEWGYEKIHRIHHEYTAPIGFAAPYAHWAEVLILGIPSFAGPAIAPGHMITFWLWIILRQMEAIDTHSGFDFPFSLTKYIPFYGGAEYHDYHHYVGGQSQSNFASVFTYCDYLYGTDRGYRFHKAYLAKLKDLAPSDGEKEGADGFAYAKLD

SEQ ID NO: 5932 - protein, 495 aa, Triticum aestivum
VRPRAAHASADAWAFLSAGSELLLEIMGPGLVGGLLLPILGALPDALLVLVSGLSGTKETAQSQVLIGMGLLAGSTVFLLTLLWGTCVVVGKCDVGENGVAIDSTDTKGFSLTGSGITTDVQTSYAARIMAISVIPFVIAQFPKMLKTHHGERLAILLALIASFSLVLAYCLSQVFQPWVQKRKLAYAKHKHVISGILQHAQKQALGRLLNDDGSPNENVIRKLFHKIDNDDSRNLSRAELHALIIGINFEEIDFDKNDAVDKIMDDFDTSGNDTVEEDEFVAGMKTWLHEAKQKVAASGAYSNKFVNDYHARTREDHDQLVDRSDEAVESVENPGWCIAKAVGYLILGATICAAFADPLVDAVHNFSNATHIPSFFVSFIGLPLATNSSEAVSAIIFASRKKQRTCSLTFSEVYGGVTMNNTLCLGVFLALIYFRELTWDFSSEVLVILLVCVIMGLFTSFRTSFPLWTCLVAYLLYPLTLAVVYVLDFVFGWS

SEQ ID NO: 5933 - protein, 109 aa, Triticum aestivum
TNSSEAVSAIIFASRKKQRTCSLTFSEVYGGVTMNNTLCLGVFLALIYFRELTWDFSSEVLVILLVCVIMGLFTSFRTSFPLWTCLVAYLLYPLTLAVVYVLDFVFGWS

SEQ ID NO: 5934 - protein, 273 aa, Triticum aestivum
MASPSSSLCSSLGYPRAASLGGRRRVGFSSSRKLFQVKASRVDSFSKSDIIVSPSILSANFAKLGEQVKAVEVAGCDWIHVDVMDGRFVPNITIGPLIVDALRPVTDLPLDVHLMIVEPEQRIPDFIKAGADIVSVHCEQTATIHLHRTVDQIKSLGAKAGVVLNPGTPLSAIEYVLESVDLVLIMSVNPGFGGQSFIESQVKKIADLRKLCEEKGVNPWIEVDGGVSPKNAYKVIEAGANALVAGSAVFGAKDYAEAIKGIKTSKRPVAVAA

SEQ ID NO: 5935 - protein, 273 aa, Triticum aestivum
MASPSSSLCSSLGYPRAASLGARRRAGFSSSRKLFQVKASRVDSFSKSDIIVSPSILSANFAKLGEQVKAVEVAGCDWIHVDVMDGRFVPNITIGPLIVDALRPVTDLPLDVHLMIVEPEQRIPDFIKAGADIVSVHCEQTATIHLHRTVDQIKSLGAKAGVVLNPGTPLSAIEYVLESVDLVLIMSVNPGFGGQSFIESQVKKIADLRKLCEEKGVNPWIEVDGGVSPKNAYKVIEAGANALVAGSAVFGAKDYAEAIKGIKTSKRPVAVAA

SEQ ID NO: 5936 - protein, 354 aa, Triticum aestivum
MAAESESCNCSAWAANDPSGVLSPHSFNRRAVRHDDVSLRITHCGVCYADVQWTRNRHHDSVYPLVPGHEIAGVVTEVGSDVKGFKPGDHVAVGTYINSCRDCDNCNNLLENHCSNFVFTFNGVDTDGTVTKGGYSTHIVVHERYCYKIPDGYPLDKAAPLACAGITVYTPMIRHNMNQPGKSLGVIGLGGLGHMAVKFGKAFGLNVTVLSTSESKRDEAINLLGADNFVVSSDKNQMEFLKNSLDFIVDTASGDHPFDPYLALLKVRGTMALVGFPGEIRVHPATLNLGARTLSGSVVGGTKDTQEMINFCAANRIYPNVEVIKIDYINEALERLVNRDVRYRFVIDIESSFK

SEQ ID NO: 5937 - protein, 372 aa, Triticum aestivum
MSKQGGIGSTVPLLTPYKMGAFDLSHRVVLAPLTRTRSYGNVPQPHAILYYQQRTTKGGLLIAEATGVSDTAQGYKDTPGIWTKEQVEAWKPIVDGVHAKGGIFFCQIWHVGRVSNHTYQPNGQAPISSTDKPLKPMVIDKHIVADFATPRPLETDEIPMVINDFRVAARNAIEAGFDGVEIHGAHGYLIDQFLKDQVNDRTDKYGGSLENRCRFALEVVQAVVDEVGADKVGIRLSPFANYPVPSDSNPEALGLYMAHALNKFGILYCHMVEPRMVNIGEKFETPHSLRPIRDAFKGTFIVAGGYDRDDGNKAIADDYADLVAYGRLFLSNPDLPRRFEIGAPLNKYIRDTFYLSDPVIGYTDYPFLPSDV

SEQ ID NO: 5938 - protein, 131 aa, Triticum aestivum
  misc_feature (64)..(64): Xaa can be any naturally occurring amino acid
SWTRVLSLGSDPYFVFPVIQASVARVLLAGVTTVAVMSMLKEVTPELSCPVVIFFYFNLIARRXTGSFTGVCREAGVRGLIVPDLPYIETGFLRNEAIKNDIELVLFTTPFTKADMINEISIALEGFVYLC

SEQ ID NO: 5939 - protein, 356 aa, Triticum aestivum
MDATRAVNKAWKGPCGVAGTQKIVIPPGNFLVGALELSGPCTSSIIIRLDGNLLGTGDLTAYKKNWIEVMRVDNFAINGHGIIDGQGPLVWEKNQCSKHYDCKILPNSLVLDYVNNATIRGITLKNAKFFHLNLFNCKTVLVENVEITAPGNSPNTDGIHMGDSEDVPIQVVRGLLVGAQGPPLPGPKHVKIHGSRCGPGHGISVGSLGRYKDEKDVEDIQVTNCTIKGATNGLRIKSYEDSKSALRATRFVYDDVRMDNVSYPIVIDQKYCPNNICAKAPGASKVVVADIVFKNIVGTSATPEAVTLNCVNNVPCQGLQLVNVNLKYTGTNNKTMAVCKNAVGKSVNVVKELACL

SEQ ID NO: 5940 - protein, 585 aa, Triticum aestivum
  misc_feature (69)..(69): Xaa can be any naturally occurring amino acid
PRVRTDAALAVLAARHGGLAELHIGPDPLDRISSDALRSVALCCPRLRCLRLSGLRDLAAAPPARRAPXLPALDVSRTDVSPGAVSRLISHSTTLRLICALNCASLEEEEAHSPAAFANSRGKLVLTINRTISKYIAADAAPLCPDTAVKDTVVFDECRSSSGKRNGVSQLITWLEWILSQSLLRIPESNPHGMNQFWLDQGAALLLTLLKSSQDDVQERAATTLATFAVIDDENTNVDPARSEAVMLEGGIPMLLDLARCSRESLQSEAAKAIANLSVNPKVAKAVADQGGIAILTNMAKSVNRLVAEEAAGGLWNLSVGEEHKVAIAAAGGVKALVDLIFRWPAGTGVLERAAGALANLAADDKCSLEVATAGGIHALVTLARSCKVEGVLEQAARALANLAAHGDNNNNNAAVGQEPGALEALVQLTHSPSEGVRQEAAGALWNLSFDDRNRESIASAGGVQALVSLCQECLNASDGLQERAAGALWGLSVSEANSIAIGREGGVPPLIALAQSEVEDVHETAAGALWNLAFYSCNSLRIVEEGGVPVLVHLCSSSHSKMARFMAALTLAYMFDGRMDEIAL

SEQ ID NO: 5941 - protein, 176 aa, Triticum aestivum
RVRGLLKSAFAPTVIRCLSFSANSHLIFAGSSSGYAHCWDLRTLRPLWETRVSPNVIYSAHHLPGDTSMLVLGGIDGVLRLVCQRTGETIRSFIMDAGYPAQSSSRPQAEQKNVRPAESGPRQQVEKKRVREIAPDARLDNIPMHLRPPITGLSVGMKKIVTTHGENYIRVWKFHS

SEQ ID NO: 5942 - protein, 123 aa, Triticum aestivum
NLTACFLKPQVLNRWGYYPLILIGSWAFGTINRIHDFIEPGHKIFWLSVLDVGTAALMGLFNSIAYGFNSSVRRAIHERLELFLPERLYRWLPSNFRPKNHLILHQQQQQRSEMVSLKTEDQQ

SEQ ID NO: 5943 - protein, 584 aa, Triticum aestivum
  misc_feature (93)..(93): Xaa can be any naturally occurring amino acid
  misc_feature (101)..(101): Xaa can be any naturally occurring amino acid
ECNWRNKRKILGVMMNWLARGRAQARLRLPQGMPSGLGPLWGRQRAAMLPPPVEAALQAVPVRPPPSGAPSVAMHDGATDGRPAGSEAVMRDXGGIPLLLXLARCSRVSAQSEAAKAIANLSVNAKVAKVVADEGGIAIFTNLAKSTNRLVAEEAAGGLWNLSVGEEHKAAIAAAGGIKALVDLIFRWPAGTDGVLERAAGALANLAADDKCSLEVAKAGGVHALVTLARSCKLEGVLEQAARALANLAAHGDNNNNNAAVGQEAGALEALVQLTCSQNEGVRQEAAGALWNLSFDDRNREAIAAAGGVEALVSLAQQCLNASEGLQERAAGALWGLSVSESNSIAIGQEGGVAPLLTMAQSEVEDVHETAAGALWNLAFYSSNAHRIVEEGGVPILVHLCSSSGSKMARFMSALALAYMFDGRMDEAAIVGTSSEGSSKGVNVEGARRMALKHIEIFVLTFSDPQVFSMAAASSAPAALSQVAEAVFIQEAGHLRCSGAEIGRFIAMLRNPTPVLRACAAFALLQFSIPGGRHATHHADLLQNVGAARVLRAAAAATSASIEAKVFARIVLRNLEHHQAGTST

SEQ ID NO: 5944 - protein, 170 aa, Triticum aestivum
  misc_feature (51)..(51): Xaa can be any naturally occurring amino acid
  misc_feature (93)..(93): Xaa can be any naturally occurring amino acid
  misc_feature (103)..(103): Xaa can be any naturally occurring amino acid
  misc_feature (113)..(113): Xaa can be any naturally occurring amino acid
  misc_feature (124)..(124): Xaa can be any naturally occurring amino acid
  misc_feature (140)..(140): Xaa can be any naturally occurring amino acid
  misc_feature (151)..(151): Xaa can be any naturally occurring amino acid
  misc_feature (153)..(153): Xaa can be any naturally occurring amino acid
  misc_feature (155)..(156): Xaa can be any naturally occurring amino acid
MDQLVNFIIRPPRADYSPDDDLLEQEFMLKGRWFQRKDLEVVYGLGFRVAXSRFTPAAVPDGPAPLVLLSVARYTGGRALPCGPPGRLLPSNXTVFTLDFSGXGLSEGEHVTXGWNEKKDLKAXVVNYLRTDGNIFCIAXGGPLMGGGTSXMXGXXDPSMWKGSWKFLPC

SEQ ID NO: 5945 - protein, 491 aa, Triticum aestivum
  misc_feature (331)..(331): Xaa can be any naturally occurring amino acid
MANAGDPASLPPSASPFSSTRALESVPFSSGNPRIEETRGVVLLHPDPPTAAAAASSSSSHLPAERKPQVFVPAVPNHMTYADFCRFCGSFVPHMLEMRIVRIDGAEDQYSVLIKFDTLSSTDSFYKHFNGKQFSSLEGDVSRIRFVEDVHYTQLIEHAHSSITSSAEQPTCPVCLERLDQDPGGILTTICNHSFHCSCISKWTGSSCPVCRYCQQQPEKSMCSVCGTSENLWICLICGNVGCGRYKGGHAIEHWKETEHCYSLELETQKVWDYAGDNYVHRLIQSKTDGKLVEYNCYGGHEADGICSICSGDAGMDEALLNSKVEAVMYXNVEEYNDLLTSQLDKQRNYYESLLSEVKEENEKEISAATSKAVSMMKLQKLQAKLDKCLEEKSFLDDINANLVKNQEMWKERVRKVQEREQAALKLKDEKIEKLEAELRDLIAHIECQNAVAAAPGSISSDIQGGTILPGPSAPSSSSSPVRPTKDRKRN

SEQ ID NO: 5946 - protein, 235 aa, Triticum aestivum
MLALGATFVLSGLLFVSKPCASDLPLFLASISQPLALALFICEEHCAAAVLHASLICLSSMLALVATFVFSCLLFLSKPCARDMRLFLASISQQLALSLLGFLAGYRLLGGVASRATATAVDAMPLMPSFKRKRPAAKLETTDTTGEPSVLDLPELAIDCILAKLPPAELRNMAAVSRSMRERCRSDHLWERHMSDKWGSVLGTAARDEWRSYLSSSTRARRRRDRGAGLLAAEA

SEQ ID NO: 5947 - protein, 462 aa, Triticum aestivum
MGHDHRRSGHDSHISRVGHGRAGEEPQGAEEAAGGAGQRGRPRSRHVRDRLPEPALPDGRREGVPPPAPADAVHAAPQGPRVRLFTQKRLEALRPIREDEVTAMVESVHRAAAGPGNEGKPLVVRNHLAMVSFNNITRLAFGKRFMNADGDIDEEGQEFKLIVNNGIKIGASLSVAEYIWYLRWLCPLNEELYNTHNERRDRLTKKIIEEHAQALRESGAKQHFVDALFTLREKYDLSDDTVFGLLWDMITAGMDTTVISVEWAMAELVRNPRVQKKLQEELDSVVGRDRVMSETDFQNLPYLMAVVKESLRLHPPTPLMLPHKASASVKVGGYSIPKGANVMVNVWAVARDPKVWSSPLEFRPERFLEESIDIKGSDFRVLPFGAGRRVCPGAQLGINLVASMIGHMLHHFEWSLPEGARPEDISMMESPGLVTFMGTPLQAVATPRLENEELYKRVPVEI

SEQ ID NO: 5948 - protein, 518 aa, Triticum aestivum
  misc_feature (373)..(373): Xaa can be any naturally occurring amino acid
MGCCRSSLRAVTHPHPEKPPGAGAGAAPARRPSFSASAHQAAPAPAASASSSESEAGFAEFSLAELRAATGGFAAENIVSESGDKAPNFVYRGRPRRPPPPPPPASAVARCPGPAPPGSRRSPEGVGRLRHRRLANLIGYCCDGDERLLVAEFMPNDTLAKHVFHWENQTIEWAMRLRVAYHIAEALDYCSNEGRPLYHDLNAYRVLFDENGDPRLSCFGLMKNSRDGKSYSTNLAYTPPEYLRTGRVTPESVIFSFGTVLLDLLSGKRIPPSHALDMMRGNNIQMLMDSHLEGNYSTEEATALVDLASQCLQYEARDRPNTKKLVNILEPLQTKLEAPSYEMLGIPNHAEEVAPPPAPQPPQHPLSPMAAAXSRMDLTAIQQILVSTHYRDDEGSNELSFQEWTQQMRDMLDARKRGDLAFRDKDFKTAIECYTQFVDVGTMVSPTVYARRSLCHLMCDQPDAALRDAMQAQCVYPEWPTAFYMQAVALSKLDMQSDAKDMLSEASQLEEKKQKNSR

SEQ ID NO: 5949 - protein, 420 aa, Triticum aestivum
  misc_feature (315)..(315): Xaa can be any naturally occurring amino acid
  misc_feature (335)..(335): Xaa can be any naturally occurring amino acid
MEGPSVEVPPYFLCPISLEIMRDPVTLATGITYDRCSIERWLSDGHATCPITQQKLAEADREATPNHTLRRLTQAWCALHAVERFPTPRPPLDACRVAEIVEEGRGAGRQKELAALREIKAIVAESDRNRRCVEATPGAVEFLVSVVRNHATASKSAEDLLELSLDSPTSTSSPEEDALSVICSLKPSKKSLVRILEENGDFLDTLVYMLRRPSYRSRCYGILLLKAMVSVMEPARLMAVRTEVVQELVRVVSDRVSAKAVKAALHVLCRLCPWGRNRVKAVEAGAMTVLVELLLDEGGRHPTELAVVAIDHLCXLCGGAVGPGGAPGGAGRRGXKAMRVSLTTTESAVRALHAVARHSPTPAVLQEMLAVGVVAKLLLVLQVDAGERARAKAKELLKMHARVWKDSPCLQAHLKAHYPC

SEQ ID NO: 5950 - protein, 145 aa, Triticum aestivum
  misc_feature (115)..(115): Xaa can be any naturally occurring amino acid
MEVLGKSVIAEPSNVIFLSTILNTEGEIPSHKCDKRCQNEHIFGNMYRCKLTGMTHICDKNCNQRILYDNHNSLCRVSGQLFPLSPLELQAVRGIRRKHEADSSHEGCSFKRRRXGAQLHPSPFERSYSAVSPIPSQAGDGMDLS

SEQ ID NO: 5951 - protein, 472 aa, Triticum aestivum
MVPREHGDEAIVADGHGKEEEVGVMGVSSGGADGDEEQHGGGGGKFSVTSFLWHGGSVWDAWFSCASNQVAQVLLTLPYSFSQLGMLSGILLQLFYGFLGSWTAYLISVLYVEYRSRKEKEGVSFKNHVIQWFEVLDGLLGPYWKAAGLAFNCTFLLPRARVQLRARASNIYYINDRLDKRTWTYIFGACCATTVFIPSFHNYRIWSFLGLGMTTYTAWYLTIAAAVHGQVPGAKHSGPNSLMLYFTGATNILYTFGGHAVTVEIMHAMWKPRKFKYIYLVATLYVFTLTLPSASTMYWAFGDALLTHSNAFSLLPKSGWRDAAVILMLIHQFITFGFACTPLYFVWEKAIGMHHTGRVLRRALARLPLVLPIWFLAIVFPFFGPINSAVGALLVSFTVYVIPALAHMITYRSAHARENAVEQPPRFVGRWTGTYVINAFVVVWVLVVGFGFGGWASITNFLRHHRHHSHRL

SEQ ID NO: 5952 - protein, 339 aa, Triticum aestivum
  misc_feature (118)..(118): Xaa can be any naturally occurring amino acid
MQEILGILLTVLSMCCISPRVRGRTHRIETTFPRLADPLGYVPKEDILYAIKAIVVTQRENGRRDDRRYSRLKYLLDSWGIDKFRAEVEKYYGKKFEDFHPLPEWQFNSYLGWQEQGXDGKLFYGVHVDNGRLGGQAKKTLREIIEKYSLDVSITPNQNLILCGVDQAWREPITAALAQAGLLEPKDVDLLNITSMACPALPLCPLAQTEAERGILPILKRIRAVFDKVGIKDEESVVVRITGCPNGCARPYMAEVGFVGDGPNSYQIWLGGTPNQTTLAETFMNKVKLQDIEKVLEPLFSYWNSTRQEGESFGSFTNRMGFEQLKEVVNKWEGSASAA

SEQ ID NO: 5953 - protein, 491 aa, Triticum aestivum
  misc_feature (97)..(97): Xaa can be any naturally occurring amino acid
MGSMATSVEEIGAAVAPQAVERRLGELRATFESGRTRPLSWRQSQLRGLLRLLADKEEEAFRALHDDLGKHRAEAYRDEVGVLTKSANAALRETGKXAPEKVWVPLVAFPASAQVVPEPLGVVLIFSCWNFPLGLSLEPLIGAIAAGNAVALKPSELAPATARFLEENIGEYLDATAVKVIQGGPAVGEQLMEHRWDKVLFTGCPRVARVVMAAAAKHLTPVALELGGKCPCIFDAVAGRRNLQTSVNRVIFAKWSSCAGQACIAIDYVLVEERFAPTLIKVLKSTLKRFIADSDQMARIVNGRHFQRLSNLLKDPAVAASVLHGGGLDAKNLSIEPTILLNPPLDSAIMTEEIFGPLLPIITVKKIEDSIAFVRARPKPLAVYAFTDSAPLKRRIVEETSSGSVTFNDAVVQFGVDTLPFGGVGQSGFGQYHGKYSFEMFSHKKAVLRRGFLVEAMLRYPPWDEQKIAMMRHLFRYDYVRFIFTFLGLRR

SEQ ID NO: 5954 - protein, 492 aa, Triticum aestivum
  misc_feature (380)..(380): Xaa can be any naturally occurring amino acid
MGSMATSVEEIGAAVAPQAVERRLGELRATFESGRTRPLSWRQSQLRGLLRLLADKEEEAFRALHDDLGKHRAEAYRDEVGVLTKSANAALREIGKWVAPEKVWVPLVAFPASAQVVPEPLGVVLIFSCWNFPLGLSLEPLIGAIAAGNAVALKPSELAPATARFLEENIGEYLDATAVKVIQGGPAVGEQLMEHRWDKVLFTGCPRVARVVMAAAAKHLTPVALELGGKCPCIFDAVAGRRNLQTSVNRVIFAKWSSCAGQACIAIDYVLVEERFAPTLIKVLKSTLKRFIADSDQMARIVNGRHFQRLSNLLKDPAVAASVLHGGGLDAKNLSIEPTILLNPPLDSAIMTEEIFGPLLPIITVKKIEDSIAFVRARPXPLAVYAFTDSAPLKRRIVEETSSGSVTFNDAVVQFGVDTLPFGGVGQSGFGQYHGKYSFEMFSHKKAVLRRGFLVEAMLRYPPWDEQKIAMMRHLFRYDYVRFIFTFLGLRR

SEQ ID NO: 5955 - protein, 144 aa, Triticum aestivum
MPSAGLEAGSNKVDVAIDLGNPLLNRTVDGFLKIGAVGACRVVAEDAFDCIHRGDISKRQLEETLKKMCKEGAYWGAVAGVYVGMEYGVERARGDRDWKNALIGGIATGALVSAASNNKGNKIAQDAITGGAIATAVEFINYLT

SEQ ID NO: 5956 - protein, 144 aa, Triticum aestivum
MPRAGLSAGSSKVDVAIDLGNPLLNRTVDGFLKIGAVGAFRVAAEDAFDCLQSGSVSKRKLEKTLEKMCKEGAYWGAVAGVYVGMEYGVERVRGEYDWKNALIGGIASGALISAASNNKGNKIAKDAITGGAIATAIEFINYLT

SEQ ID NO: 5957 - protein, 352 aa, Triticum aestivum
  misc_feature (314)..(314): Xaa can be any naturally occurring amino acid
  misc_feature (319)..(319): Xaa can be any naturally occurring amino acid
MCVEGFEDAQIERPADFAMERVCENTVSIDFKQAKMVAGIEESWHNFVPAIRSGDWSDIGGRDYMEDAHVCIPNLAKNFGYNMVDDEVISFYGVFDGHGGKDAAQYVRDNLPRVIVEDAAFPLELEKAVRRSFVQTDSQFAEKCSVQDGLSSGTTALTAMIFGRSLLVANAGDCRAVLSRRGAAIEMSKDHRACCLNERKRVESLGGYVDDGYLNGQLAVTRALGDWHLDGLKEMGEPGGPLSAEPELKMITLTKDDEFLIIGSDGIWDYFSNQNSVDFARRRLQDHNDLRRCCKEIVEEAIRRGATDNLTAVXVSFHXKAPPQIRVNRTGRVERSISAEGLHSLRVLLEGQ

SEQ ID NO: 5958 - protein, 352 aa, Triticum aestivum
PRVRLSAHKGVNLPNTPVDLPALSEKDKADLRFGVEQKVDFIFASFVRRGQDVRDIRKVLGPDGKNIKIISKIENHQGVENFDDILAETDGVMVARGDMGIEIPLERVFIAQKMMITKCNLAGKPVICATQMLESMTYNPRPTRAEVSDVANAVLDGADCVMLSGETAKGNYPVDAVKTMHDICKLAESVLCYPAIFNELRNLTELPTETTETVACAAVAAAHEQNAGCIIVLTTSGNSARLISKYKPNAPIVVVTRNPQTARQIHLYRGCFPFLYPKASSAITSLLNSSSQGHLSPVENAPWQEDVDHRIRWGMEQAMKYGLLSRGQPVVAVQGWRGGLGNTNTLRIIYAP

SEQ ID NO: 5959 - protein, 172 aa, Triticum aestivum
ISYYGGPAVGSTAEVCDANSHLITGGELRALQPVFQIYGRRQVFAGPIVTLKVFEDNVLVREFLEEKGQGRVLVVDGGGSLRCAILGGNPVQQAQNNGWAGIVVNGCIRDVDEINGCDIGVRALASHPMKANKKGMGEKHVPVTIAGTRICDGEWLYADTDGILVSRTELIV

SEQ ID NO: 5960 - protein, 324 aa, Triticum aestivum
MMGGFVSRILLLVFGYAYPAYECYKTVELNKPEIEQLIFWCQYWILVALMTVMERFGDLTISWLPFYSEAKLLFFIYLWYPRTKGTTYIYGTFFKPYISQHENEIDRNLLELRARASDVVVVYVQKVAAVGQNTFFDVLKYVASQSPSQKSKQQRPQEPQQSQPQPQVQQQQPQRQAQPVMRRAASIAARQAAMAQQAQETKPVSPKIKRQASAKGGPAASVKPAAAAAPTAKPDEKTKKSEAKPAAELVPAPATEAVVPRPEPKAQPAPEAEVSDDMAIDEADVAVEGAEEVDPALEEETVMEETIRVTRAKLRRRAAAEAGA

SEQ ID NO: 5961 - protein, 441 aa, Triticum aestivum
  misc_feature (61)..(61): Xaa can be any naturally occurring amino acid
  misc_feature (309)..(309): Xaa can be any naturally occurring amino acid
  misc_feature (316)..(316): Xaa can be any naturally occurring amino acid
  misc_feature (329)..(329): Xaa can be any naturally occurring amino acid
  misc_feature (357)..(357): Xaa can be any naturally occurring amino acid
  misc_feature (377)..(377): Xaa can be any naturally occurring amino acid
MDEAGRASAPAVVTVTASAAAPSPPPPPPPATATAAAADPPSPDPDALYEEGMWQQMAMSXGATMQSGPYPVRPGEPDCTYYLRTGLCRFGMSCRFNHPQDRNTAIASARMKGEYPERVGQPECQYYLKTGTCKFGPTCKFHHPREKAGIAGMVQLNTLGYPLRPNERECAYYLKTGQCKYGNTCKFNHPEIFNAVASSRGSPIYPPVHNSGSTGPHSYTGTMASWTYPRGSFIPSPRWQSPSNYTPMIVPQGLVQVPSWNSYPPGQMVPVSSPESRLQSPGALPYYGTSRPGEASAGNQGMQSPYRSXSFPAPQXALQRENVSPGRAXSGPECIYEHYIWSGDSKVDAADTFHHPXGVRSQPPPDCILSPMGLPLXRPGEELCKFYSRYGICKFGVNCKFDHPMAAPMGVYAYGYSASASPNAPMGRRLLESPSGSAYAS

SEQ ID NO: 5962 - protein, 327 aa, Triticum aestivum
  misc_feature (26)..(26): Xaa can be any naturally occurring amino acid
SARLQWAGLGATCICEALGSAVAKEXDTMLRAAIPVRQRVAVCIWRLATGEPLRLVSKRFGLGISTCHKLVLEVCGAIKSVLMPRFLQWPDEAAAGRFKEGFERSFGVPGVIGAMYTTHIPIIAPKISVAAYFNRRHTERNQKTSYSITLQGVVGPDRAFTDVCIGWPGSMPDDQVLEKSMLHQRAAAGMMHDACLVGGASYPLMDWVLVPYTHQNLTWTQHAFNEKVGDIRNVAVEAFARLKTRWACLQKRTEVKLQDLPVVLGACCVLHNICEMRREELEPEVPFALFDDDTTPETPVRSETAKQERDSIAHNLLHRGFAGTTFF

SEQ ID NO: 5963 - protein, 186 aa, Triticum aestivum
PGSTILCADGTITLTALSCDPEKGLVRCRCENSALLGERKNVNLPGVIVDLPTLTEKDKVDILQWGVPNKIDMIALSFVRKGSDLQMVRSVLGEHAKSIILMSKVENQEGVANFDDILANSDAFMVARGDLGMEIPIEKIFFAQKVMIFKCNQQGKPVVTATQMLESMIKSPRPTRAEATDVANAV

SEQ ID NO: 5964 - protein, 247 aa, Triticum aestivum
  misc_feature (40)..(40): Xaa can be any naturally occurring amino acid
  misc_feature (47)..(47): Xaa can be any naturally occurring amino acid
MAQPKAVRAAAAAAVPDIAAQLDLASACINGAESMMAAPXCRGEAAXVVVGHRGKGMNALASPDERLREVKENSVRSFNDAARVAGVGYVEFDVQVTKDGCPVVFHDNFIFTEQDGKICGKRVTDLPLVEFLSYGPQKDQDKVGRPLLRKLKDGRTLRWDVRSDEPLCTLREAFEGVDTRVGFNVELKFDDDLVYQEEELVGVLQAILKVVFEHAKDRPVIFSSFQPDAAQLMRRLQDQYPVYFLTV

SEQ ID NO: 5965 - protein, 295 aa, Triticum aestivum
PRPRSPASVVARGPRGRSKTRNGDDDAGAPPPELYTGGERSGMVVRDRSKRKNVADEVFKQAKRKGAKQGPARRQSSSSRSFPGTSRLLTGETVQPDTPQPPEEIVHNIYFGSDGFTRHLRPLRSFNDPEHAAFLESIMKSECPTELAPADGMSKVNVNLIRKEEKCPEPVKRPAPFQGGGRILAAPSENSAPSGISLAAAASSTATTTAPKTITVDDSLPSTSLQIRFADGSRVVGRFNTSHTISDVRAFIYTTRPGETSDYTLQVGFPPKPLDDATKTIEEAGVANSVIIQRV

SEQ ID NO: 5966 - protein, 422 aa, Triticum aestivum
  misc_feature (249)..(249): Xaa can be any naturally occurring amino acid
IVDSRGNPTVEVDLVAGDGSLHRSAVPSGASTGIYEALELRDGDKSVYGGKGVLTAVRNINEVIAPKLVGVDVRNQKDVDAIMLDIDGTENKSQLGANAILGVSLSVCRAGASAKGVPLYKHIQELSGTKELVMPVPAFNVINGGSHAGNNLAMQEFMLLPVGATSFAEALRMGSEVYHVLKGIIKAKYGQDACNVGDEGGFAPNVQDNREGLVLLMDAIEKAGYTGKIKIGMDVAASEFLMKDGSYDXANFKNQPNNGAHVLSAQSLCDLYKEFVKDFPIVSIEDPFDQDDWSSWASLQSSVDIQIVGDDLLVTNPKRIVEAIDKKACNALLLKVNQIGTVTESIQAALDSKAAGWGVMVSHRSGETEDNFIADLAVGLASGQIKTGAPCRSERLAKYNQLVRIEEELGNVRYAGEAFRSP

SEQ ID NO: 5967 - protein, 202 aa, Triticum aestivum
  misc_feature (105)..(105): Xaa can be any naturally occurring amino acid
MAETVFAPCLEGMKHVRSDSGVMLAKPFLDVCKQILPVLDKFGAAMAIVKSDIGGNITRLENKYSSDPSKYEHLYTMVQEEVEKKTAKGSSSCTNGLLWLTRAMXFLVELFRNLLDHPDWTMSQACTDSYTKTLKKWHGWLASSSFTVAMKLAPNKDKFMEVISGTGDIKADIEKFCTTFYPFLKENHDFLASVGLDDMKAS

SEQ ID NO: 5968 - protein, 246 aa, Triticum aestivum
  misc_feature (90)..(90): Xaa can be any naturally occurring amino acid
  misc_feature (240)..(240): Xaa can be any naturally occurring amino acid
MFLSRIVLRDLDSIDSPASMATSKKVVTRDEWERKLRDVKIRKEDMNRLVMNFLVTEGFVDAADKFRVESGTQPDIDLATITDRMEVKKXAVQSGNVQEAIEKINDLNPTILDTNPELYFHLQQQKLIELIRAGKINEALEFAQEELAPRGEENQAFLEEIEKTVALLVFEDVKNCPYGELLDVSQRLKTASEVNAAILTSQSHEKDPKLPSLLKMLIWTQNQLNEKAAYPRINNLSTAXWEDPAI

SEQ ID NO: 5969 - protein, 285 aa, Triticum aestivum
  misc_feature (220)..(220): Xaa can be any naturally occurring amino acid
MAKDIEAAPQGGEFSTKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGPSCSLPVFSATDPKRNARDSHIPVLAPLPIGFAVFMVHLXTIPITGTGINPARSLGAAVIYNKDKAWDDQWIFWVGPLIGAAIAAAYHQYVLRASAAKLGSYRSN

SEQ ID NO: 5970 - protein, 286 aa, Triticum aestivum
  misc_feature (221)..(221): Xaa can be any naturally occurring amino acid
MAKDIEAAPQGGEFSTKDYSDPPPAPIVDFEELTKWSLYRAVIAEFVATLLFLYITVATVIGYKHQSDPTVNTTDAACSGVGILGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATDPKRNARDSHIPVLAPLPIGFAVFMVHLXTIPITGTGINPARSLGAAVIYNKDKAWDDQWIFWVGPLIGAAIAAAYHQYVLRASAAKLGSYRSN

SEQ ID NO: 5971 - protein, 327 aa, Triticum aestivum
  misc_feature (71)..(71): Xaa can be any naturally occurring amino acid
  misc_feature (147)..(147): Xaa can be any naturally occurring amino acid
  misc_feature (167)..(167): Xaa can be any naturally occurring amino acid
IVESVGEGVTELVLGDHVLPVFTSECECAHCKSKESNLCDLLRINVDRGVMIGDGESRFTINGKPIFHFVXGTSTFSEYTVIHVGCLAKINPEAPLDKVCVLSCGISTGLGATLNVAKPKKGDDPRRFCSTPCFCRLKRIMCYNQDXLPCASVSHDQAMEGAKMAWXSRIIGVDLNPAKYEQAKKFGCTDFVNPKDHTKPVQEVLVDATNGGVDRAVECTGHIDAMIAAFECVHDGWGVAVLVGVPHKEAVFKTSPMNLLNERTLKGTFFGNYKPRTDLPEVVEMYMRKELDLEKFITHSVPFSQINTAFDLMLKGEGLRCIMRMDE

SEQ ID NO: 5972 - protein, 168 aa, Triticum aestivum
MAGGGELVVSFGEMLVDFVPTVAGVSLAEAPAFLKAPGGAPANVSIAVARLGGEAAFVGKLGDDEFGRMLAAILRDNGVDDGAVVFDAGARTALAFVTLRADGEREFMFYRNPSADMLLTADELNVDVIKRAAVFHYGSISLIAEPCRSAHLRAMEIAKEAGALLSYD

SEQ ID NO: 5973 - protein, 187 aa, Triticum aestivum
MALVGQAAMVAQFAGVDAYGLIKMIADAAQTVRRNRATCLQLARRAKMIGDLLHQLHAAQLMQQPETRNPMEQLEETLRRALLLVRSCQGRGYLYRCFMGARHADELREVQGEITFYLQLFPLVSYVDTTLTWVRLLNKAAAPEPPSCKEAPVVRPYFVPDEWFLLVSHSGSIPWHCIHMVYILLFL

SEQ ID NO: 5974 - protein, 284 aa, Triticum aestivum
MSSSVGGGGGGGAALAGGDVAGLLDKAKELDQLRKEQDDVATEINKIHKKIISSPEMVDKSVDAMMARLRGFYVQARELSESEVSASSALVGLLDGLLQSGVSAAPRKKIEISEQKKKRMKSDTDTTRFSSASMRSQLDQAANLKGEQVAARVKSDDEKDEWFVVKVIHFDKETKEFEVLDEEPGDDEESAQKFERKYKLPMSYIIPFPKKGDPSSAQDFGQGRQVLAVYPGTTALYRATVASQRKRKSDDYNLLFDDDEEDGNLPERAVPFYRVVALPEGHRQ

SEQ ID NO: 5975 - protein, 141 aa, Triticum aestivum
VKLVFPIDFVTADKFAPDAKTGYATDADGIPDEWEGLDCGEQSSKLFREEILKSKTIVWNGPSGVFEFDAFAKGTKSVLEAVIEATKEGATTIIGGGDTATAALNWDAADKVSHISTGGGASLELLEGKELPGVTALSSKN

SEQ ID NO: 5976 - protein, 202 aa, Triticum aestivum
MAETVFAPCLEGMKHVRSDSGVMLAKPFLDVCKQILPVLDKFGAAMAIVKSDIGGNITRLENKYSSDPTKYEHLYTMVQEEVEKKTAKGSSSCTNGLLWLTRAMDFLVELFRNLLDHPDWTMSQACTDSYTKTLKKWHGWLASSSFTVAMKLAPNKDKFMEVISGTGDIKADIEKFCTTFYPFLKENHDFLASVGLDDMKAS

SEQ ID NO: 5977 - protein, 204 aa, Triticum aestivum
  misc_feature (197)..(197): Xaa can be any naturally occurring amino acid
MPGGGEMPETKQTPKNKACLICIDGWGISPEEDHKGDAIYNAETPVMDKLEKEHPFTSIAAHGLAVGLPDGLMGNSEVGHLNIGAGRVVYQDIVRIDLTMKKKEFGQVENIKNAFERAKSTNGRLHFMGLVSDGGVHGHINHLVSLLEAARDAGVPKSFIHFFGDGRDTAPKSAAGYMKQLLESLDNLQYGKIADVXGRYYAMD

SEQ ID NO: 5978 - protein, 143 aa, Triticum aestivum
  misc_feature (106)..(106): Xaa can be any naturally occurring amino acid
MAATSYSSSSSAAGAGGGGAAAATAAGLKTYFKTPEGRYKLQYEKAHSTAVLHYNHGGKTVSQLTVAYLKERSTGQGSTPSTPSSSSGMRSAAARLLGTGNGRKKXNRALSFVGGNGVCRAVSGRRSGAAWLLGSGNGSRALF

SEQ ID NO: 5979 - protein, 280 aa, Triticum aestivum
GGRTVVVTIHQPSSRLYHMFDKVLLLSAEGRPIYYGRAADSLSYFASVGFASPLSVNPADLMLDLANGILPETNGDGVPGGGSEGEQKEVRGKLADAYARHIAPAVKLDICSHEAASAGGIRRGASRAEWTAGWCAQFSVLLRRGLTERRHESFNKLRIFQVLSVAFLAGLLWWRTPAAHLQDRTALIFFFSVFWGFFPLYNAVFVFPLERPMLLKERSSGMYRLSSYFAARTAADLPMELGLPTAFVLILYWMGGLDPRPASFLLSLLVVLYSVLVAQS

SEQ ID NO: 5980 - protein, 298 aa, Triticum aestivum
MAAPLPRAPVSSPASRAALCPARSNPCTAAAPSSGALGWRRRQPCPVLSIAPGSARSTPAALAVDPKVEALLDSVKWDVKGLAVAIAQNVDTGAILMQGFANKEALAATISTRKATFYSRSRSSLWTKGETSMNFINVHDIFLDCDRDSIIYLGTPDGPTCHTGAETCYYSSVYDALQGSKSNQERQVATTLYSLEDTISRRKEEIVTEGSGKPSWTKKLLLDNQLLCSKIREEAGELIQTLVENEDKSRTASEMADLLYHAMVLLSVRDVKMEEVLEVLRKRFSQSGVEEKASRKKS

SEQ ID NO: 5981 - protein, 236 aa, Triticum aestivum
FVRGVSGGERKKFAFGNEIIINPSLLFLDEPTSGLDSTTALRIVQLLHDIAETGKTVITTIHQPSSRLFHKFDKLILLGRGSLLYFGKTAEAMPYFSSIGCNPLIAMNPAEFLLDLANGNTNDVSVPSELDDKVHMENQNLQDTNSKINLRPSAQDVHEYLVDAYEHRVAYKEKKKLLAPLPISDDMKATITSSKREWGTNWCQQYSILFCRGLKERRHDYLSWMRITQVIATSVI

SEQ ID NO: 5982 - protein, 656 aa, Triticum aestivum
MDSAAAQAQPTHAPADEEEARRRRGTDCVYYLASPLTCNKGSECEYRHSDAARVNPRDCWYWFNGNCANAKCSFRHPPLDDLLGASATPRAPQQPALQVPVPAQAVPPNGTAKPVVPCYYYQKGMCAKGNLCTFSHGPQFAGNPALQPHLQLKNSNSWTKPSNSPQQSTTPAVHGELKVGAQNGRPAQKQNPTSRAYHSPGIYQNQNNNPYVLSGAAKNYQPQRSVQAESAENVMETGEFVREPSAGSSVVAGSVEDAAERSFKEGHTSSYRRASGEQNSGVRRQAHGGYELERSSHRSSSDRLVSERRLTQRDSMPVTAESSDLRHRLLKQRRLNDSRSTQVPDRRDRRYPEDERDSHHRRRGEERAAHDGLSRSRLQGRIKLPGETSLDRLGPHPHLEKERGHRDRLSPPKQTDLRAKLHDRLKARSNEEVPGNLKSSVVKASSGEDAGVVNFSGPKSLAELRAKKAAYRSGENTVKNAGRVARPARMTSEIVAKRDSPDPVPFDGPKPLSVILKRKREAASADSGSMQEEQVAGEEEQSLNNSRIVENDRVEASTEENEVGEEEFHPEDDVMYDDDGLSPADDNTAEAAADVGKEELEEGQQEDLETAAEEEYDYEAADDTNAEGENDYQEYEDDDDLEDDDDFARKVGVLIS

SEQ ID NO: 5983 - protein, 373 aa, Triticum aestivum
MFDDLAGTKSFASTSYWLCAAGFYVLARVQEVADKPIYTWTLHIVSGHTLGHLCAAMVPLFYILLLEKRTRPIQPERHMILVHHQLKLAFMVCLLVPKMICLWMPKLQVSAIMYEISILMWEFSARYVANQAKTSEERGMLETPIRARQIVPRVRGLYGMDIYKNKVLEFLQSERSDESIFGLWGTSGVGKTRLLSLIADSFADSFHHVIFLDGGSSVRVMQNHFAYFLKLDWETISLLEEHYRAKIIMEYLEHVSFLVLLDDVQDEVYPDLTAVGLPMALGHRQKVILTSRSQVACARMGCTISNTLEMKCLGDEDAWSLFEYNAGVKITEADTEIYEYAKKMVSACGGLPRAICAIGIGVAGATCRGKHPR

SEQ ID NO: 5984 - protein, 299 aa, Triticum aestivum
MTVGGEATATAMGHGQTVCVTGAGGYIGSWIVKLLLEKGYAVRGTVRNPDDAKNAHLRGLAGAAERLVLCKADLLDADALRAAIAGCHGVFHTASPVTDDPEEMVEPAVRGTRYVIDAAAESGTVGRVVLTSSIGAVAMDPSRAPDAVVDESCWSDLEFCKKTKNWYCYGKTVAEREAWEAAAARGVDLVVVNPVLVQGPALQPAVNASLTHVLKYLDGSAKTYANAVQAYVHVRDTAAAHVLVFESPAAAGRYLCVADGAVLHREDVVTILRKFFPEYPIPSRSVVLVISHRSERRAS

SEQ ID NO: 5985 - protein, 300 aa, Triticum aestivum
GGPRSQSPPNLAVGAGYIGLEMGSVWNRLGSEVTVVEFAPDIVPSMDGEIRKQFQRMLEKQKFKFMLKTKVVGVDTSGSGVKLTVEPAAGGEQTVIEADVVLVSAGRVPYTAGIGLDAIGVETDKGGRVLVDNRFMTNVKGVYAIGDAIPGPMLAHKAEEDGVACVEFIAGKEGHVDYDTVPGVVYTHPEVASVGKTEEQVKASGVAYQVGKFPLLANSRAKAIDDAEGMVKVISEKETDRILGVHIMSPGAGEIIHEAVLALQYGASSEDIARTCHAHPTVSEALKEACMNTYDKAIHM

SEQ ID NO: 5986 - protein, 94 aa, Triticum aestivum
PTRPPTRPPTRPACDNTGLKTFFFPCGTFSRIASIAKNKPMSSGEACNDIMAYSLILSCCCYTCCVRRKLRQRLNIAVHIPGHLNLLVSVGLYP

SEQ ID NO: 5987 - protein, 313 aa, Triticum aestivum
  misc_feature (174)..(174): Xaa can be any naturally occurring amino acid
DPRVRFKNEWGTAMYPVVPGHEILGVVTSVGAGVSKFKAGDTVGVGYFVGSCRSCECCGNGYENYCSGMVLTSNGIDPEHGGAVTQGGFSDVMLVNEDYVVRVPDGLPLDKAAPLLCAGVTVYSPMMRFGLNAPGKHLGVVGLGGLGHVAVKFGKAFGMRVTVISTSPGKREEXALERLGADEFLVSRDPEQMQAAVGTMDGILDTVSAWHPISPLFALMKPMGQMVFVGGPTKPLELPAYAIVPGGKGIAGNCVGGIRDCRAMLEFAAKHGITAEVEVIKMDYVNTALERLAKNDVRYRFVIDVAGSLGSTS

SEQ ID NO: 5988 - protein, 122 aa, Triticum aestivum
MGSEADAAEMKGPLLAGVPAAAEVVPPWREQLTVRAIVVSAILGVLFCLVTHKLNLTVGIVPSLNVAAGLLGYCLVRTWTAALGMFGVVSKPFTKQENTVIQTCVVACYSLAELDDRVYVSS

SEQ ID NO: 5989 - protein, 109 aa, Triticum aestivum
  misc_feature (11)..(11): Xaa can be any naturally occurring amino acid
MIEVVLSDRLXGTKVLVKWSDDNTSSDITKLVAAHTGTTADMIRIQKWYTIYKDHITLSDYQITKGRGPNSTTTSVITPAIAGPSPIVPVMSVGCIPVPMSSQLDVWAE

SEQ ID NO: 5990 - protein, 428 aa, Triticum aestivum
QHFEATIKSITTHNQGQAKASLPAGCRGRPRRMQRSAWGSLLGSCLGGGGGKTGKQVRPGPGPRKRESSAAAGAGQRLSFTDVMSAASEQELSVSLVGSNLHVFTVAELKAATQGFLDDNFLGEGGFGPVYKGAVDDKVKPGLKAQPIAVKLWDPQGAQGHKEWLSEVIFLGQLRHTNLVKLIGYCCEDENRLLVYEYMAKGSLENHLFKKFPPVLSWSTRLNIAVGAAKGLAFLHDAEKPVIYRDFKASNILLDPDYKAKLSDFGLAKDGPEGDETHVSTRVMGTHGYAAPEYILTGHLTAKSDVYSFGVVLLEILTGRRAVDKTRPSREHHLVQHMRSWLKDPEKLGKIMDPALEGKYATTAAHKAALVAYQCLSGSPKSRPDMSKVVEDLELLLNLVDDVPGEPVMHVASQDDTRKERTRRRNGE

SEQ ID NO: 5991 - protein, 189 aa, Triticum aestivum
GHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSADDSNNNSNNRNDDASMGLNARDGSDNGSGTQSSRTKRAVEIDSPQDMSPDQSVDPPDSTCAHVSHLKSEICSNR

SEQ ID NO: 5992 - protein, 324 aa, Triticum aestivum
MPRYDERDRYGGNTRLYVGRLPSRTRTRDLEDLFGRYGRVRHVDMKHEFAFVEFSDPRDADEARYNLDGRDFDGSRMIVEFAKGVPRGQGGGGDRDRGGRGGDREYMGRGPPPGSGRCFNCGIDGHWARDCKAGDWKNRCYRCGDSGHIERDCQNSPKNLKRGKSYSRSPSPRRGRVRDRSYSRSRSRSYSRSVSPRRDERRSRSPRDSRSPRRSPRDSLSPRRSPRNSRSPMKSPRGSRSPMRSPRDSRSPRRSASPAKGRARSPTPPGSRSPAPRDNSRSPMKADSPKNMSPAANGRSLSPRDGEDNGHHRAPSGSASPGGG

SEQ ID NO: 5993 - protein, 87 aa, Triticum aestivum
  misc_feature (13)..(13): Xaa can be any naturally occurring amino acid
  misc_feature (33)..(33): Xaa can be any naturally occurring amino acid
VDRLFKLTEGAKXKEKIDKMFKGEKINTTEKQXLLKVALKPPENASITIDGVNLAPEFGAVKDKIRQFPKTFRIGPWVGATGKPLTN

SEQ ID NO: 5994 - protein, 367 aa, Triticum aestivum
  misc_feature (131)..(131): Xaa can be any naturally occurring amino acid
  misc_feature (304)..(304): Xaa can be any naturally occurring amino acid
  misc_feature (310)..(310): Xaa can be any naturally occurring amino acid
MPRYDDRYDRYDDRYDRYDDRFDRYNDRYDRYDRYGGNTKLYVGHLSTHTRTKDVEYLFGRYGRIRCVELKYDYGFVEFSDPRDADDARYELDGQEVDGSRIIVEFARGTPRGPGGSREYLGRGPPPGSGXLCFNCGIDGHWARDCKAGDWKNRCYRCGDSGHIERDCQNSPKNLKRGKSYSRSPSPRRGRVRDRSYSRSRSRSYSRSVSPRRDERRSRSPRDSRSPRRSPRDSRSPMKSPRGSRSPMRSPRDSRSPRRSASPVKGRARSPTPPGSRSPAPRENSRSPMKADSPNNMSPAANGXRSPSPXDGEDNGNHRAPMWKCLTWWSVEMDQNPFQCSPSGRASPGEGREMDHILPTVMKLKHV

SEQ ID NO: 5995 - protein, 159 aa, Triticum aestivum
MDATATGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTAEKEGQAPKSPKKAAKSPKKAATPKKA

SEQ ID NO: 5996 - protein, 285 aa, Triticum aestivum
  misc_feature (267)..(267): Xaa can be any naturally occurring amino acid
MAKEVSEEPEHAAPAHKDYSDPPPAPLFDMGELRMWSFYRALIAEFVATLLFLYITVATVIGYKVQSAADPCGGVGVLGIAWAFGGMIFVLVYCTAGISGGHINPAVTFGLLLARKVSLLRAVMYIVAQCAGGIVGAGIVKGIMKDAYQANGGGANMVASGFSRGTALGAEIVGTFVLVYTVFSATDPKRSARDSHVPVLAPLPIGFAVFMVHLATIPITGTGINPARSLGAAVIYNKKAAWDNHWIFWVGPFVGALAAAAYHQYIXLRAAAIKALGSFRSSRSN

SEQ ID NO: 5997 - protein, 175 aa, Triticum aestivum
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 5998 - protein, 203 aa, Triticum aestivum
  misc_feature (171)..(171): Xaa can be any naturally occurring amino acid
MAEPGVPLPGWEGMKHVRSDSGVMLAKPFLDVCKQILPVLDKFGAAMAIVKSDIGGNITRLENKYSSDPTKYEHLYTMVQEEVEKKTAKGSSSCTNGLLWLTRAMDFLVELFRNLLDHPDWTMSQACTDSYTKTLKKWHGWLASSSFTVAMKLAPNKDKFMEVISGTGDIXADIEKFCTTFYPFLKENHDFLASVGLDDMKAS

SEQ ID NO: 5999 - protein, 145 aa, Triticum aestivum
  misc_feature (9)..(9): Xaa can be any naturally occurring amino acid
  misc_feature (11)..(11): Xaa can be any naturally occurring amino acid
  misc_feature (27)..(27): Xaa can be any naturally occurring amino acid
  misc_feature (34)..(34): Xaa can be any naturally occurring amino acid
  misc_feature (36)..(36): Xaa can be any naturally occurring amino acid
  misc_feature (56)..(57): Xaa can be any naturally occurring amino acid
  misc_feature (95)..(95): Xaa can be any naturally occurring amino acid
FGAAFIMLXPXKYAAMLAEKMQTYGAXTGWLSNXGXGPGGRYGVGKRIKLPYTRKXXDAIHSGELLTANYQKTEVFGLEIPTAIEGVPSEILDPXINTWTDKAAYKETLLKLAGLFGKNFEVFASYKIGEDSTLTEEILAAGPKV

SEQ ID NO: 6000 - protein, 392 aa, Triticum aestivum
PAGSEYPHPLSSLLLPPPPLIDQEELQLSAMEPIPLLTPYKMGQFDLAHRVVLAPLTRQRSYGNVPQPHAAVYYSQRATAGGLLIAEATGVSDTAQGYTDTPGIWTAEHVEAWKPIVAAVHAKGALFFCQIWHVGRVSTFELQPGGAAPLSSTEKGVGPQMSFDGRLEEFAPPRRLTVEEIPAIVDDFRKAARNAIDAGFDGVEIHGANGYIIEQFLKDSANDRTDEYGGSLENRCRFALEVVDAVVKEVGGHRVGIRLSPFTDYMDCHDSDPHSLALYMSTKLNDHGILYLHMVEPRMAIVDGRRVVPKRLLPYREAFKGTFMANGGYDREEGGKVVADGYTDLVSFGRPFLANPDLPKRFEVGAELNKYDRMTFYTSDPVVGYTDYPFLD

SEQ ID NO: 6001 - protein, 310 aa, Triticum aestivum
  misc_feature (266)..(266): Xaa can be any naturally occurring amino acid
MRAPMRGGGGRGGGRGFGDSGGRGGRGRGFGGRSDGGGRSGGRGFGGRSAGRGGRGGGRGGGRGGPSMKGGAKVVVVPHKHDGVFIAKAKEDALCTKNMVAGESVYGEKRVSVQNEDGSKVEYRVWNPFRSKLAAAVLGGVDNIWIAPGTRVLYLGAASGTTVSHVSDIVGPTGLVYAVEFSHRSGRDLVNMAKKRTNVIPIIEDARHPAKYRMLVGMVDVIFSDVAQPDQARILALNASYFLKNGGHFVISIKANCIDSTQAGRXAVFASEVEKLKADQFKPSEQVTLEPFERDHACVVGGYRMPKKQK

SEQ ID NO: 6002 - protein, 159 aa, Triticum aestivum
MDATATGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPNINPVLLPKKTAEKEGKAPKSPKKAAKSPKKAATPKKA

SEQ ID NO: 6003 - protein, 145 aa, Triticum aestivum
  misc_feature (73)..(73): Xaa can be any naturally occurring amino acid
  misc_feature (76)..(76): Xaa can be any naturally occurring amino acid
MASTATCEAPMQGLKYTDGLPVSRRSNSASLGSDSNGGRIRSMQEWPIEGIKKFETLSYLPPISTEALLKQVXDYXRSSSKWERCLDDSKAGHMTREHNASRGYYKRRNWTMWKLPMIGSTDATQVINEDEEGKKENPDANVRII

SEQ ID NO: 6004 - protein, 149 aa, Triticum aestivum
MHSTNLLLEEPIRMVSILEPSKPNFFPAMTKIVGTLGPKSRSVEAISACLKAGMSVARFDFSWGDAAYHQETLENLKLAIKATKKLCAVMLDTVGPELQVVNKSEVTISLEENESVVLTPHKGQEASSKLLPINFAGLAKAVKPGATIF

SEQ ID NO: 6005 - protein, 309 aa, Triticum aestivum
  misc_feature (90)..(90): Xaa can be any naturally occurring amino acid
KESTALVTANPHRLAVGHPVPHPPDSSPLPRRGQNPTPRSSQLPRSRNPRRHRGHGEGAPLLPAPGGLQPLHTGPPPPPYPRARRLPATXFAPPRPSTSSAANPLPFMSFDIPAQSNSTPPIFTGPIGGSSASFEDEPPLLEELGINTRQIWRKTLSILHPLRSADPSLHADADLSGPFLFLLSFGLFQLLAGKFHFGIVLGWVTVASLFLYFVFSMLSGGRRGDLDLYRCVSLVGYCMLPMVIFSAVSLFLPRGGGLIFGMGMGFVLWSTRVCTRLLAELASSGDEHRGLIAYACWLVYMLFSLLVIF

SEQ ID NO: 6006 - protein, 361 aa, Triticum aestivum
  misc_feature (161)..(161): Xaa can be any naturally occurring amino acid
  misc_feature (257)..(257): Xaa can be any naturally occurring amino acid
TPQSYLPTLPFRVSIPSRRRRRRRKEHGEMSSGMGKVVCVTGASGYIASWLVKLLLHRGYTVRATVRDTADPKKTLHLQALDGAKDRLHLFKASLLEEGSFDAAIAGSDCVFHTASPFYHNVKDPKAELLDPAVNGTLNVLRSCKKASIKRVIITSSMAAXVAYNGKPRTPDVVVDETWFSSAEVCEKNEQWYVLSKTLAEEAAWKFANDNGFEIVTINPAMVIGPLLQPTLNTSAEAILKFINGSSSTYPNFSFGXGINVKDVALAHILAYEVPSANGRYCMVERVAHHSEIVKIIHEMYPKFPVPDKCADDAPFVPIYQVSKDKIRSLGMELIPLETSLKETIESLREKGFVTSESSHL

SEQ ID NO: 6007 - protein, 365 aa, Triticum aestivum
  misc_feature (76)..(76): Xaa can be any naturally occurring amino acid
SALHSTVQLPILSSRVPSLQPKQSTTQPPPEEHEEMGSGTGKVVCVTGGSGYIASWLVKFLLQRGYTVRATVRDTXDPKKTLHLQALDGAKDRLHLFKASLLEEGSFDAAVAGCDCVFHTASPFYHNVKDPKAELLDPAVDGTLNVLRSCKKASIKRVIVTSSMAAVAYNGKPRTPDVVVDETWFSSAEVCEKNKQWYVLSKTLAEEAAWKYANDNGLEIITINPTMVIGPLLQPTLNTSTEAILKFINGLSSTYANFCFGWINVKDVALAHILAYEVPSANGRYCMVERVIHHSDLVKIIHEMYPEFPVPDKCADDAPFAPIYQVSKDKIRSLGMELTPLETSLKETIESLKEKGFVTSESSHL

SEQ ID NO: 6008 - protein, 369 aa, Triticum aestivum
  misc_feature (138)..(138): Xaa can be any naturally occurring amino acid
  misc_feature (175)..(175): Xaa can be any naturally occurring amino acid
  misc_feature (265)..(265): Xaa can be any naturally occurring amino acid
SARGLKYRYSGSGGTPTRSRGGDMESGSSQDMGNRFSYEELEEATDSFNENRELGDGGFGTVYKGYLGDGRVVAVKRLYNNSYRRVEQFVNEAAILARLRHPNLVMFYGCTSKESRELLLVYEFVQNGTVADHLHGPXRAAERALPWPLRLSIAVESAAALTYLHAIEPPIVHRXDVKTNNILLDTDFHVKVADFGLSRLFPLDATHVSTAPQGTPGYVDPEYHQCYQLTDKSDVYSFGVVLVELISSKPAVDITRQRNEINLGXMAISKIQKCRLEELVDVELGYESDPAARKMMTMVAELAFRCLQQNGEMRPPIREVLDVLRAIQDDCLGHKDGGGKGKKDFAEPFSPNTVHAPWDSRNTTPNTSQ

SEQ ID NO: 6009 - protein, 104 aa, Triticum aestivum
  misc_feature (58)..(58): Xaa can be any naturally occurring amino acid
  misc_feature (80)..(80): Xaa can be any naturally occurring amino acid
  misc_feature (89)..(89): Xaa can be any naturally occurring amino acid
MAPTVMAWSDTSVAPFQGLKSTAGLPVSRRSNGASLGSVSNGGRIRCMQVWPIEGIKXIRDLSYLPTLNKEASSSKSTNXFAPNWVPCXSSTKVGSTSVNGMPV

SEQ ID NO: 6010 - protein, 156 aa, Triticum aestivum
  misc_feature (110)..(110): Xaa can be any naturally occurring amino acid
MEASGAAAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLXGVTIAHGGVIPKINPVLLPKRTAEKEGKEPKSPKKATKSPKKTTKA

SEQ ID NO: 6011 - protein, 38 aa, Triticum aestivum
RRQEGNAAGNGFLLLDSEFNVKGRWEKPGHSPLFGYDF

SEQ ID NO: 6012 - protein, 170 aa, Triticum aestivum
PIQRNRRQHHSSRVLAAGEAASKMAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPKKSPAAAEKEAKSPKKKTAAKSPKKKTAATKE

SEQ ID NO: 6013 - protein, 514 aa, Triticum aestivum
MANIDMAAVLADMDRDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLSVLSCDPAAGTVRCRCENTAMLGERKNCNLPGIVVDLPTLTEKDKEDILGWGVPNDIDMIALSFVRKGSDLVTVRQLLGQHAKRIKLMSKVENQEGIVNFDDILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNDAVFKEMIKAAPLPMSPLESLASSAVRTANKARATLIVVLTRGGTTAKLVAKYRPRVPILSVVVPVLTTDSFDWTVSSEGPARHSLIYRGLIPLLAEGSAKATDSESTEEILQAALKSAVKKQLCKAGDAVVVLHRIGVASVIKICTVK

SEQ ID NO: 6014 - protein, 191 aa, Triticum aestivum
MSKKKKKKKNLGRGPVCTEPPNPPLAGVPARSEQARKMDGSKLKKVAGKKFGGPRKKSVTKSIKAGLQFPVGRIGRYLKKGRYAQRVGSGAPVYLAAVLEYLAAEVLELAGNAAKDNKKTRIVPRHLLLAILNDQELGRLLSGVTIAHGGVIPNINPVLLPKKAAEKAEKAGTAAKSPKKATKSPKKATKA

SEQ ID NO: 6015 - protein, 198 aa, Triticum aestivum
MARISNWSLVFLLISTLLHIEPSLSSPSPSPSPSPFIKSSCSSTQYPALCVSSLSVYASSIQQDPHQLVQTALSLSLNRTQATKTFVANCNKFRGLKPREHAALKDCAEEISDSVDRLSRSLKELKLCKVKGEDFTWHISNVETWVSSALTDESTCGDGFSGKALNGKIKDSIRARMLNVAQVTSNALSLINHYAAQH

SEQ ID NO: 6016 - protein, 300 aa, Triticum aestivum
TSLYKKAGWYRSGIPGISSTHASAAFASYALGSPSSFLALVDTYDVMRSGIPNFCAVAPARRPGGYKASGIRLDSGDLAYLSIETRKVFHAIEKEFNIPGFGKMIITASNDLNEETIDALNKQGHEVDAFGIGTYLVTCYSQAALGCVFKLVEINSRPRIKLSEDVAKVSIPCKKRCFRLYGKEGYPLVDIMIRESEPSPKAGERILCRHPFLESKRAYVVPQHVEELLHCYWPGSSDKPRAELPPLLKIRSRCMQQLEKLRPDHIRRLNPTPYKVSVSAKLYEFIHYLWLNEAPVGELQ

SEQ ID NO: 6017 - protein, 81 aa, Triticum aestivum
MERILYDNHNSLCRVSGQLFPLSPLELQAVRGIRRKHEADSHEGCSFKRRRGAQLHPSPFERSYSAVSPIPSQAGDGMDLS

SEQ ID NO: 6018 - protein, 96 aa, Triticum aestivum
MADAGEEPHHVSEPLDLVRLLLNEVVFVKLRGDRELKGKLHAYDSHCNLVLGEVEETIYTVDEDDDDDELKTISRKSEMLFVRGDSVVLISPGVPF

SEQ ID NO: 6019 - protein, 129 aa, Triticum aestivum
  misc_feature (114)..(114): Xaa can be any naturally occurring amino acid
  misc_feature (116)..(116): Xaa can be any naturally occurring amino acid
MGTRGLAVLLLAAGLLQALLPASEAEGLVRNALKKRHIDRNSRDAGSLSGREEGQHHLIGGASTLRSEEEGDIVSLKNYMNAQYFGEIGVGTPPQKFTVIFDTGSSNLWVPSAXKXYFSIACYLHARYK

SEQ ID NO: 6020 - protein, 549 aa, Triticum aestivum
  misc_feature (129)..(129): Xaa can be any naturally occurring amino acid
  misc_feature (362)..(362): Xaa can be any naturally occurring amino acid
MGTRGLAVLLLAAVLLQALLPASEAEGLVRIALKKRHIDRNSRVAASLSGREEGQHHLIGGANTLRSEEEGDIVSLKNYMNAQYFGEIGVGTPPQKFTVIFDTGSSNLWVPSAKCYFSIACYLHARYKXAGASSTYKKNGKPAAIQYGTGSIAGYFSEDSVTVGDLVVKDQEFIEATKEPGVTFLVAKFDGILGLGFKEISVGKAVPVWYNMVEQGLISDPVFSFWLNRHADDEGEGGEIIFGGMDPKHYVGEHTYVPVTQKGYWQFDMGDVLVGGKSTGFCAGGCAAIADSGTSLLAGPTAIITEINEKIGAAGVVSQECKTIVSQYGQQILVLLLAETQPKKVCSQVGLCTFDGTRGVSXTDTWNIPKAFFHYAVIAARIVLLTSMAHFPIVHLCEHSAGIRSVVDDEPVKSNGLRTDPMCSACEMAVVWMENQLAQNKTQDLILDYVNQLCNRLPSPMGESAVDCASLGSMPDIEFTIGGKKFALKPEEYILKVGEGAAAQCISGFTAMDIPPPRGPLWILGDVFMGPYHTVFDYGKLRVGFAKAA

SEQ ID NO: 6021 - protein, 426 aa, Triticum aestivum
  misc_feature (409)..(409): Xaa can be any naturally occurring amino acid
  misc_feature (417)..(417): Xaa can be any naturally occurring amino acid
  misc_feature (422)..(422): Xaa can be any naturally occurring amino acid
KEMIVSMAVAGAIIGAAVGGWANDRFGRRTSILVADLLFFAGAVVMASATGPVQLVVGRVLVGLGVGMASMTAPLYISEASPARIRGALVSTNGFLITGGQFLSYLINLAFTKAPGTWRWMLGVAGLPAVFQFVLMLFLPESPRWLYRKGRVEEAEAILRKIYTAEEEVTREMQELKESVEAEARERGSSERVSLTALVKTPTVRRALVAGVGLQVFQQLVGINTVMYYSPSIVQLAGFASNQTALALSLVTSGLNALGSIVSIYFIDRTGRRKLLVISLVGVIASLALLSAVFHQDHHTLARRRQAPRPDTSMAPSHARATGRAAPAGTAPGASRPSSTGCGFCASGAGKQAAPGRVPAVERDGARRVPRRGATVVHARLPEPIRLAGDVRAGSVHRLLLPREMGHGXLDRQLKRXNRWRXPRVF

SEQ ID NO: 6022 - protein, 99 aa, Triticum aestivum
MPRAEVAFAMHAGDGEVEAGFAKLQGEDFEYYMQTYSIMLGRSSKKSMVDVDLSSLGGGMNISRHHARIFYDFQRRRFALDVIGKNGCHVEGVLHLPGN

SEQ ID NO: 6023 - protein, 56 aa, Triticum aestivum
ILKAGEGPAAQCNRGFPAMDIPPPRGPLWNQGDVFMGPNHTVLDNGKLRVGFAKAA

SEQ ID NO: 6024 - protein, 347 aa, Triticum aestivum
  misc_feature (130)..(130): Xaa can be any naturally occurring amino acid
MGYDGAPSPASAAARDAKKKRGNRSSAKLKQCKLDARREQWLSQVKDGKEATAKPLPAGAGSGAGSNAGSPILASPHPPLPRRRADARSRGGVLEDDKEDAGATGQEVGGSDLDSPMHSPCSDNSRGGGXLQSKRCSSNGGGPSLSSVSSLWSSSRSVSDAEDDDTGSGPEEENGVLDDWEAVADALSVDDNSHCHQSLGTTMPPAATSESAPLANTSKRTEPIRSNARAWTPDDTFRPQSLPSISKQSSFPARIGNCWGMGMSAAHQSILSMPLSCPICYEDLDPTDSSFLPCPCGFHLCLFCHKRILEADARCPGCRKLYNAGSAGEGAPAPVRLSRSCSMGPRH

SEQ ID NO: 6025 - protein, 160 aa, Triticum aestivum
VTFQSYRANLIYQVYFLTVGGTQLHADARRNSLEEAVRLCRAGGLQGIVSEARAVFRHPSAVARVKESDLSLLTYGQLNNVPEAVYMQHLMGVDGVIVDLVQEIAEAVSEFAAVVAPEPSPEEGQAGRLGLDRAAPAKKTPNFSQREISFLLRLIPELVQ

SEQ ID NO: 6026 - protein, 513 aa, Triticum aestivum
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIENDLAQLREQGVDARIASGGGRMYVTMDRFENDWSVVKRGWDAQVLMELPHKFRMLLDAVEDSNSRAADHGNAEDMVKRNKAGQPMLDKSGSIQILTSHTLQPVPVAIGGPGLHPGVRFRIGMYTPGLTNTVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGQPMLDKSGSIQILTSHTLQPVPVAIGGPGLHPGVRFRSDIQTPGLANVAATVMNLHGFQAPADYETTLIEVVDK

SEQ ID NO: 6027 - protein, 314 aa, Triticum aestivum
HAAPQRAGATRPGGCAPPHLCSAAVKTNSTCKMESNSDAAQIKQGSNGSSNNNDMGSSTKNAIAKPCTDRERVMSPSLVKSNQQTSAFHPVQHQVSPADAARKDKASEEIVNAVKVGHSSEAQQSSVQHHHHAHYYRHVIAQQQTLIDRASNARCGSSNASDLPLEGHAANYGVNGSISGSNNGSNTQNASSSAPNIARPNMDSGAMDKTEAGGGNGSGSGPSGSGNDMVCQNQLSQREAAVNKFRQKRKERNFGKKVRYQSRKRLAEQRPRVRGQFVRQSGPAAVAGAPVQMTRPSLLVHCSVCYIYIVIDSH

SEQ ID NO: 6028 - protein, 446 aa, Triticum aestivum
  misc_feature (359)..(359): Xaa can be any naturally occurring amino acid
MAKGMPAVGWAARDTSGVLSPYSFSRRSSSSIHSVPVPIMPLCFLRQSDEFPYVMHDSRALKDDDVTIKVLFCGLCHTDLHIAKNEWGNALYPVVPGHEIVGVVTDVGPGVKNFKAGDTVGVGYFIDSCRSCVSCGSGHENHCPTLVLTSNAVDYDGATTQGGFSDVLVVDQGYVVRVPEGLPLDGAAPLLCAGVTVYSPMMEFGLNAPGKHLGVVGLGGLGHMAVKFGKAFGMTVTVISSSPRKREEAVERLGADAFLVSQDSEQMKAAAGTMDGIIDTVSAGHPIVPLLELLKPRGQLVVVGAPSTPLELPAYAIIGGGKRVAGNLVGSVASCQAMLDFAGKHGITADVEVVKMDYXQYGGRAAGEERREIPLRHRRRRQPAGRRRLVLPNTPYACRPLWLPTSFQPREVVICCFILTNGLVRAIAFEIIGAIFRAKKKKKKDI

SEQ ID NO: 6029 - protein, 143 aa, Triticum aestivum
  misc_feature (9)..(9): Xaa can be any naturally occurring amino acid
LLLLGRGSXQHATALEGALKIKEISYLHCEAVMSGELKHGVLALVDENLPIVMILTRDDIFAKSLNAYQQVIARSGRPIIICNENDPEFPTDKTDKIEVPKNVDVLQGLINVVPLQLMSYWMAVAEGVNVDMPRNLAKSVTVE

SEQ ID NO: 6030 - protein, 486 aa, Triticum aestivum
LIPSPANPRFPGPSLPYALGAALPRPAQHRWLIDSWPPACGKVRRRRRPRGTRWTITTSRTARWTSTSTAGGDGSRSDGEGDDEYALLTRITDTSAAEARAGKDIQGIPWERLQITRQDYRKARLEQYKNYENFPQSGELMDKLCKQVESSSKYYEFQYNTRIVKPSILHFQLRNLLWATSKHDVYFMSNSTVGHWSSLSHKMTDVLDFSGHVAPAKKHPGCALEGFTGVQVSTLAVNEGLLVAGGFQGELVCKSLGERDVKFCTRTTLSDNAITNAMDIHRSTSGSLRITVSNNDSGVREFDMERFQLLNHFRFNWPVNHTSVSPDKKLLAVVGDDRDALLVDSRNGKVTSTLVGHLDYSFASAWHPDGVTFATGNQDKTCRVWDIRNPSTSLAVLRGNIGAIRCIRYSSDGRFLLFSEPADFVHVYSAAECYRKRQEIDFFGEISGISLSPDDESLFVGVCDRVYASLLNYRMVHANGYLDSYM

SEQ ID NO: 6031 - protein, 555 aa, Triticum aestivum
  misc_feature (39)..(39): Xaa can be any naturally occurring amino acid
  misc_feature (79)..(79): Xaa can be any naturally occurring amino acid
  misc_feature (165)..(165): Xaa can be any naturally occurring amino acid
  misc_feature (170)..(170): Xaa can be any naturally occurring amino acid
  misc_feature (237)..(237): Xaa can be any naturally occurring amino acid
MAVEAHDDAIHQTPLHALMKHADRGEAIKAEYKADILVXWRKQDTTETVEELLKLAEAANLKVKIDKMFKGVKINTTEXNRSVLHVALRAPRDAVINSDGVNVVPEVWAVKEEISLVSATYRRGSCIGASEKTPTKASTPAMHVCFIRFLVVKPSTPYDPDTASXSSKLXRFSSPTKKCNLRLRLIIDKPRLSLWHNKFSSFFLATCYNQSGCTSILKFLLLQLGERQVNYRVIINXFFSLSRQFGIDPNNAFAFWDWVGGRYSVCSAVGVLPLSLQYGFPIVQKFLEGASSIDNHFHTSSFEKNIPVLLGLLSVWNVSFLGYPARAILPYSQALEKLAPHIQQLSMESNGKGVSIDGVRLPYEAGEIDFGEPGTNGQHSFYQLIHQGRVIPCDFIGVIKSQQPVYLKGETVSNHDELMSNFFAQPDALAYGKTPEQLRSEKVPENLISHKTFQGNRPSLSFLLSSLSAYEIGQLLSIYEHRIAVQGFIWGINSFDQWGVELGKSLASTVRKQLHASRMEGKPVEGFNPSSASLLTRFLAVKPSTPYDTTVLPKV

SEQ ID NO: 6032 - protein, 247 aa, Triticum aestivum
MASPALISDTDQWKALQAHVGAIHKTHLRDLMTDADRCKAMTAEFEGVFLDYSRQQATTETVDKLFKLAEAAKLKEKIDKMFKGEKINTTENRSVLHVALRAPRDAVINSDGVNVVPEVWAVKDKIKQFSETFRSGSWVGATGKPLTNVVSVGIGGSFLGPLFVHTALQTDPEAAECAKGRQLRFLANVDPVDVARSIKDLDPATTLVVVVSKTFTTAETMLNARTIKEWIVSALGPQAVSKHMIAV

SEQ ID NO: 6033 - protein, 478 aa, Triticum aestivum
  misc_feature (7)..(7): Xaa can be any naturally occurring amino acid
IRHEAPXRLQDNADHVDKSEETTPRPKLKPLHWDKVRASSDRAMVWDQLKSSSFQVNEEMIETLFICNPANAAPKEATKRPALPTPKAENKVLLDPKKAQNIAILLRALNVTKEEVCEALCEGNTQNFGADLLETLLKMAPTKEEEIKLREFKEETSPIKLGPSEKFLKAVLDVPFAFKRVDAMLYIANFESEVKYLKNNFEILEAACDELRNSRLFLKLLEAILKTGNRMNVGTNRGDAHAFKLDTLLKLADVKGTDGKTTLLHFVVQEIIRTEGSRLSASNQSTPRTLANPLRDELECKKLGLQVVAGLGNELSSVKKAAAMDSDVLSSYVAKLAGGIEKITEVLRLNEELNTRDDAWRFHDTMQKFLKKADDEILRVQAQESVALSLVKEITEYFHGDSAKEEAHPFRIFMVVRDFLSVLTQVCREVGRINDRTIASSVRHFPVPVNPMMPQLFPRIHALRAGISDDESSVASSP

SEQ ID NO: 6034 - protein, 152 aa, Triticum aestivum
  misc_feature (151)..(151): Xaa can be any naturally occurring amino acid
MATRTTAHGAAGDDEVAEAAGPALRHRHGHAGKGAGEAANGGASPEDASVEQVFADKAVPSWREQLTVRALVVSALLAVMFSVIVMKLNLTTGIIPSLNVSAGLLGFFFVRLWTNAFERMGLVGHPFTRQENTVIQTCVVSAYGIAFSGGXG

SEQ ID NO: 6035 - protein, 306 aa, Triticum aestivum
TRPRTRGSRKGFSILGFIQKQMARILSLDYQLDCLDYGDEKWQHADLDYETFKLLQQGHTFGKPKGQMKTERGESFLTFAVDMTLKSTKALVQPTSPDGLDFWRSKLLWASRVLPMPLIGLFVITGLCLPVDKQDGYPELEALSKLDLGAALKIFLAKQLTSDFNAMTAPAEDKSVIIGERNRVATEKIKGAINRGYKRIAVLYGGGHMPDLGRRLREELDMVPSNVQWVTAWSIRSRELDKKSLPFLKTMAEVSGWPLNRYETLALLIFSSVLAVDLWFWEFLVESSLNWASLAGSWIDQFSAPF

SEQ ID NO: 6036 - protein, 414 aa, Triticum aestivum
  misc_feature (102)..(102): Xaa can be any naturally occurring amino acid
  misc_feature (113)..(113): Xaa can be any naturally occurring amino acid
DGNCFSADPEHQHEANYCQQPYEGRRSGKDFGLVVTIVGIVLIVLVLSLLLVASNKRNCQRVTAEQQLLQKQMQDNSTPGMSSELLESARYISQAVKFGSQXMPTHRVFSLEXLKEATKCFERSAFLGEGSIGKLYKGKLENGTVIAIRCLALHQRYSIRNLKLRLHLLAKLRHPNLVCLLGHCIDNAVDESSVKRVFLVYEYVPNGTLSSYLSGSTPEKTLKWCDRLHVLIGIARAVHFLHTGIIPGSLYNRLKTSNILLDEHHIAKLSDYGLSMITEEIYKHEAIGEGQRYIQNNAEELETLQDDVCSFGCIILEALMGSKLHRKGDPFILSELVMSLSCQEEREHVLDPVVLGTSSQDSLSMVVSITIKCLSVESSTRPSIEEVLWNLQYAAQVQATADGDLRSEVSSQAC

SEQ ID NO: 6037 - protein, 481 aa, Triticum aestivum
MSSAPLLGAREHSSECGEVKRGSPAWLRLLIDTEEAWAQLQFALPMVLTNMSYYAIPLVSVMFSGHLGNVHLAGATLGNSWATVTGYAFVTGMSGAMETLCGQAYGARMYRLLGLYLQSSLIMSAMVSVLISVVWLFTEPILLSLHQEPEVSHAATVFIRYQIPGLFAYSFLQCLLRYLQTQSIVVPLVVCSMVPFALHIALNYLLVNVVGLGLTGASLAISATFWVSCLMLLAYVMWSTEFDETWKGFSTDALNYLLPTIKLAMPSAIMVCLEYWAIELLVLLAGLLPNSTVSTSLIAICASTQAVSYMITYGFSAAVSTRVSNEVGAGNVDRAKNAVTVTMKLSVFLALSFILLLIIGHGLWASLFTGSAMIAAKFAAITPLLMISIVLDSTQGVLSGVARGCGWQHLAATTNLVAYYLAGMPVAILLAFKLNLYTHGLWLGLITGLACQTSVMVIITLRTKWSKLVDAMVKNRDDYVA

SEQ ID NO: 6038 - protein, 307 aa, Triticum aestivum
MRPPARGGRGGRGFGGRSDGGGRGGRGFGGRSDGGGRGGRGGRGGRTPRGRGGRGGGGRGGAGMKGGSKVVVVPHKHDGVFIAKAKEDALCTKNMVAGESVYGEKRVSVQNEDGTKVEYRVWNPFRSKLAAAVLGGVDNIWIAPGARVLYLGAASGTTVSHVSDIVGPTGLVYAVEFSHRSGRDLVNMAKKRTNVIPIIEDARHPAKYRMLVGMVDVIFSDVAQPDQARILALNASYFLKNGGHFVISIKANCIDSTQAPEAVFAAEVEKLKLEQFKPSEQVTLEPFERDHACVVGGYRMPKKPKAT

SEQ ID NO: 6039 - protein, 86 aa, Triticum aestivum
IPFYLGPYFGIDMFIGTVILFVWQRLDRVKSDTYAPAVASGLICGDGLWVLPQSMLALAKVKPPICMKFLSRGVNAKVDAFIATLS

SEQ ID NO: 6040 - protein, 446 aa, Triticum aestivum
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIQEKSCNALLLKVNQIGSVTESIEAVKMSKHAGWGVMTSHRSGETEDTFIADLAVGLSTGQIKTGAPCRSERLAKYNQLLRIEEELGDAAVYAGLKFRAPVEPY

SEQ ID NO: 6041 - protein, 549 aa, Triticum aestivum
  misc_feature (144)..(144): Xaa can be any naturally occurring amino acid
MALTLRSSTSFLAPLDPCSKLLHRPEDAPPSSVAVPQAPARLRALRAAAQAPPAPMEAPAPIPAELLHGQVQQANAGGGRPSRGGVPVFVMLPLDTVGPGGQVSRARALAVSLMALRSAGVEGVMVDVWWGVVERDGPGRYDWXEGYAELVRMVERAGLRLQMVRSFHQCGGNVGDPCNIPLPPWVLEEVNADPDIVYTDRSGRRNPEYISLSGDTLPVLKGRTPVQVYSDYMRSFRDRFAGYLGTVIAEVQVGLGPCGELRYPSYPEANGTWSFPGIGEFQCYDKYMRASLQAAAVAAGHENWGTSGPHDAGEYKQFPEETGFFRRDGTWSTEYGHFFLKWYSGMLLEHGDRVLAAAEAIFGGTGVTLSAKVAGIHWHYRTRSHAAELTAGYYNTRHHDGYEPIAQMLARHGTVLNFTCMEMKDEQQPGHAGCSPELLVQQVRAAARAARVELAGENALVRVDEQAFAQVAATAEAAGLSAFTYLRMNRNLFEGDNWRRFVAFVKTMADGGARTALPRCDTGQSDLYVGFVDAAKEQRAPESEAAAAL

SEQ ID NO: 6042 - protein, 496 aa, Triticum aestivum
  misc_feature (194)..(194): Xaa can be any naturally occurring amino acid
  misc_feature (210)..(210): Xaa can be any naturally occurring amino acid
  misc_feature (219)..(219): Xaa can be any naturally occurring amino acid
  misc_feature (242)..(242): Xaa can be any naturally occurring amino acid
  misc_feature (259)..(259): Xaa can be any naturally occurring amino acid
  misc_feature (285)..(285): Xaa can be any naturally occurring amino acid
  misc_feature (297)..(297): Xaa can be any naturally occurring amino acid
  misc_feature (311)..(311): Xaa can be any naturally occurring amino acid
  misc_feature (338)..(338): Xaa can be any naturally occurring amino acid
MLRSPAMAPSLRTTVLLFFFLLAAASSFSSLAQAVGDGIRVLSAEKRIDLTGPIVKVFLTLKVQNAATGADASHVLIAFTPAEADHLAIVKATRAEGKRKKKTYIPLPVSPADAATAAPNGARLYSISLPSPLKPAETTTVEVFYVLTHSLEPFPAEITQSESQLVYYRDSAVILSPYHVQEQGTYVKTPSSRXVESFTRGEPHQPLGPXCNSGAYSNXAPKAYFAMILHYETTTEFRFLRXVLRQVEISHWGNVQVTXGIKVEAGGSNNKGIFSRFEYQVRQSXSGASSLKNLLAXLPPRVHSVYYRDEXGNISSSHLRSDSYKSELETEPRYPLFXGWHCTFTIGYGMPLQDFLFESADGRRFANLTFGCPLLNTVVDNLTIKVVLPEGSKSPQAVVPFETEQHLETSYSYLDVVGRTTVVIKKKNVVGEHNVPFQVYYEFSPIFMLAEPLMLVTAVLLLFAACIVYLHTDLSIAKSQASSRRRSSCKLVVVMK

SEQ ID NO: 6043 - protein, 89 aa, Triticum aestivum
  misc_feature (57)..(57): Xaa can be any naturally occurring amino acid
APTVMAFSATSVAPFHGLKSTAGLPISRRSSSAGLSSATNGGRITCMQVWPIEGIKXFFTLSYLPPLSTEALLKQVHYLIRSKWVPCLE

SEQ ID NO: 6044 - protein, 175 aa, Triticum aestivum
  misc_feature (89)..(89): Xaa can be any naturally occurring amino acid
MDASATGAGAKSKKGAAGRKAGGPRKKSVTRSVKAGLQFPVGRIGRYLKNGRYAKRVGTGAPVYLAAVLEYLAAELLELAGNAAKDKQXSRIVPRHLLLAVRNDQELGRLLAGVTIAHGGVLPNINPVLLPKKTAEKEPKSPKKAAKSPKKGRKEGLDRDAHRSISLSCSVELMV

SEQ ID NO: 6045 - protein, 191 aa, Triticum aestivum
MDGMGRKEHKSQITNQIPSPPLPRHDEHQPPDMDASATGAGAKAKKGAAGRKAGGPRKKSVTRSVKAGLQFPVGRIGRYLKKGRYAKRVGTGAPVYLAAVLEYLAAELLELAGNAAKDNKKSRIVPRHLLLAVRNDQELGRLLAGVTIAHGGVLPNINPVLLPKRTAEKEPKEGKSPKKTAKSPKKADKKA

SEQ ID NO: 6046 - protein, 159 aa, Triticum aestivum
MDASATGAGAKAKKGAAGRKAGGPRKKSVTRSVKAGLQFPVGRIGRYLKNGRYAKRVGTGAPVYLAAVLEYLAAELLELAGNAAKDNNKSRIVPRHLLLAVRNDQELGRLLAGVTIAHGGVLPNINPVLLPKRTAEKEPKEGKSPKKTAKSPKKADKKA

SEQ ID NO: 6047 - protein, 279 aa, Triticum aestivum
  misc_feature (69)..(69): Xaa can be any naturally occurring amino acid
  misc_feature (71)..(71): Xaa can be any naturally occurring amino acid
  misc_feature (82)..(82): Xaa can be any naturally occurring amino acid
  misc_feature (95)..(95): Xaa can be any naturally occurring amino acid
  misc_feature (112)..(112): Xaa can be any naturally occurring amino acid
  misc_feature (121)..(121): Xaa can be any naturally occurring amino acid
  misc_feature (145)..(145): Xaa can be any naturally occurring amino acid
ERGRPLRTLSPFRWPLWWGAARTLCRVSASPQIFLNKVERAALGAVPYPLLSIFIPWSGPMHKVNFEAXPXYGRIQNLKNFXEVVQKVRGGKNIXVNKTVKGRLLDNVEFLXWLKGQYDFXNGGIMNEKSNCMVYLSKGWKKRRXNGPKKSSNSLQANRLYSANSADGGALNSNTDLASPIGKVGNAVKEEHYMEQIQQLSEKIADLKVSVDNTEKERDFYFSKLRDIEILCQRPELEHLPMTKGIRKILYAADAKDSSLPEANEIITRSPGMFSDEAE

SEQ ID NO: 6048 - protein, 279 aa, Triticum aestivum
MAAGAAASFGLMDKAYFVGRGEILSWVNATLQLSLNKVEEAASGAVQCQLLDMVHPGLVPMHKVNFDAKTEYDMIQNYKILQDVFNKLRIGKNIEVNKLVKGRPLDNLEFLQWLKRYCDSVNGGIMNENYNPVERRSKGCKERTHKGPNKSSKSLQANRLSSANSADGGALNSNTDLASPVGKVCNAVNEEHYMEQIQQLSEKIADLKVSVDNTEKERDFYFSKLRDIEILCQRPELEHLPMTKGIRKILYAADAKDSSLPEANEIITRSPGMFSDEAE

SEQ ID NO: 6049 - protein, 194 aa, Triticum aestivum
MDSGSDSDSAPEELTAVQGVEKHEEISKVEKDSAVRATQEEKDRRKRWAQRKTSSKLNKKKPLKVEDKDTEVDEETHAMPGTLPKSVIEMLAAREKQTFSSDSEEENVNQKVQKKKKRLETATTGPETILLKDVRSTEHIKKALEFLSRRKNQVPRSNAVLKNPNAMRLFNKPNSRVECIRISESVRLETDMAG

SEQ ID NO: 6050 - protein, 195 aa, Triticum aestivum
MDTACGSKPPQSKKVCIIGAGMAGLAAARELRREGHDVTVLEQSGDVGGQWLYDPRTDADDALGVAAPVKVHSSIYASLRLISPRQTTGFTDFPFCPKSGRDDRRFPGHREVHLYLKDFCDAFGLMEAVRLNTRVLHAAMTPACKWAVRSMDLGIGECDGADGKELDAYVDEVFDAVVVASGHYSQPRLPSIKGM

SEQ ID NO: 6051 - protein, 103 aa, Triticum aestivum
MSSSVGGGSAGGGGVDMVSLLEKAKDLDQLKKEQDEIVADINKIHKKLLASPEMVDKPVDTILLKLRGLYARAKELSENEISASNALIGLLDGLLQSGASTAQ

SEQ ID NO: 6052 - protein, 278 aa, Triticum aestivum
AHSPLQSVAVAAGPNQTLAAGRRQAMDRKRINDALDRHLRAATERSSPSTSRGAQPKPPPAAAPKPKGQLDSDSSEGGSAGGPSEADDTFWINWFCAMRGNEFFAEVDDDYIQDDFNLCGLSAQVPYYDHALDLILGLEPVQGDVFADDQNELIVASAEMLYGLIHARYILTTTGLAAMLEKFKNCDFGRCPRVSCSGQPCLPMGQSDIPRSSTVKIYCPKCEDLYYPRSKHQANTDGAYFGTTFPHIFMMTHSQLKPQKPAQQYVPRIFGFKVHKKT

SEQ ID NO: 6053 - protein, 133 aa, Triticum aestivum
KLQKLLVALCSASVETLVKTSHGVLSNGNGNAHSGNGEVGEGWTKTVSSALAVPSNRKLVLDLTGRATFEAVRSFLEFVLWRLHDAARAGGDATARAGLCVLRYMSERSMVVAAICIVLCLHVLNRTWLLAPA

SEQ ID NO: 6054 - protein, 211 aa, Triticum aestivum
NRTCLTSDAWADAWVDIFEASLAWVVMPKFGWRWLLALSSVPSLLLLLFYAITPESPRFLCMKGRTMEAVDVLEKMARLNGAQLPSGKLVSDKNIELDEVSESATLLAATAKAAKEEENDNIKEDEGSDFGGFKSVSKLLSPKLLRATLLLWMAFFGNAFSYYGIVLLTSELSNGNRICAKQEVESVHSNNSSLYKNVFISSFADIPGSFV

SEQ ID NO: 6055 - protein, 292 aa, Triticum aestivum
  misc_feature (94)..(94): Xaa can be any naturally occurring amino acid
MTTTAAMNVAVTQLCARGRRRRPAALRHDHRWARLLRLAVATRAVRLVWDQLLACSSCGGGGGARYRRLGPPHGPDVLTPVPMDDDAAARAATXDADAADVEDVVGLKVSLLGDCQIGKTPRVRRPARPGEEQNGGLQMTGLNLMDKTLAVRGARLAFNIWDVAGDSQSADHVPIACKDAVAILFMFDLTSRCTLNNVTDWYERARKWNKTAIPILIGTKFDDFAQLPLEMQWTIVDQARAYARAMKATLFFSSATHNINVNKIFKFITAKLFNLPWTVERNLTVGEPIIDF

SEQ ID NO: 6056 - protein, 189 aa, Triticum aestivum
MGRKFFVGGNWKCNGTVEQVESIVNTLNAGQIASTDVVEVVVSPPYVFLPTVKGKLRPEIQVAAQNCWVKKGGAFTGEVSAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAATVKSA

SEQ ID NO: 6057 - protein, 132 aa, Triticum aestivum
  misc_feature (6)..(6): Xaa can be any naturally occurring amino acid
  misc_feature (8)..(8): Xaa can be any naturally occurring amino acid
  misc_feature (15)..(15): Xaa can be any naturally occurring amino acid
  misc_feature (25)..(25): Xaa can be any naturally occurring amino acid
  misc_feature (33)..(33): Xaa can be any naturally occurring amino acid
  misc_feature (39)..(39): Xaa can be any naturally occurring amino acid
RRSLMXEXSSEFVEXKVAYALAQGXKVIACVGXTLEQRXAGSTMEVVAEQTKAITGKIKDWTNVVVAYEPVWAIGTGKVATPAQAQEVHANLRDWLKTNVSPEVAASTRIIYGASLKPEFIDIINAATVKSA

SEQ ID NO: 6058 - protein, 257 aa, Triticum aestivum
  misc_feature (65)..(65): Xaa can be any naturally occurring amino acid
  misc_feature (78)..(78): Xaa can be any naturally occurring amino acid
  misc_feature (94)..(94): Xaa can be any naturally occurring amino acid
  misc_feature (126)..(126): Xaa can be any naturally occurring amino acid
  misc_feature (172)..(172): Xaa can be any naturally occurring amino acid
  misc_feature (190)..(190): Xaa can be any naturally occurring amino acid
  misc_feature (205)..(205): Xaa can be any naturally occurring amino acid
  misc_feature (223)..(223): Xaa can be any naturally occurring amino acid
  misc_feature (233)..(233): Xaa can be any naturally occurring amino acid
MGRKFFVGGNWKCNGTVEQVESIVNTLNAGQIASTDVVEVVVSPPYVFLPTVKAKLRPEIQVAAXQNCWVKKGGAFTXGEVSAEMLVNLGVPWXSFLGHSERRSLMGESSEFVGEKVAYALAQGLXKVIACVGETLEQREAGSTMEVVAEQTKAITGKIKDWTNVVVAYEPXVWAICTGKVATPAQAQEXHCNLRELLKDHVKPXEVLHPHRSFIGGSGTGAXCKDWAGQPQXQGFLCWGSFLLNLGLYDIINGPHR

SEQ ID NO: 6059 - protein, 253 aa, Triticum aestivum
MGRKFFVGGNWKCNGTVEQVESIVNTLNAGQIASTDVVEVVVSPPYVFLPTVKAKLRPEIQVAAQNCWVKKGGAFTGEVSAEMLVNLGVPWVILGHSERRSLMGESSEFVGEKVAYALAQGLKVIACVGETLEQREAGSTMEVVAEQTKAITGKIKDWTNVVVAYEPVWAIGTGKVATPAQAQEVHANLRDWLKTNVSPEVAASTRIIYGGSVTGASCKELAGQPDVDGFLVGGASLKPEFIDIINAAPVKSA

SEQ ID NO: 6060 - protein, 254 aa, Triticum aestivum
  misc_feature (199)..(199): Xaa can be any naturally occurring amino acid
  misc_feature (226)..(226): Xaa can be any naturally occurring amino acid
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAGKIKDWTNVVVAYEPVWAIGTGKVATPAQAQEVHANLRDWLKTNVSXPEVAESTRIIYGGSVTGASCKELAGQXDVDGFLVGGASLKPEFIDIINAATVKSA

SEQ ID NO: 6061 - protein, 480 aa, Triticum aestivum
MASTAAPPAALVARRAASASVAAPLRGAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGKELPGVVALDEGVMTRSVSV

SEQ ID NO: 6062 - protein, 323 aa, Triticum aestivum
MAAAAARTSVVCVTGAGGFVASWLVKLLLSKPHYTVRGTVRDPGNAKNSHLKALEGAGERLQLLSADLMDYDSIASAVAGCEGVFHVASPVPSGRSTNPEEEVIAPAVTGTLNVLKACYEAKVKRVVIVSSCAAVFNNPNWPKGKVFTEDSWSDEDLCRKGEDWYLLSKTRAEREAFAYAAKTGLDVVAILPSLVLGPLMQSTVNASSKILLKYLKGEHETVENRIWNLVDVRDVADALLLAYENPAASGRYICSPVRIKVSDVISILKTLYPTYTYPKNFTEVEEGNVLSSEKLQKLGWTFRPVEKTLGDSVESYKASGVLN

SEQ ID NO: 6063 - protein, 98 aa, Triticum aestivum
WAVGPSLVLVGAMMMRVAKEIEWGDMKEAIPAFVTMALMPLTFSIANGIIAGLAVYVALHWYDWASLACGKVGKALDDRRNQVAAATPEVGPAPAQDV

SEQ ID NO: 6064 - protein, 257 aa, Triticum aestivum
FGRGAVVVTNGLAGGGEASAEQRSLEAYAALYSGRTRLARLVFIAQRCGVEAIELAALRMAYDEAKAREDTAFYREAALRINGRLGPTHLLDQDWVDSVNHRAEQRKENLETELEVYKTCLHGESIRICYNDLGDFYYSHGRLTEAFKSYIKTEEYFSASEHVVQMCMKAILISVELGHNVRVLNFVSKAQGCQDPLSPIAIAKLQAVAGLARLGRKEYKLAAQEFLETGPELGSNYSEVIAAQDVATYGSLCALAF

SEQ ID NO: 6065 - protein, 291 aa, Triticum aestivum
AGGKAGRVPILSGLNGYARPGEVLAIMGPSGCGKSTLLDALAGGPGSGVSQKGDILINGRRQKLSYGTSAYVTQDDVLMTTLTVREAVRYSASLQLPSGMSAAAKRERAEETLREMGLEGAADTRIGGWMHKGISGGQRRRVSICMEILTRPALLFLDEPTSGLDSAASFHVVSRIARLARREGMTVVAAVHQPSTEVYGLFHGLCLLAYGKTVFFGPAAETNQFFALSGFPCPSLMNPSDHFLRTINKDFDNGIEEGLGGKRTTTADNIDALAGLLQILRAHGQGDAADR

SEQ ID NO: 6066 - protein, 159 aa, Triticum aestivum
HYYRSILEREELHSIKWNAGAVFPFIGFALAMFLFYSTVPTVLKICGATMLNLSLLTSDMWAVLIRIFAYHEKVDWMYFVAFACTAGGLLVYSYRSLVARRSSKEADDTAQVTGASDEQSRVGDEESGIQNQVRSSFAGGNDDQVSYKELPSNGSPSKN

SEQ ID NO: 6067 - protein, 381 aa, Triticum aestivum
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECKNCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSVVAVFGLGTVGLAVAEGAKSAGASRIIGIDIDAKKFDVAKNFGVTEFVNPKDHDKPIQQVLVDLTDGGVDYSFECIGNVSIMRAALECCHKGWGTSVVVGVAASGQEIATRPFQLVTGRVWKGTAFGGFKSRSQVPWLVEKYMNKEIKVDEYITHNMNLTDINKAFDLLHEGGCLRCVLAMEH

SEQ ID NO: 6068 - protein, 370 aa, Triticum aestivum
MSNAASTTPLLAHYKMGKFDLSHRVVLAPLTRERSFGNVPQPHAILYYQQRATKGGLLIAEATGVSDTAQGYKDTPGIWTKKQVEAWKPIVDGVHAKGGIFFCQIWHVGRVSNHTFQPNGQAPISSTDKPIKPATRADGIGLAKVSTPRRLTTDEIPLVIDDFRVAARNAIEAGFDGVEIHGAHGYLIDQFLKDQVNDRTDKYGGSLENRCRFALEVVQAVADEIGADKVGIRLSPFASYSDASDSNPEALGLYMAQALNKLGILYCHMVEPRMVNIGEKLETPHSLRAMRDAFKGTFIVAGGYGRDDGDKAIADGYADLVAYGRLFLSNPDLPRRFEIDGPLNKYNRDTFYLSDPVIGYTDYPFLPSDI

SEQ ID NO: 6069 - protein, 209 aa, Triticum aestivum
  misc_feature (92)..(92): Xaa can be any naturally occurring amino acid
MEVQARHGVLPTGRQQHLHGHGQSHHQPPAGEDEWWEYFPCPFCYIEVEVPFLCDHLQEEHCFDMRNAVCPICADNLGADTTGHFRERHSQXLKMRKSSSSRAGAAGSDKEAYEEDDSYFEESSYIMGQPVPDDHSPDPLLSQFICTVAPPVVDPEPSKAEEEDHAAPSSDDQRLNQVVMDDASKKDLEERLRRVEFVKQMLMTTIAWD

SEQ ID NO: 6070 - protein, 181 aa, Triticum aestivum
  misc_feature (31)..(31): Xaa can be any naturally occurring amino acid
  misc_feature (60)..(60): Xaa can be any naturally occurring amino acid
  misc_feature (63)..(63): Xaa can be any naturally occurring amino acid
  misc_feature (67)..(67): Xaa can be any naturally occurring amino acid
  misc_feature (103)..(103): Xaa can be any naturally occurring amino acid
  misc_feature (133)..(133): Xaa can be any naturally occurring amino acid
  misc_feature (149)..(149): Xaa can be any naturally occurring amino acid
GTLLVYRDKLFGERLVWDSFPYRELKNGVLXEVDGHWVDEGASDVDIGANPYAEGGGDDXGVXDDQXIKVNVIVDTLRLQEQPAFDKKQFISHMKRYIKNLSXRLECDDLDAFKKNGESDTYYIVSRSRTFSXFVDESMHDEAVVVPAXYKEGAVDLSLLDFAHGMPEVKCLSHCMLKCML

SEQ ID NO: 6071 - protein, 480 aa, Triticum aestivum
AYLGDIIEQVCTKKQAGTGPEFPGYRRPTRPHELKGSEVAAGYDVFKTHIARAALVSANTASVLVSTAIGFDERMLLHSAMPIEPNPHPERPNRLRAIAASLAAAGIFPSKCALVPPREITKEELVMVHTSDHVESVEQTKNMLYSYFTSDTYANGHSACAAKLAAGLCADLASLIVSGRVRNGFALVRPPGHHAGVKQAMGFCLHNNAAVAALAAQKAGAKKVLIVDWDVHHGNGTQEIFEGNKSVLYISLHRHEDGSFYPGTGAADEVGDLDGKGFSVNIPWSCGGVGDNDYIFAFQHVVLPIATEFAPDITIISAGFDAARGDPLGCCDVTPAGYSQMTSMLTACSEGKLLVILEGGYNLRSISSSATEVVKVLLGDGPSYGTDAAAPSKEGMQTVLQVLDIQQKYWPVLVPIFASLQVQAQQGPTSSNYVNAENMLKRRMLTGGPGPVWWKWGSKRLLYEVLFEGRRPRKSKAKGK

SEQ ID NO: 6072 - protein, 376 aa, Triticum aestivum
  misc_feature (41)..(41): Xaa can be any naturally occurring amino acid
  misc_feature (128)..(128): Xaa can be any naturally occurring amino acid
MATVNPFDLLGDDEGDDPTQLLAKAAALAQKAEAKKAAAPXAAGKGGAKTVANLPTKPPPPGQAANESRGGGPPSRGGYGRGERGSGRGGRGGYGQNRDYGSEDTNGYRGGYGARTGGEEGAQDRERXPRQPYQGGGRRGGYRDGEFGDDSERPPRRNYERQSGTGRGYEIKREGAGRGNWGTTSDEIVAQETEALKQDEKAPAPEKQGAPEDAPQADENKATKDGAAVVEEEKEEDNEMTLDEFEKVMEEKRKALAALKKSEERKVEIDKDLQAMQLLSTKKGNDEVFIKLGADKEALKKKENAEREERAKKSVSINEFLKPAEGERFYGGRGRGGRGRGDRGGFRGGFGGGGYHGPPPAPAIQDQNQFPTLGGK

SEQ ID NO: 6073 - protein, 313 aa, Triticum aestivum
  misc_feature (187)..(187): Xaa can be any naturally occurring amino acid
  misc_feature (214)..(214): Xaa can be any naturally occurring amino acid
MAIKKVFARSVYDSRGNPTVEVDVVTETGLHRAIVPSGASTGQHEACELRDGDKSKWNGKGVTKAVENVNTVIAPALIEKNLDVKDQSAVDAFLNELDGTTNKTKLGANAILGVSLAVAKAGAAEKGVPLYAHVSDLAGTKKPYVLPVPFMNVLNGGSHAGGRLAFQEFMIVPTDAPTFSEALRQGXAEVYQALKGLAKKRYGQSAGNVGDEGXVLPPDIQTAEEALELITDAIEQAGYTGQMKIAMDVASSEFYKESEKKYDLDFKNPESDPPKWITYEELANMYSELCKKVPIVSIEDPFAEDNWEAWSYF

SEQ ID NO: 6074 - protein, 219 aa, Triticum aestivum
MSADELRLDLEELLRLEGLAKRPRVVSLLSNEIRSVDAKLASRAAPVPVPTPAPQAVAVAAAAPAGLSYVTLGSFSWDQDNEKIRVYVFLENVDQEKVETTFKPMSADIKFHDVKGKNYRCAIPKLNKEIVPEKCKVVVKPTKIVITLWKASSGNWLDLHYKEDKFKPSMDKEKDPMSGIMDLMKGMYEEGDEDMKRPIAKAWSDARSGKTADPMKGLP

SEQ ID NO: 6075 - protein, 98 aa, Triticum aestivum
GTRAIPKIKEADLSQVTRGAGSNVPEAVYMQHLMGVNGVIVDLVPEITGAVSDLIAVPEIDTEINDLSSQAVKDAASTPNFTQREISFLLRLMPELVQ

SEQ ID NO: 6076 - protein, 152 aa, Triticum aestivum
MGARASCFSRLCCCWISFPSSDPRPPRPPPTPAAAAAAYLPCPGMDAETGPGTVTTAARRPPQPRTPYADADRTLRALAAAVEGFGRRAIGGLHGALYHVTSLQDDGHGTLREACRAKEPLWIVFEVSGDIHLHTYLRVSSHKTIDGRGQRV

SEQ ID NO: 6077 - protein, 272 aa, Triticum aestivum
  misc_feature (120)..(120): Xaa can be any naturally occurring amino acid
  misc_feature (210)..(210): Xaa can be any naturally occurring amino acid
MAAAAAAASMARRLLSPTTTSYSTTARLLISRRIASAASVPRAPAAAAKEMLRPAAVASSSAFLLRGAGGARGMARRPGGDGYAPARGGGGGGGDRAPTEMAPLFPGCDYEHWLIVMDKXGGEGASKHQMIDCYINTLAKVLGSEEEAKKKIYNVSCERYFGFGCEIDEETSNKLEGIPGVLFVLPDSYVDPEHKDYGAELFVNGEIVQXRSPERQRRVEPVPQRASDRPRYNDRTRFQREEGRTSSGDEPGCSIEDQITIPGRFPQGKLKG

SEQ ID NO: 6078 - protein, 137 aa, Triticum aestivum
LLLPLPQMEMPTGSSQAGGRFPVPHKSLSLDIKGNKTDIVISKYEDNFLVIVTQIGCMGTILAAKKDESVFSDPTYNVSVLFGKRDEPLLLVCARQLIEHISGSGSARPLVISFGLKDHSQGTSKDVVSSIVDNRLW

SEQ ID NO: 6079 - protein, 110 aa, Triticum aestivum
  misc_feature (98)..(98): Xaa can be any naturally occurring amino acid
  misc_feature (100)..(100): Xaa can be any naturally occurring amino acid
  misc_feature (105)..(105): Xaa can be any naturally occurring amino acid
LLLPLCARGSLIRLVPQMEMPTGSSQAGGRFPVPHKSLSLDIKGNKTDIVISKYEDHFLVIVTQIGCMGTILAAKKDESVFSDPTYNVSVLFGKRDEXLXLACAXQLIEH

SEQ ID NO: 6080 - protein, 558 aa, Triticum aestivum
  misc_feature (274)..(274): Xaa can be any naturally occurring amino acid
  misc_feature (298)..(298): Xaa can be any naturally occurring amino acid
TTVLVTLNNPLQVELVHAQLKRAKERVDMPDDEFYNDLLSLYNKTYDPSAELAILERLSEKLHLMTITDLTQESLALHEMVASGGGQDPGEHIEKLSMLLKKIKDFVQTNNPEMGPPMASKIMDTSGDQKSVIVPDEFRCPISLELMKDPVIVATGQTYERSCIEKWLASGHHTCPTTQQRMANTTLTANYVLRSLISQWCETNGIEAPKRSSQPSKPMPACSSSERANIDALLSKLCSPDPEEQRSAAAELRLLAKRNAHNRLCIAEAGAIPXLLLSLLSSSDLRTQEHAVTALLNXSIHEDNKASIMSSGAVPSVVHVLKNGSMEARENAAATLFSLSVVDEYKVMIGGTGAIPALVVLLSEGSQRGKKDAAAALFNLCIYQGNKGRAIRAGLVPLIMGLVTNPTGALMDEAMAILSILSSHQEGKAAIGAAEPVPALVELLGSGSPRNRENAAAVMLHLCSGEQQLVHLARAHECGIMVPLRELALNGTERGKRKAVQLLERMSRFMVQQQEEQESNSRLQAAAAQVLPQAPEQVQESEIPDQLESPASQYPTLL

SEQ ID NO: 6081 - protein, 160 aa, Triticum aestivum
  misc_feature (145)..(146): Xaa can be any naturally occurring amino acid
  misc_feature (149)..(150): Xaa can be any naturally occurring amino acid
  misc_feature (153)..(153): Xaa can be any naturally occurring amino acid
MPEQSKRQRGRKRTAAATLLLAYAALAMERADAALLPAVYREIGAALQTSPTALGSIALSRSVVQAACYPLAAYLAARHDRLTVIALGAFLWAAATLLIGLSTTFAQMAVTAALNGVGLALQIPAIFAFVADSVDGTNRGMAFGXXMVXXKAXTVGGTTL

SEQ ID NO: 6082 - protein, 178 aa, Triticum aestivum
MVGSGMQRGAPLVVGRVIGDVVDPFVRRVALRVGYASRDVANGCELRPSAIAEPPRVEVGGPDMRTFYTLVMVDPDAPSPSDPSLREYLHWLVTDIPGTTGVSFGTEVVCYEGPRPVLGIHRLVFLLFQQLGRQTVYAPGWRQNFSTRDFAELYNLGLPVAAVYFNCQRETGTGGRRM

SEQ ID NO: 6083 - protein, 180 aa, Triticum aestivum
MVGSGMHAQRGDPLVVGRVIGDVVDPFVRRVALRVGYASRDVANGCELRPSAIADPPRVEVGGPDMRTFYTLVMVDPDAPSPSDPSLREYLHWLVTDIPATTGVSFGTEVVCYEGPRPVLGIHRLVFLLFQQLGRQTVYAPGWRQNFSTRDFAELYNLGLPVAAVYFNCQRETGTGGRRM

SEQ ID NO: 6084 - protein, 211 aa, Triticum aestivum
MAAGALGLALVAAFALALAGANSEGDALSALRRSLRDPGGVLQSWDPTLVNPCTWFHVTCDRDNRVTRLDLGNLNLSGHLVPELGKLEHLQYLELYKNNIEGTIPSELGDLKNLISLDLYKNNVSGTIPPTLGKLKSLVFLRLNGNRLTGPIPRELAGISSLKVVDVSGNNLCGTIPTTGPFEHIPLSNFERNPRLEGPELQGLAVYETNC

SEQ ID NO: 6085 - protein, 307 aa, Triticum aestivum
  misc_feature (249)..(249): Xaa can be any naturally occurring amino acid
IRHEGSNEEHRRCIAACLVKATYIMEEDRPKCRVYDMGLAPPWWQSFHFELRDLLKCGTENADEFIFGAVFEYCPPAGWQRHPSAPNYVFALRGTMPRHPKSAHDLYNDIKVFLSDLPCPRRPRKARQAGANMLIRKGTERCVLWLAGHSLGASLALEVGRDMAEQHQAYLPTFLFNPPNVSPMPAFNLLNPSEVAKKDVFTGSYLVKAALGATVMRSYCTRMEKVFQRLSPWVPELYVNERDIICQGXIDYFEQRQKVEERIAGVGRAAMKLSYRDMLSSLIGSRKEQPHLLPSARLWKNSNTKFG

SEQ ID NO: 6086 - protein, 182 aa, Triticum aestivum
  misc_feature (123)..(123): Xaa can be any naturally occurring amino acid
TSPKSMMIAQVIGTAMGCIISPLTFMLFYKAFDIGNPDGTWKAPYALIYRNMAILGVEGFSVLPKYCIAISGGFFAFAAIFSIARDVMPHKYAKYVPLPMAMAVPFLVGRSFAIDMSSGRPGXVGSLIVIAWTKINEKEAGFMVPAVASALICGDGIWTFPASILALAKIKPPICMKFLPAA

SEQ ID NO: 6087 - protein, 270 aa, Triticum aestivum
  misc_feature (56)..(56): Xaa can be any naturally occurring amino acid
MKHEFAFVEFSDPRDADEARYNLDGRDFDGSRMIVEFAKGVPRGQGGGGDRDRGPXGGDREYMGRGPPPGSGRCFNCGIDGHWARDCKAGDWKNRCYRCGDSGHIERDCQNSPKNLKRGKSYSRSPSPRRGRVRDRSYSRSRSRSYSRSVSPRRDERRSRSPRDSRSPRRSPRDSRSPMKSPRGSRSPMRSPRDSRSPRRSASPVKGRARSPTPPGSRSPAPRENSRSPMKADSPNNMSPAANGRSPSPRDGEDNGNHRAPSGSASPGGG

SEQ ID NO: 6088 - protein, 180 aa, Triticum aestivum
DMVIAEYYYDHFHLDLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPVTLVHFPQWGSILPHPAAITSEF

SEQ ID NO: 6089 - protein, 115 aa, Triticum aestivum
  misc_feature (99)..(99): Xaa can be any naturally occurring amino acid
MDAGGKIKKGAGGRKGGGPKKKPVSRSVKAGLQFPVGRIGRYLKKGRYAQRVGTGAPVYLAAVLEYLAAEVLELAGNAARDNKKNMIIPRHVLLAVRNXEELGKLLAGVTIAHGG

SEQ ID NO: 6090 - protein, 216 aa, Triticum aestivum
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVDDAKAFAEREITFFMETSALEAMNVETAFTEVLTQIYRVVSKKALDIGDDPAAPPRGQTINVGGKDDVSAVKKAGCCSS

SEQ ID NO: 6091 - protein, 516 aa, Triticum aestivum
  misc_feature (156)..(156): Xaa can be any naturally occurring amino acid
  misc_feature (185)..(185): Xaa can be any naturally occurring amino acid
MAVSPLALVLLLLAFAVSLLYILRRPAPLRSGSDGGRRHLPPSPRGLPLLGHLHLLGSLPHRALRSLAAAHGPVLLLRLGRVPAVVVSSPAAAEEVMRARDLAFASRPRSAMADRLLYGRDVAFAPYGEYWRQARRVCVVHLLSPLRILSFRGVRXEEEAAALVERVRGAAAGGAAVDLCELLVXYANTVVSRAAFGDDSARGLYEEGNKERELRKVFNDFQELLGTAPLGELLPWLGWLDAVRGMEGKIRRTFKALDGVLEKVIGDHRRRRQAGQQTGDDGGDHRDFVDVLLDVSDTDDEAGMRLSTTEIKAIILDMFAAGTDTTSTAMEWAMAEVITHPDSMRKLQDELRAAVGGSGHVITEDHIDKLHYLKAVVKETLRLHPPIPLLVPREPQDDAEILGHHVPAGTRVVINAWAVGRDPAAWERAEEFVPERFLDGAVDYKGQDFQLIPFGAGRRGCPGVGFAAATVEMALASLMYHFDWEPAGASLDMREVNGLAVHLKSGLPLVAKLRFR

SEQ ID NO: 6092 - protein, 223 aa, Triticum aestivum
  misc_feature (164)..(164): Xaa can be any naturally occurring amino acid
MVKRWLPLEANPDVMNQFMWGLGVPEDVGFCDVYGLDDEMLAMVPQPVLAVLLLYPQDRKKESDASATSTAETKEPNKKVYFTKQTVGNACGTIGIIHAIGNAVSKIKLVDGSYFHRFYKQTADMDPIQRAAFLEEDQEMEDAHSVAAAGGDTEAKDGVIEHYXCLSCVDGELYELDGGKPQPIHHGPSSPDSLLQDAARVIKAKIVEYSESLNFNVMALSKM

SEQ ID NO: 6093 - protein, 175 aa, Triticum aestivum
MAPTVMASSVTSVVPFQGLKSTAGLPVSRRSNGASLGSVSNGGRIRCMQVWPIEGIKKFETLSYLPPLSTEALLKQVDYRIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 6094 - protein, 362 aa, Triticum aestivum
  misc_feature (96)..(96): Xaa can be any naturally occurring amino acid
  misc_feature (109)..(109): Xaa can be any naturally occurring amino acid
  misc_feature (120)..(120): Xaa can be any naturally occurring amino acid
MWGTAANLRRNIEGSTEANMPNVKSAGGAGASASPAGGDGEVEAGFAKMQGVDFEYYMQTYSSMLPRYSEKSKVDVDLAGLGGGMNISPHHARILXTSSPRRFALDGIXSNGGLVEGVLXHLPGNPPVKLDSQDLLQIGDKKFYFLLPTRSIFASFAARQAPVIPPQIPPPAYARPGHPRVSDFHDRFSEGDYGRDSDDIGNGVGEGGMKGKLKRTKKSPGDLDIYGGHRINVEAIGTLGEDNRSEIRSRGDKDVDNQHLQTEEKEVVSSVATVLSDLCGPGEWMPMKTLHTELMDQFGNVWHHSRVRKYLTADDWSPIEAKGRPWYGLLGLLRKYPEHFVINTKSKGRAISEFVSLVSLLS

SEQ ID NO: 6095 - protein, 342 aa, Triticum aestivum
MTKVLLTGGSGFIAAHTLEQPPGSGYSIVTTVRSEDKAQKIRNAFPDKVKDGKLEIVIVTDIAKPDAFDQVAKTPGLDAVIHVASPFHFNITDPKKDLIDPAVIGTTGILKALHASAPNVKRVVITSSFAAIIDEAKFTDGSHVFSEKTWNPVTIDDITRSDTTAYRASKTLAERAAWDFVAEKKPSFDLVTVCPPLVLRPVSKHLATLESINTSNARIVNLLRGEWKDEIPPCTPVPLWIDVRDAARAHVRGLEEPSAGGKRLFTTAGLFSHREIVDIIAEKFPEFKDRLPGPEVKGGELPPKDQIFGIDNKETNELLKIDWLTVEKSMTDLVESLKEIGI

SEQ ID NO: 6096 - protein, 195 aa, Triticum aestivum
HASAHASAHAFADAWVQLCKHFQFDWPVNHTSLSPDGKLVVIVGDDPNGLLIDANSGKTLHSMKGHHDFSFASAWSPDGRTFATGNQDKTCRIWDARNLSKAVHVLKGNLGAIRSIRFTSDGQFLSMAEPADFVHIFDVKSDYNRRQELDFFGEISGMSFSPDTDALFVGVWDRTYGSLLQFGRLYNNWYHDSML

SEQ ID NO: 6097 - protein, 440 aa, Triticum aestivum
  misc_feature (128)..(128): Xaa can be any naturally occurring amino acid
  misc_feature (200)..(200): Xaa can be any naturally occurring amino acid
  misc_feature (311)..(311): Xaa can be any naturally occurring amino acid
MSNYHDDHVEDMEDDYDMDDPAEDMVDAHHERGLRDSDSEDDEYAHSNDKIPDTSAADARKGKDIQGIPWERLAITRENYRQTRLEQYKNYENIPNSGEAAAKECKPTVKGGMYYEFRQNTRSVKSTXILHFQLRNLVWATSKHDVYLMSHYSVLHWSALSGVDTELMNVQGHVAPREKHPGSLLEGFSQTQVSTLAVKXDNLLVAGGFQGELICKHLDREGISFCCRTTYDDNAITNAVEIFNTASGAVHFMASNNDSGVRDYDMERFQLCKHFQFDWPVNHTSLSPDGKLVVIVGDDPNDLLIDANSGXKTLHSMKGHHDFSFASAWSPDGRTFATGTNDKTGRIWEARNLSKAVHVLKGNLGAISSFRFTSDGQFLSMAEPVDFVERLQEKANSNTSSERYFVGASARTYMSPSSDGRIEDMWDRTYGSLLQFGRPV

SEQ ID NO: 6098 - protein, 384 aa, Triticum aestivum
  misc_feature (229)..(229): Xaa can be any naturally occurring amino acid
MFWLRRGVLAQVLPSSSASPVSPLHRLISAAAPAISPNIRFAVEEYLVSTCGLTRPQALKASAKLSHLKSPANPDAVLAFLAGLGLSDADVAALVAKDPQFLCASVERTLAPVVAGLSGLGLSRSDIARLASLSRYRFRCRSIVSKLQYYMPFFGSFENLLRALKRNFYLHSADLDDVVKPNVAMLRECGLGACDIVKLCISQPWLLTANLERVQAMVECAENIGVPPXSGMFRHALHAVAFLSEDKIAARVKYLKNTFRWTDAEVGMAVSKAPMVLARSKESLQRRSEFLISEVGLEPVYIAQRSEIIGHSLEGRLRPRYYAVKFLKENGLLKRDPNYSTVFKISEKAFRKKFIFPHKEAALHLTEDYDAACKGDVPTNFRFT

SEQ ID NO: 6099 - protein, 237 aa, Triticum aestivum
  misc_feature (13)..(13): Xaa can be any naturally occurring amino acid
ANSARGKHCLNCXELKGSEVAAGYDVCETHIARAPPRSPPPASVRVPPAAGFRARPLPRTALAIKPNPHPERPNRLRAIAASLAAAGIFPSKCALVPPREITKEELVMVHTSDHVESVEQTKNMLYSYFTSDTYANGHSACAAKLAAGLCADLASLIVSGRVRNGFALVRPPGHHAGVKQAMGFCLHNNAAVAALAAQKAGAKKVLIVDWDVHHGNGTQEIFEGNKSVLYISLHRHE

SEQ ID NO: 6100 - protein, 82 aa, Triticum aestivum
  misc_feature (35)..(35): Xaa can be any naturally occurring amino acid
  misc_feature (55)..(55): Xaa can be any naturally occurring amino acid
MSGAGKKVADVAFKASRTIDWEGMAKVLVTDEARXEFSNLRRAFDEVNTQLQTKXSQEPEPIDWDFYRKGIGSGIVDLYKEA

SEQ ID NO: 6101 - protein, 369 aa, Triticum aestivum
MAPTATTTTTAAEQQQHPRKAVGLAAHDASGHLSPIRIPRRSTGDDDVAIKVLYCGICHSDLHTIKNDWRNAIYPVVPGHEIAGVVTEVGKNVAGFAAGDRVGVGCMVNTCRACESCEEGAENYCARVVLTYNSRDRDGAVTRGGYSDLVVADARFVVRFPDALPLDVAAPLLCAGATVYAPMRRHGLGAPGSHVGVIGLGGLGHVAVKFARAFGAAKVTVISTSPGKREEALERLGADAFVLSTDAAEMKAAAGTMHGIVNTASAAASLHPYLALLKPHGKMILLGIPDKPLQVSAFALIGGGKTLAGSCMASISETQEMLDFAAEHGVAADVEVIGAGEVNAAMERLAKGDVRYRFVIDVGNTLKAD

SEQ ID NO: 6102 - protein, 365 aa, Triticum aestivum
CWGAKGDGKTDATQAVMKAWKNACGATGTQKIVIPPGNFLVGALELSGPCTSSIIIRLDGNLLGTGDLTAYKKNWIEVMRVDNFAINGHGIIDGQGPLVWEKNQCSKHYDCKILPNSLVLDYVNNATIRGITLKNAKFFHLNLFNCKTVLVENVEITAPGNSPNTDGIHMGDSEDVTIKATNIGVGDDCISIGPGTKHVKIHGSRCGPGHGISVGSLGRYKDEKDVEDIQVTNCTIKGATNGLRIKSYEDSKSALRATRFVYDDVKMDNVSYPIVIDQKYCPNNICAKAPGASKVVVADIVFKNIVGTSATPEAVTLNCVNNVPCQGLQLVNVNLKYTGTNNKTMAVCKNAVGTSVNVVKELACL

SEQ ID NO: 6103 - protein, 315 aa, Triticum aestivum
  misc_feature (95)..(95): Xaa can be any naturally occurring amino acid
  misc_feature (106)..(106): Xaa can be any naturally occurring amino acid
  misc_feature (109)..(109): Xaa can be any naturally occurring amino acid
  misc_feature (120)..(120): Xaa can be any naturally occurring amino acid
  misc_feature (128)..(128): Xaa can be any naturally occurring amino acid
  misc_feature (137)..(137): Xaa can be any naturally occurring amino acid
  misc_feature (177)..(177): Xaa can be any naturally occurring amino acid
  misc_feature (188)..(188): Xaa can be any naturally occurring amino acid
  misc_feature (198)..(198): Xaa can be any naturally occurring amino acid
  misc_feature (251)..(251): Xaa can be any naturally occurring amino acid
  misc_feature (257)..(257): Xaa can be any naturally occurring amino acid
  misc_feature (280)..(280): Xaa can be any naturally occurring amino acid
  misc_feature (294)..(294): Xaa can be any naturally occurring amino acid
FKRQKNGGAFVASFHPPRRAGPAPAAQPQPEPPRSASGAPRRRAQPLVRHGPVSGKFLAGGNGKCNGTKVSISKLVSDLNAATLESDVDVLLVTXRFIYYDDVKRXLTXDRIEVSGCIIXIGKGGAYXGEFTAGELXDIGLPMGLVLGTLERQSYYRQMIISLLEYIGCICLESKSXGFGVMACIGGXEREAGKTFNXDVCLKQMKAFADNITDWTNVVIAYEPVWAIGTGKFASPEQAQEVHAAVRDWCXKTNVSXDVASTVRIIYGRFQLNATNKEGXIEGFLVGGALVVKXRLNGPHFATICNSVTSKKVTA

SEQ ID NO: 6104 - protein, 152 aa, Triticum aestivum
  misc_feature (7)..(7): Xaa can be any naturally occurring amino acid
  misc_feature (91)..(92): Xaa can be any naturally occurring amino acid
MDASKLXKVAGKKFGGPRKKSVTRSVKAGLQFPVGRIGRYLKKGRYAQRVGSGAPVYLAAVLEYLAAEVLELAGNAAKDNKKTRIVPRHLXXAIRNDQELGRLLSGVTIAHGGVIPNINPVLLPKKTAEKAEKTAAKSPKKATKSPKKATKA

SEQ ID NO: 6105 - protein, 255 aa, Triticum aestivum
  misc_feature (81)..(81): Xaa can be any naturally occurring amino acid
  misc_feature (96)..(96): Xaa can be any naturally occurring amino acid
  misc_feature (189)..(189): Xaa can be any naturally occurring amino acid
MGRKFFVGGNWKCNGTTDQVEKIVKTLNEGQVPPADVVEVVVSPPYVFLPVVKSLLRPEFHVAAQNCWVKKGGAFTGEVSXARCSVNLGVPWVILXGHSERRALLGESNEFVGDKVAYALSQGLKVIACVGETLEQREAGSTMEVVAAQTKAIAEKISDWSNVVVAYEPVWAIGTGKVATPAQAQEVHXSLRDWLKINVSPEVAESTRIIYGGSVTAANCKELGAQPDVDGFLVGGASLKPEFIDIINAATVKSA

SEQ ID NO: 6106 - protein, 221 aa, Triticum aestivum
MGSCASRSPASVVAAGSGRAVATKTAKVIGLDGSMAQYVALVTARQALVDAARAWSFLCSPDELRLDAPARALAEDEALQPGWLYFVLPVSMLRRPLSGQEMTALAVRASSALAVASGISSPTRGKNGAALAGANGKRRKVAARVAPLAHDDDVAERDGGWDQHLAYGKYGGVRKRVLAASDVAAGKARRGDGYGGRRSSRHRRRRAGVQRLSAILEADDF

SEQ ID NO: 6107 - protein, 113 aa, Triticum aestivum
  misc_feature (96)..(96): Xaa can be any naturally occurring amino acid
  misc_feature (106)..(106): Xaa can be any naturally occurring amino acid
MFIIEDKGGAIAIMCASLFFLGTWPAVLTLLERRGRLPQHTYLDYSITNLLAAILIALTFGQLGDAKHNMPNFFTQLSQDNWPSVMFAMAGGVVLXVGNLSTQYAXAYVGLSV

SEQ ID NO: 6108 - protein, 507 aa, Triticum aestivum
YLLGGLHSKNCSKKAWCFMCEFERLIVEGKQGKTALSPTGILSHLHEIGSSFGPGKQEDAHEFLRHSIDAMQSVCIKEARKGGAHCLAEETTLVQLIFGGYLRSKIKCTRCHISSEQYERMLDLTVEIDGDISSLEEALQRFTSTEVLDGDNRYQCSRCNSYERAKKKLTISEAPNVLTIALKRYQSGKFGKISKAIRFPETLNLSCYMNSTDDNSPVYSLYGMVVHHDVMNAAFSGHYVCYVKDTHGKWYKIDDSQVKPVSLENVMSKCAYMLLYARCSPRAPNSVRHAMMVNDPSYAKKAKHKPNLEQTPLQRGSLNRHQGGELHSDHITDNLTRRFDEFGDAPYPAAESPSPSESSSLFSNSDAGSHSTVSTDSSESTRNSTSTDDYEQYFFGSSDQMYLGGPRGAHEEIGYMSYSRSRSALGTSSSGQEVDEERSVEQRFEVSRGGWLEGGESSPLSYTDQSKHHLLTEQHRQFGGSEHDPGEARGSVLLRRSAREKTAQTFY

SEQ ID NO: 6109 - protein, 204 aa, Triticum aestivum
  misc_feature (85)..(85): Xaa can be any naturally occurring amino acid
PRVRLKALIQSSRGQFKSAVESFRILLAIIQAKKEIWKLTPYDKVKSLHKLEMEAWLDLASIYTKLEAWNDSNICLDKAACSEDXPPQRWRDSGLQREAQSKEQAGLEAFSLSLSINPDYVPSMVSMASILRTLGAKSSSIARTFLRSATRLEPTNHQAWMGLGLVLKSEGSVLEAADCFQAAYELLELSPIQDFSEQLPILLQ

SEQ ID NO: 6110 - protein, 282 aa, Triticum aestivum
MASISGAAAPPSSSSACRLRLRRQLLMRPSHLRLRAPHSIADLSRSSSSSSSGSSHSHAPAPPLASRAPGQGGGAAVEKDPIKLWDRYVEWLYQHKQLGLFVDVSRMGFTDDFLLRMEPLMQRAFVAMGELEKGAIANPDEGRMVGHYWLRDPGLAPNSFLRTKIEKTVDHILAFSQDIVSGKIKPPSSQVGRFTQILSIGIGGSSLGPQFVSEALAPDNPPLKIRFIDNTDPAGIDHQIAQLGEELKSTLVIVISKSGGTPETRNGLLEVQKAFRDAGLDF

SEQ ID NO: 6111 - protein, 413 aa, Triticum aestivum
MFTGLCVFEKQTHRNRAQRKVYRSFCNLRSIQFTARKMVAKEAIPLLTPHRMGRFELSHRVVLAPLTRCRSYANVPQPHAALYYSQRATEGGLLIAEATGVSATAQGYPETPGIWTQQHVDAWKPIVDAVHRKGALFFCQIWHVGRVSTNDFQPDGQAPISSTDQQITPDAESGMVYSKPRQLQTDEIPLIVDDFRRAARNAVEAGFDGVEIHGAHGYLLEQFMKDSSNDRTDEYGGSLENRCRFAVEVIDAIVHEIGADRVGIRLSPFVDYMDCFDSDPHALGMYMVQQLNKHQGFVYCHMVEPRMAIVDGRRQIPHGLLPFRKAFNGTFIAAGGYDREEGNKVVADGYADLVAYGRIFLANPDLPKRFELDSPLNKYDRNTFYTQDPVIGYTDYPFLEGLECRVVHPLDLN

SEQ ID NO: 6112 - protein, 157 aa, Triticum aestivum
  misc_feature (3)..(3): Xaa can be any naturally occurring amino acid
  misc_feature (7)..(7): Xaa can be any naturally occurring amino acid
  misc_feature (22)..(22): Xaa can be any naturally occurring amino acid
  misc_feature (97)..(97): Xaa can be any naturally occurring amino acid
  misc_feature (125)..(125): Xaa can be any naturally occurring amino acid
  misc_feature (146)..(146): Xaa can be any naturally occurring amino acid
SNXYDLXFIDAYDGNDIFPRKXWDADGAFLRNLEEKVHPVHGTVVVNLHSDSGPSSPDVDDEAPFENVLPMGRYVSHVSRAYKRHFGLAFTVASPWXCNITLVACRDKAILRSAPVGRSHRDFVXSKLLSRSSMVEQALDLPFPCXQYVKNGFTLVE

SEQ ID NO: 6113 - protein, 306 aa, Triticum aestivum
  misc_feature (118)..(118): Xaa can be any naturally occurring amino acid
MSVSNIGMMDGAYFVGRNEILAWINTTLQLGLAKVEEAASGAVASQLMDAAHPGAVPMHKVNFDAKNEYDMIQNYKVLQDVFNKLKITKHIEVNKLIKGRPLDNLEFMQWMKRYCDSXNGGFMTSYNASERRESSKGGKDTNRRTSGTSQAPAKSASATHKAQPPPHAAKRANGHASNAPQRCAKPPPAAAPAYDAQMTELKLLVDSAEKERDFYFSKLRDVEILCQSPEVEHLPDGKAIQKILYASEDDPSNGAEARAEMWRRKPDAAAANVRRSWRRLRPKLHPKDSSRNVKQKHRSPQRNHRT

SEQ ID NO: 6114 - protein, 465 aa, Triticum aestivum
YREAGGDTFLAAGILGSTQDMQPPPPPPPDLSPRAGSAGRRPARRPRKLPVAVSGIVADVIGKGYSRPATPPVSATERSGWKGKGKDMDGESVSNGWNDERNGERESGGGDPTLNVEEAEQFLCSMLGDHSQLSMGVVKDVLGQSGYDVEQALDALLDGPPTRPCIPNEETNGSSSPHLFPGNGLFEEECTASIQQSPRQFPEEIPGMSYNHSERQHEFFWGEQQSSSYMKAVCEVQHSATPSPRSAVVDSKMPQQVLESLFKIPERRTYEPSKMDWKKVVKKLQSYNHPITASNQERPKNGDGYREFRGVSARHYDTMKGYYQKAAVAYSKGDKSYASYLAEEGKHYRELGHKEDEKASREIFEARNKHITNTVTIDLHGQHVKQAMKLLKVHMLVCVCMPSTLLRVITGCGVEGTGKGKIKRSVIELVEKEGIEWYEGNSGTIVLRLGGPREYRFLEHDSDSD

SEQ ID NO: 6115 - protein, 612 aa, Triticum aestivum
  misc_feature (266)..(266): Xaa can be any naturally occurring amino acid
  misc_feature (532)..(532): Xaa can be any naturally occurring amino acid
  misc_feature (572)..(572): Xaa can be any naturally occurring amino acid
LLAGLLVLAFWLRSGGSAPPKPPPASFRPPPVKVDADDADDGRKRVTIFFGTQTGTAEGFAKAMAEEAKARYEKVLFKVVDLDDYAAEDDEYEEKLKKETFALFFLATYGDGEPTDNAARFYKWFTEGKESEVWLKDFNYAVFGLGNRQYEHFNKVAKEVDELLLEQGGNRLVPCGLGDDDQCNTTGATTPYTAAIPEYRIVFIDKDDTTGATTPYTAAIPEYRVVFIDKSDLEFEDKSWTLANGNGVIDAQHPCRANVAVRKELXTGDPVGVYSENSIETVEQAETLLGLSPETLFSIHADAEDGSPRKGGGSLAPPFPSPCTLRTALLRYADLLNAPKKPALTVLAAHASDPTEAERLRFLASPAGKDEYAQWIVASQRSLLEVMAAFPSAKPPLGVFFAAIAPPPRLQPRFYSISSSPKLAPSRIHVTCALVYGPTPTERIHQGVCSTWMKNTLPLEYSEECSWAPIFVRQSNFRLPADPSTPIIMIGPGTGLAPFRGFLQERLALKESGAELGSSVLFFGCRNREMDXREGPTKEYVQHKMVDKATEIWNVISQGGYIYVCGDAKGMXKDVHRVLHTIVQKQGSLDNSKTELYVKNLQMEGRYLRDVW

SEQ ID NO: 6116 - protein, 657 aa, Triticum aestivum
  misc_feature (141)..(141): Xaa can be any naturally occurring amino acid
LLAGLLVLAFWLRSGGSAPPKPPPASFRPPPVKVDADDADDGRKRVTIFFGTQTGTAEGFAKAMAEEAKARYEKVLFKVVDLDDYAAEDDEYEEKLKKETFALFFLATYGDGEPTDNAARFYKWFTEGKEKEVWLKDFNYXAVFGLGNRQYEHFNKVAKEVDELLLEQGGKRLVPCGLGDDDQCIEDDFTAWKELVWPELDQLLRDEDDTTGATTPYTAAIPEYRIVFIDKSDLEFEDKSWTLANGNGVIDAQHPCRANVAVRKELHKPASDRSCIHLEFDISGTGLVYETGDHVGVYSENSIETVEQAETLLGLSPDTLFSIHADAEDGSPRKGGGSLAPPFPSPCTLRTALLRYADLLNAPKKAALTALAAHASDPTEAERLRFLASPAGKDEYAQWIVASQRSLLEVMAAFPSAKPPLGVFFAAIAPRLQPRFYSISSSPKLAPSRIHVTCALVYGPTPTERIHQGVCSTWMKNTLPLEYSEECSWAPVFVRQSNFRLPADPSTPIIMIGPGTGLAPFRGFLQERLALKESGVELGSSVLFFGCRNREMDYIYEEELQNFLQEGALSELIVAYSREGPTKEYVQHKMVDKATEIWNVISQGGYIYVCGDAKGMAKDVHRVLHTIVQKQGSLDNSKTELYVKNLQMEGRYLRDVW

SEQ ID NO: 6117 - protein, 555 aa, Triticum aestivum
  misc_feature (173)..(173): Xaa can be any naturally occurring amino acid
MVCAAVSLAGGSATATATSLSRRPALGLRSRRLLWARAMSHVAPRLSSATVGAPTPDHDQRPGRARAVAAQAGPRQALISLSDKTDLANLGNGLESLGFSIISTGGTASSLEAAGVNVTKVEQITNFPEMLDGRVKTLHPSIHGGILARRDQEHHLKALNEHGIGTFDVVVVXNLYPFYDKVTSGTISFEDGIENIDIGGPTLIRAAAKNHKDVLVVVDHHDYPALLKYLQEKQVDPQFRRMLAWKAFQHVASYDSAVSEWLWKQSSGGDIFPPSFTVPLSMKSTLRYGENPHQKAAFYGDRSLSLVNAGGIATSFQHHGKEMSYNNYLDADAAWNCVSEFENPTCVVVKHTNPCGVASRQDVLEAYRLAVKADPVSAFGGIVAFNTTIDEDLAKEIREFRSPTDGETRMFYEIVVAPGYTEKGLEVLKGKSKTLRILEAKGSGNIMLIVFPPQLYHLLPGVPRGATHSPGCAPLRSGLRPIVHPFRSGSSPESMKQLLSAAGERSESVVDGLVRTALVSLHNGVCKACRACLLAVPDNAAFSPAPFRTAVASPL

SEQ ID NO: 6118 - protein, 383 aa, Triticum aestivum
  misc_feature (7)..(7): Xaa can be any naturally occurring amino acid
  misc_feature (13)..(13): Xaa can be any naturally occurring amino acid
  misc_feature (22)..(22): Xaa can be any naturally occurring amino acid
  misc_feature (28)..(31): Xaa can be any naturally occurring amino acid
  misc_feature (43)..(43): Xaa can be any naturally occurring amino acid
  misc_feature (66)..(66): Xaa can be any naturally occurring amino acid
  misc_feature (155)..(155): Xaa can be any naturally occurring amino acid
  misc_feature (370)..(370): Xaa can be any naturally occurring amino acid
LKLSKPXMNGHEXVDSNVFCMXTNEDIXXXXSAMLKVLRAVQXERWVSWRALRGAASKAVDSQELXDYSLRGLRGKLMDDGHFIAVRCNAETSAIEYRLETYSNQSPVDATVFGPSVEHLAHDLRFLYDALLNPEIMLSSQPEVVGASAHNAAAXILDCKQFIKHYDESAPESPPNPILLAVRCSIELLDHPKDYTAPPVELVLLPATATLGELKMLAARVFQETYLMFHSFQAEQLPEFPNLSDTTPVKHVLGPSQLVRVRGRCTGDHRRIVQFRMERGLENWTVDCTCGAKDDDGERMMACDACGVWQHTRCSGISDFEEVPEKFICRKCASPRKGKGGRGGGGGSGGGRMEMASAGRCKDEIGSCCXGRAGKIGRLATVG

SEQ ID NO: 6119 - protein, 430 aa, Triticum aestivum
NLTSPVVLDDFRCPISLDLMKDPVIVSTGQTYERGCIERWLEAGHNTCPKTQQKLLNKSLTPNYVLRSLIAQWCEANGVEPPKRPAQPNNTPATCTASEHSKVIELLQKLSSQNLADQRGAAGMLRQLAKRSAENRACIGEAGAIPILVSLLPTTDVSTQEHVVTALLNLSIYEENKARIITSGAVPGIVHVLKRGSMEARENSAATLFSLSLVDENKVTIGASGAIPALVLLLGNGSQRGKKDAATALFNLCIYQGNKGKAVRAGLVPILLELLTETESGMVDEALAILAILSSHPEGKAAISAAAAIPILVGVIRNGSSRNKENAAAVLVHLCNGEQQQQHLAEAQEQGIVTLLEELAESGTDRGKRKAIQLLERMNRFLKQQSQAQGDAMAQAHAQSQTLSQALVQVQADTQLEESLPPTSSHLPER

SEQ ID NO: 6120 - protein, 80 aa, Triticum aestivum
LLTAACGQQCRMRFAGWYLKIAVGGAAIGAAMELFMIHTGFYEKVTVLESEKRAWESSPEAQAMREALNPWHKRDEKEKK

SEQ ID NO: 6121 - protein, 703 aa, Triticum aestivum
  misc_feature (238)..(238): Xaa can be any naturally occurring amino acid
  misc_feature (278)..(278): Xaa can be any naturally occurring amino acid
  misc_feature (297)..(297): Xaa can be any naturally occurring amino acid
MDSAAAGMRDSALDLLAALLTGRAPPAAADGDQNRRLLALLATSLAVLVGCGVALLFRRSSSGAAPLAHKSAAAKPLAAKKDQEPDPDDGRQRVALFFGTQTGTAEGFAKALAEEAKARYDKAVFKVLDLDDYAAEDEEYEEKLKKENIAFFFLATYGDGEPTDNAARFYKWFSEGNERGEWLSNLKFGVFALGNRQYEHFNKVGKEVDQLLAEQGGLTGKISFKRDRGGTGPCHPVXFGCRNRQMDFIYEDELNNFAESGALSELVVAFSREGPTKXEDATHINKSFSLSNGHVLXDSQHRLRRRQGHGKGRAPPASDRSCIHLEFDIAGTSLTYETGDHVGVYAENSIETVEEAEKLLDYSPDTYFSIYADQEDGTPLFGGSLPPPFPSPCTVRVALARYADLLNSPKKSVLLALAAHASDPKEAERLRHLASPAGKKEYSQWIIASQRSLLEVISEFPSAKPPLGVFFAAIAPRLQPRYYSISSSPRMAPTRIHVTCSLVHGQTPTGRIHKGVCSTWMKNSTPLEESQECSWAPIFVRQSNFKLPADPTVPIIMVGPGTGLAPFRGFLQERLALKETGVELGRAILFFGCRNRQMDFIYEDELNNFAESGALSELVVAFSREGPTKEYVQHKMAEKAAELWSIVSQGGYVYVCGDAKGMARDVHRALHTIVQEQGSLDSSKAEGYVKNLQMEGRYLRDVW

SEQ ID NO: 6122 - protein, 222 aa, Triticum aestivum
  misc_feature (60)..(60): Xaa can be any naturally occurring amino acid
  misc_feature (153)..(153): Xaa can be any naturally occurring amino acid
TTLLLWFVFYANSFAYYGLVLLTAQLSNANRSCASGLKYVKSETDASLYKDAWNLSRGHXVLAEASGLIASALLVEWFGRKATMWCLLFTCCGFLGPLVFYQSELWTTGLLFGARACAMGSYTVVCLYAPEVVYCSLNLSMNNPSIVFLYSVXLYPTSVRSTGVGIATAMGRVGGIICPLVAVGMLRSCHQMEAIIVFEVVLFLAAIACMLFPFETKGRAMN

SEQ ID NO: 6123 - protein, 111 aa, Triticum aestivum
GYAEKQALGEVSQELLDTQVNPAVWEISGHIVLKRRSDYEEASETSAWKLLAEVSLSEERFEEVKAYIFSAAGLVLSDEEEEEASEGKGTTTFAPVPVSPMPVAEGCLVHQ

SEQ ID NO: 6124 - protein, 510 aa, Triticum aestivum
  misc_feature (188)..(188): Xaa can be any naturally occurring amino acid
MQTQLVEPAQPQAQEMFQAMAPDQQQQGEAEHPDAGGEEARKVGVPVFVMMPLDTVRKDGSALNRRKAVQASLAALKSAGTAGIMVDVWWGIAESEGPGQYNFAGYIELMEMAKKAGLKVQAVMSFHQRGGNVGDSVNIPLPKWVTEEMDQDQDLAYTDRCGRRNYEYISLGADTLPALKGRTPIQCXYADFMRGCRDHLAAYMGDTICEIQVGMGPAGELRYPSYPESNGTWSFPGIGEFQCYDRYMRASLKAAAEAVGRPEWGNAGPEDSGSYNQWPEDTGFFRREGGWNTDYGQFFMSWYSQMLIEHGERILSACSSVFTGTPGVKVSVKVAGIHWHYGTRSHAPELTAGYYNTRNHDGYLPIARMIGRHGAVLNFTCVEMRNHEQPQDAQCMPEALVSQVASAAKEAGVGLAGENALPRYDETAHDQVLATAAEKAEEDRMVAFTYLRMGPDLFQPDNWRRFAAFVKRMTETGVRDVSREQVEREAQGVAHATQGVIQEAAVALCN

SEQ ID NO: 6125 - protein, 345 aa, Triticum aestivum
MTVGGEATATAMGHGQTVCVTGAGGYIGSWIVKLLLEKGYAVRGTVRNPDDAKNAHLRGLAGAAERLVLCKADLLDGDALRAAIAGCHGVFHTASPVTDDPEEMVEPAVRGTRYVIDAAAESGTVRRVVLTSSIGAVAMDPSRGPDAVVDESCWSDLEFCKKTKNWYCYGKTVAEREAWEAAAARGVDLVVVNPVLVQGPALQPAVNASLTHVLKYLDGSAKTYANAVQAYVHVRDTAAAHVLVFESPAAAGRYLCVADGAVLHREDVVTILRKFFPEYPIPSRCSDEVNPSKQPYKMSNKRLRELGLEFTPVAQCLYDTVVSFQEKGVLPAPPASAKPAMKETN

SEQ ID NO: 6126 - protein, 162 aa, Triticum aestivum
MKMTLEGYLCVARRAAIRIKRQLKIVPQIIKRKDSHLYRHLQKLRAADCFFVYRMVVVLFRRELAFEQTVCLWEVMWADQAAIRAGIGRTTWGKIRLHAPPTDDLLLYAIAACVLQRRKLIIEKYSSMDEILRECNSMAGQLDVWRLLDDAHDLVVNLHDKI

SEQ ID NO: 6127 - protein, 302 aa, Triticum aestivum
  misc_feature (100)..(100): Xaa can be any naturally occurring amino acid
MATPAALGRHAVRARAAATTLAPAPLPAGNGGLSVAKAMSRARDNGMTAFIPYITAGDPDLATTAEALRLLDACGADVIEVGMPFSNPYADGAVIQASAXRALAAGATSDTVMAMLKEVTPELSCPVVIFSYFNPIERRGTGSFTAAAREAGVRGLIVPDLPYTEASVLSIEAKKNEIELVLLTTPSTKAERMNEITSASEGFVYLVSINGLTGTRPDVNPRVKDLLREIKQVTDKAVAVGFGISTPDHVRQVAQWGADGVIIGSAMVKQLGEANSPREGLKRLEVYAKSLKDALHAVICTI

SEQ ID NO: 6128 - protein, 676 aa, Triticum aestivum
  misc_feature (290)..(290): Xaa can be any naturally occurring amino acid
MHPAGEAPPLLATIQEDDELVSESMKSGGGVVESCRCEVEAAGINYHITVSARPHPLKIWSRPDDLLLDAAGGPAAPAPPPVSRSSRCRLVLRNVGCRARPGELLAIVGPSGAGKSTLLEILSGRLEPSSSSPADLRVNGSAVDAAALRRLCGYVTQRDVLFPLLTVRETLHFSARLRLGPDAYDAAAVDALVDDLALARVADARVKDLSGGERRRVSIGVEAVRDPAVLVLDEPTSGLDSASALQIVGALRAMAESRGRTVVLSIHQPGARIVKMFDAVLLLAAGSVLXTGSVDALHSLLTGAGLRLPPHVDAVEFAIDSVDELRLHLHLQQQHQRDRRCTLQQLFQQHKLQAQADDDSAAGMLADGGTSGQHRYANSWPREVAVLSQRFFKNVARTRQLFACRTVCMLVAGLALGSIFYDLAEDKAADRVGLFAFLLTFLLSSTTEALPVFLQEREILAKETSSGAYRVSAYAVANALVFLPFQLVLAAVFAAPAYWLTGLRRTAPAFSYFLLLIWLVLYTANSVVACFAAAAPDFVVGNAAVQGVMGSFFLFSGYFIRRSAMPAYWVPMHYLSLFKWPFEALLLNEFGGRCAARAMGVCVATGDEVLRREGIGGECRWRNVAVMVGFVAFYRPLGYAVLRVRCSLTLRAAARSALLSSSSHYSACFSASTAKA

SEQ ID NO: 6129 - protein, 146 aa, Triticum aestivum
ELLQLIEEEDIPAPAPIEQRWTAHSRSPMSPASSSEEDDIFSWVGIIMYLPTSDPRQRKDITEEFFNYRSLTQTSLWDDYSAYEHWAKIEVPKDKDELAQLQARLRKRFPVDAYNKARMELDPNKVLSSAKLEKFFPGMQTVQHAR

SEQ ID NO: 6130 - protein, 160 aa, Triticum aestivum
  misc_feature (44)..(44): Xaa can be any naturally occurring amino acid
  misc_feature (61)..(61): Xaa can be any naturally occurring amino acid
MRKIVKKKAGFDIMDLDTIQVAKRCFVPALFGHATEDDFILPHXHSDKICEAYVGDKNIIXKFDGDHNSPRPQFYFDSITIFFHNVLNPPDVPDDHYFLTPHGSLGQGHWDTEHDIEYRIAQSPTAPSTTTEDAIAQLRSRRLMSRMEVPSGTATEGRAD

SEQ ID NO: 6131 - protein, 135 aa, Triticum aestivum
MASTACFVIVSKNDIPIYEAEVGSAPKKEDLAYHHQFILHAALDVVQDLAWTTNAMFLRSVDRFNDLVVSVYVTAGHTRFMLLHDSRSEDGIKSFFQEVHELYIKIFLNPLYLPGSRIASSHFDTKVRALARKYL

SEQ ID NO: 6132 - protein, 330 aa, Triticum aestivum
  misc_feature (228)..(228): Xaa can be any naturally occurring amino acid
  misc_feature (253)..(253): Xaa can be any naturally occurring amino acid
MARPSKGKVCVTGASGFVASWLVKRLLESGYHVLGTVRDPGNQKKVAHLWNLAGAKEGLELVRADLLEEGSFDDAVMACEGVFHTASPIITNADSKEEMLDSAINGTLNVLRSCKKNPFLKRVVLTSSSSTVRLRDEAEFPPNVLLDETSWSSVEFCESIQIWYAVAKILAEKSAWEFAKENNIDLVAVLPTFVIGPNLSPVLGPTASDVLGLFKGETEKFTIFGRMXYVHIDDVASCHILVYETADAKGRYXLCNSAVLDSNELVALLAKRFPSFPIPKSLPNIYGEQTYGYNTSKIRKLGLEFRGVEEMFDDSVESLKAHGYLREGAA

SEQ ID NO: 6133 - protein, 379 aa, Triticum aestivum
KEEQGRPRSMEPIPLMTPYQMGPFEFSHRVVLAPMTRSRSYGNFPQPHAIRYYTQRATEGGLLISEATGVSADAQGMSAIPHTPGIWTKDQVQAWRPIVDAVHAKGATFFCQIWHVGRASDMQQEPISSTDKPIERTPENYSMDFSTPRSLTEEEIPDVVNQFRIAARNALEAGFDGVELHAGNGYLLDQFMKDSVNDRADGYGGSLENRCRFTLEVVDAVSNQIGPYCVGVRLSPYSSCLGCRDSDPDELAVYMARELNRRDILYLNVVEPEMAWEYDGGALGVGHHRLQAMRDTFDGTLMVGGGYGREEGNCAIAEEYADLVAYGRLFLANPDLPERFRRNAPLNKYNRATFYTDDPVVGYTDYPFLGQTSKGNGVI

SEQ ID NO: 6134 - protein, 234 aa, Triticum aestivum
  misc_feature (202)..(202): Xaa can be any naturally occurring amino acid
MASTPPQADYGKEAVLDVSENQDVETGEVKNGGLQRDLKNRHMQMIAIGGAIGAGLFVGSGGALQKGGPAALLIGYLIIGIMLLCTCLALAEMAVLYPVNGAFFTYICRFVDPSWGFAMGWQYALAWLTVLPFELIAASITIKFWREDINMAVWVSVFLVTLIGIQFFGVRGYGEVEFVLSIIKICAWCGFIILGIVINCGXGVGDQGYIGVKYWQDPGAFTSFKGFCAVFVVA

SEQ ID NO: 6135 - protein, 357 aa, Triticum aestivum
SYLPILPFRVSTHTPAAACRRRKEHGEMSSGMGKVVCVTGASGYIASWLVKLLLHRGYTVRATVRDTADPKKTLHLQALDGAKDRLHLFKASLLEEGSFDAAIAGSDCVFHTASPFYHNVKDPKAELLDPAVNGTLNVLRSCKKASIKRVIITSSMAAVAYNGKPRTPDVVVDETWFSSAEVCEKNEQWYVLSKTLAEEAAWKFANDNGFEIVTINPAMVIGPLLQPTLNTSAEAILKFINGSSSTYPNFSFGWINVKDVALAHILAYEVPSANGRYCMVERVAHHSEIVKIIHEMYPDFPVPDKCADDAPFVPIYQVSKDKIRSLGMELIPLETSLKETIESLREKGFVTSESSHL

SEQ ID NO: 6136 - protein, 524 aa, Triticum aestivum
  misc_feature (99)..(99): Xaa can be any naturally occurring amino acid
  misc_feature (122)..(122): Xaa can be any naturally occurring amino acid
  misc_feature (137)..(137): Xaa can be any naturally occurring amino acid
  misc_feature (170)..(170): Xaa can be any naturally occurring amino acid
  misc_feature (205)..(205): Xaa can be any naturally occurring amino acid
  misc_feature (284)..(284): Xaa can be any naturally occurring amino acid
PPPPRPLDAADPAPAPSRPLPVVGTAKLAERPLHRHGDWRAPALAPPPPVIPPTTGASRGELPAGTPEDVDAAVAAARPALRTNRARVGTRAPGPLRAXSPREFGANVIELIWDLSSPGTLXWERPLGGAMWHADFXFPAFSAARGARKQSAEVAMLQIFKRNIFNEPIXGVPLVYLCYYHLLKVVSYVGCGLAARCSGVLKQSXLASLTCLELGDVCKEIGLPSGVLNIVTGLGHEAGAPLSSHPDVDKVAFTGSYATGQMIMVAAAPTVKPVTLELGDRSSXGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGKGGIDNYLSIKQVTEYTSDAPWGWYKAPAN

SEQ ID NO: 6137 - protein, 503 aa, Triticum aestivum
MVATAKIPQRQLFIDGDWRAPALGRRLPVINPTTEASIGEIPAGTSEDVDAAVAAARAALKRNRGRDWSRAPGAVRAKYLRAIAAKMVERKSDLARLEALDCGKPLDEAAWDMDDVAGCFEFFAGHAEALDKRQNAAVALPENFKCHLKKEPIGVVALITPWNYPLLMAVWKVAPALAAGCTAVLKPSELASLTCLELGDVCKEIGLPSGVLNIVTGLGHEAGAPLSSHPDVDKVAFTGSYATGQKIMVAAAPTVKPVTLELGGKSPIVVFDDVDIDKAVEWTLFGCFWTNGQICSATSRLLIHKNIAKEFVDRMVAWSKNIKVSDPLEEGCRLGPVVSEGQYEKIKKFVANAKSEGATILTGGVRPKHLEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGKGGIDNYLSIKQVTEYTSDAPWGWYKAPAN

SEQ ID NO: 6138 - protein, 394 aa, Triticum aestivum
MAASLLRRAASGRGRCPSPAESLRRLVSSEAAPEQALPRPLPEMRPFEHRPSPYAGMGGAEILEKRKKFLGPSLFYYYQKPLNIVEGKMQYLYDEQGKRYLDCFGGIVTVSCGHCHPDIVKAVQEQTKLLQHTTTIYLHHAIVEFAEALASKMPGNLKVVYFVNSGTEANELAMLMARLYSGNLGMVALRNGYHGGSAGTIGLTGLQTWKYPIPQGEIHHVMNPDPYRGAFGSDAAAYAREVEEHINFGSSGRVGGFIAETFQGVGGTVELAPGYLKSVYDTVRKAGGVCIADEVQSGFGSSGSNYWGFQTQDVIPDIVTMAKGIGNGLPLGAVVTTPEIASVMAQKIQFNTFGGNPVCSAGGLAVLKVLDKEKRQAHCADVGAHLVERLKSLA

SEQ ID NO: 6139 - protein, 278 aa, Triticum aestivum
  misc_feature (28)..(28): Xaa can be any naturally occurring amino acid
INSISNNSDGETFISADDLRINLWNLEXNSQSFNIVDVKPTNMEDLTEVITCAEFHPTHCNTLAYSSSKGSIRLIDLQQSALCDNHSKIFEEHEAPGARSFFTEIIASISDVKFSRDGRYLLSRDYMTLKLWDLNMDSGPVSTFQVHEHLRPRLCDLYENDSIFDKFECCLSGDGLHVATGSYGNLFRVFASTPGSMEVTTLEASRNPMRRQIANPTRPTRGTLTSMTRGVRRGGENLGVDANGNSLDFSTKLLHLAWHPTENSIACAAANSLYMYYA

SEQ ID NO: 6140 - protein, 151 aa, Triticum aestivum
  misc_feature (107)..(107): Xaa can be any naturally occurring amino acid
MSSLMDKAKGFVAEKIAHIPKPEASLDSLSFKGMSRECITVHSNVNVSNPYDHRLPICELTYTLKCAGNVVASGTMPDPGWIAASDTTKLEIPAKIPYDFLISLVKXVGRDWDIDYQLDVGLTIDLPIVGNFTIPLSTSGEMKLPTLKDMF

SEQ ID NO: 6141 - protein, 139 aa, Triticum aestivum
MCGIFAYLNYNVSRERRYVLEVLLNGLRRLEYRGYDSSGIAVDADLPAPLPSGSAPAPYAGAPPLVYRQEGKIENLVRSVYAEVDEKDVNLDAAFNVHAGIAHTRWATHGVPAPRNSHPQSSGAGDEFLVVHNGIITNY

SEQ ID NO: 6142 - protein, 242 aa, Triticum aestivum
SARGSILLRERTLIFGGKSYYGALLCCSWSADGKYILSGGEDDLVQVWSMDDRKMVAWGEGHTSWVSSVAFDSYWSPPSSDDAGENAMYRFGSVGQDTQLLLWDLAMDEIAVPLRHPSSGSPTFSSGSPSAHWDSACPPPTALPQPSPRMRDVPKLSPLVAHRVHADPLSGLEFTSESIVTICREGLIKIWARPQHSENSQRPNSSELAAGNAISKDKMITSPNKAGASSSSFKQPSSVIFS

SEQ ID NO: 6143 - protein, 650 aa, Triticum aestivum
MILLGSSSPSTPAIIAPRPRRLRHRTTTPSLPHSRSPHRHLVLASSSPAPTPRPLARAHRPGAVATAAEMVFSVTKKETKPYEGQKPGTSGLRKKVTVFQQPHYLANFVQSTFNALPADQVKGATIVVSGDGRYFSKDAVQIIAKMAAANGVRRVWVGQDSLLSTPAVSAIIRERISADGAKATGAFILTASHNPGGPTEDFGIKYNMGNGGPAPESVTDKIFSNTKTVTEYLIAEDLPNVDISVIGVTSFTGPEGPFDVDVFDSATDYIKLMKTIFDFESIKKLLASPKFSFCFDGLHGVAGAYAKRMFVDELGASESSLLNCVPKEDFGGGHPDPNLTYAKELVDRMGLGKTSNVEPPEFGAAADGDADRNMVLGKRFFVTPSDSVAIIAANAVQSIPYFASGLKGVARSMPTSAALDVVAKNLNLKFFEVPTGWKFFGNLMDAGMCSVCGEESFGTGSDHIREKDGIWAVLAWLSILAYKNKDNLGGDKLVTVEDIVLQHWATYGRHYYTRYDYENVDAEAAKELMANLVKMQSSLSDVNKSIKEIQPTVADVVSADEFEYKDPVDGSVSKHQGIRYLFGDGSRLVFRLSGTGSVGATIRIYIEQYEKDSSKTGRASSDALSPLVDVALKFSKIKEYTGRSAPTVIT

SEQ ID NO: 6144 - protein, 229 aa, Triticum aestivum
  misc_feature (62)..(62): Xaa can be any naturally occurring amino acid
MAPAFTSLLPAATSAAASRLPSAAAGAASTFARLPHHPTGWAGASVAAPRTAAARKRAPGVXYATAATDKSIYDYTVKDIDGKDVPLKKFKNKVLLIVNVASQCGLTTANYTELSHIYEKYKTQGFEILAFPCNQFGAQEPGSNTQIKQFACTRFKAEFPIFDKVDVNGPNTAPIYKFLKSSAGGFLGDLVKWNFEKFLVDKNGKVIERYPPTTSPFQIEKDIQKLLAA

SEQ ID NO: 6145 - protein, 216 aa, Triticum aestivum
MAYRAEDDYDYLFKVVLIGDSGVGKSNLLTRFTRNEFSLESKSTIGVEFATRSIHVDDKVVKAQIWDTAGQERYRAITSAYYRGAVGALVVYDVTRHVTFENVERWLRELKDHTDANIVIMLVGNKADLRHLRTVPSEDAKAFAERENTFFMETSALEAMNVEDAFTEVLSQIYRVVSKKALDIGDDPAAPPKGKTINVGSKDDVSAVKKSNCCSS

SEQ ID NO: 6146 - protein, 460 aa, Triticum aestivum
MARSSSPLVNKASPTEQPRLLCTRRSSKRVTALSPEALLDATLAGVEQQDDAGVIAAATALKRDATLSDETLAVHAGEKMGKNGAMDTDSIATPIVSGTTHWFKSSGDLVAFKEGRRHGFEYGRYGNPTVKVLEDKISALERAESTLVTSSGMNAIVATLLALVPPGAGHVVTTTECYSEARAFIRDKLSKMGIKVTFVELNDMDTLKAVLDQGDVTLFYTDCPTNPHLKCIDIKLVAELCHRKGALVCIDSTLASPINQKPLTLGADIVVHSATKYIAGHHDVIAGCISGSDALISRIRAWHHDLGGAISPDAAYMIIRGLKTMALRVETQNRTALRMARLLENHPKIERVYYPGLLSSPWHDIAKSQMTGFGGVISFEVASDLHGVMRFVDALEIPFIATSLGGCESLVQQPAVMSFWGQSDEEKAKNGIKDNLVRFSFGIEKFEDLRDDIIQALEKI

SEQ ID NO: 6147 - protein, 218 aa, Triticum aestivum
MAVAYRAEEEYDYLFKVVLIGDSGVGKSNLLSRFARDEFSLDTRSTIGVEFATKTVRVDGKLVKAQIWDTAGQERYRAITSAYYRGAVGALVVYDVTRHITFENAERWLTELRDHTDANIVVMLVGNKADLRHLRAVSPEEARAFAERHRTFSMETSALEATNVEDAFTEVLGEIYRVVSKKALDIGDDPAAPPRGKTIDVGGKDDVTPVNTGGCCSA

SEQ ID NO: 6148 - protein, 447 aa, Triticum aestivum
  misc_feature (379)..(379): Xaa can be any naturally occurring amino acid
PKAPKLTEAMSLYDGGLAGVYPEEEDDRLADLAGDSDYDDDEYVQSISKASEDTSAMDVLKGKDIQGIPWERLTITRDGYRKSRLEGYTNFENIPNSGQLSEKVCTPVEKGQLYYEFAHNTRSVRPTIFHFQLRNLVWATTRHDVYLMSHMSVLHWSPLTSEKHEVIDLQGHVAPCVKHEGNFYEGFYRTHVSTLAVKNNLLVAGGFQGELICKFLDREGISYCSKSTHDDNGITNCLEIFEKPSGSVHFLASNNDCGLRDFDMEKFQMCNHFHFDWAVNHTSLSPDGKIIAVVGDNPDGVLVDASSGKVIHELSGHLDYSFASAWNPDGRTFATGNQDKTCRIWDARNLSKSVAVLGGNMGAIRSIRYTSDGKFLAMXAEAADFIHIFDVGSGYDRKQELDFFGEIAGISFSPDTEALFVSVHDRNYSSLLQYSRRRFYGYLDSAL

SEQ ID NO: 6149 - protein, 468 aa, Triticum aestivum
  misc_feature (296)..(296): Xaa can be any naturally occurring amino acid
GTRAHSAGYYDDETGAFNELLLISGKAMQVWVDYESDSTQISVFLAPLKNGAKPSTPLVSAKSNLSKVLVEPAYAGFSSSTGTVRSRHYLLGWSFAMDGPAPPIDIGSLPKLPFVGAKPRSKVPDIVLPIATAAFVLGVVAVVILLVRRRSRYAEVREEWEVEFGPHRFTYKDLFRATEGFKNKTLLGFGGFGRVYKGALPKSKLEVAVKKVSHESRQGIKEFVAEVVTIGRLRHRNLVQLLGYCRRKGELLLVYDYMSNGSLDKYLYSGSKEKPALDWAQRFRIIKGVASGLLYXHEDFEQVIIHRDIKASNVLLDADMNGRLGDFGAFILEVACGRRPVEQAMNDSRLMLVDWVLEHWQKESLLEVVDARLDGNYDAGEVVLALKLGLMCSHPMPGARPSMRQVMQYLEGDMPIPELTPTQMSFSMLALMQSQGFDSFVLSATSDPSSATNTMMTMGTISGLSGGR

SEQ ID NO: 6150 - protein, 158 aa, Triticum aestivum
KIKWDPDLVNHLMYALSLSGHYEVLARHLEMLLPGTYGRSERWYVLALCYSAAGMDDSALNIIRNGFRVLQRKGKPHIPSLLLGAKLCCKNPKHASEGIKFANKARESFRSHDMHFISAVNHFLGVCYGPFARSSTSHTEKMRLQDDALRLLQDAAAT

SEQ ID NO: 6151 - protein, 508 aa, Triticum aestivum
MQPYLELASLRITATIPLSPRIYSTIFLEAMAAMAYIALRGAALAAIVALIHWVYRWRHPKCAGTLPPGSMGIPIIGETLQFFAPNPTCGLSPFVRDRVKRYGSMFKTSIVGRPVVVSADPDVNHYVFQNEGKLFESWYPDTFTEIFGRDNVGSLHGFIYKYLKTLVLRLYGQENLKAVLLAETDAACRGSLAAWAAQPCVDIKDGLSTMIFDLTAKKLIGYEPTKSSESLRENFTAFIRGLISFPLNIPGTAYHECMEGRKKAMKVLKGMMQERMADPERKCEDFFDHVIQELRREKPLLTETIALDLMFVLLFASFETTALALTLGVKLLTENPRVVDALTEEHEAIVRNREDPDAAITWAEYKSMTFTAHVIMEIVRLANIVPGIFRKALQDVEIKGYTVPAGWGIMVCPPAVHLNPDIYEDPLAFNPWRWQDKPEITGGTKHFMAFGGGLRFCVGTDLTKVLMATFIHNLVTKYRWKTVKGGNIVRTPGLGFPDGFDIQLFPKN

SEQ ID NO: 6152 - protein, 224 aa, Triticum aestivum
PAGSRKKKTPGESVYGEKRISVDEVVKNDDGTTTTTKIEYRMWNPFRSKLCAAIAGGADEIYIKPGSRVLYLGGASGTSVSHVADIVGPTGYVYAVEFSSRSGRDLITMASKRPNVVPIVEDARQPARYRMIVPMVDVIFADVAQPDQARIVAMNANWFLKVNGGVLISIKANCIDSTAPAAEVFAAEVQKMRAESIKPKFQLTLEPFERDHCLVAGEYLRYKS

SEQ ID NO: 6153 - protein, 159 aa, Triticum aestivum
GGGFGESSADPWVDEFQEHMSSFKQSSGTSRGVYVFSENNPYVGHPNPMQEGQELFRKGLLSEAVLALEAEVLKNPDNAEGWRLLGVTHAENDDDQQAIAAMMRALEANPTNLEILLALGVSHTNELEQGEALRYLSRWLQNHPKYGGLVPPQSTGFTL

SEQ ID NO: 6154 - protein, 241 aa, Triticum aestivum
MATNIEDVPSVELMTELLRRAKCSSKPDKRIILVGPPGSGKGTQSPLIKDEYCLCHLATGDMLRAAVTAKTPLGIKAKEAMDKGELVSDDLVVGIIDEAMKKPSCQKGFILDGFPRTVVQAQKLDDMLAKQGAKVDKVLNFAIDDAILEERITGRWIHPSSGRSYHTKFAPPKTPGVDDVTGEPLIQRKDDTAVVLKSRLEAFHMQTEPVIDYYSKNGLVANLHAEKPPKEVTVEVQKALS

SEQ ID NO: 6155 - protein, 193 aa, Triticum aestivum
MDGLVAFSRRRRRWLLLAALGTASAYGAYKIYHLPVVAARRRRLVRLAGALADFLDAAASSADAAALVSSDLADFVRSDSDELPRSVAHIAKLVVSPEVSATVSALSHPIAAGVLRGVSSTPGTGSGDRAGRAPPLNVLPFPGSPPPPAPAVSPPPSRHLVMDFYSRASPPGKSSSSPDCLRWNERVMGTRGV

SEQ ID NO: 6156 - protein, 165 aa, Triticum aestivum
  misc_feature (41)..(41): Xaa can be any naturally occurring amino acid
LVPIIRDNLNLAKADIGNAGVASVSGSIFSRLAMGAICDLXGPRYGCAFLVMLAAPTVFCMSLIDDAAGYITVRFLIGFSLATFVSCQYWMSTMFNSKIIGTVNGLAAGWGNMGGGATQLIMPLVFHAIQKCGATPFVAWRIAYFVPGLMHVVIGLLVLTMGQDL

SEQ ID NO: 6157 - protein, 214 aa, Triticum aestivum
MTVAAARCLILTPTISSSSAALRLPRIARRRPLSCSASPLAVFATMDSPPEGYRTNVGICLADPSLTKIFSASRIDIPTAWQMPQGGIDPGEEPRAAAVRELREETGVRSAEIVAEAPNWLTYDFPADVKDKLNARWGTNWKGQAQKWFLFRLTGGDDEINLMGDGSEKPEFSEWAWMTPQQVIEKAVDFKKPVYEETLKHFAPYLQSDPTASS

SEQ ID NO: 6158 - protein, 139 aa, Triticum aestivum
  misc_feature (14)..(14): Xaa can be any naturally occurring amino acid
  misc_feature (16)..(16): Xaa can be any naturally occurring amino acid
  misc_feature (29)..(29): Xaa can be any naturally occurring amino acid
RDGVPHLVVYTAYXYXCLSSLVVGVALNXWCLYRPMAGVPRSTLRAYAGDREGRGLALLAGLVSGLGNAFTFMAGQAAGYAAADSVQALPLVSTLWGVVLFGEYRRSSRRTYTLLGSMLFMFVVAMAVLMASSAHRKPL

SEQ ID NO: 6159 - protein, 61 aa, Triticum aestivum
RPVARRRQKADPAFAPGVYHIEPGGLSCGDVVNILQNLQGDVVAGDVLEFTLQRDTVDPAS

SEQ ID NO: 6160 - protein, 116 aa, Triticum aestivum
  misc_feature (81)..(81): Xaa can be any naturally occurring amino acid
MKRVRGFKIGHRFVKIFRWIRSKRTQTMKRQCPTRITNPIAGIRSLARSLSRRAKRLCGGKKNSGQSQIRLGKDPRTSASXKVVPKGHLVVHVGESDGDTRRVVVPVIYFNHPLFG

SEQ ID NO: 6161 - protein, 498 aa, Triticum aestivum
  misc_feature (203)..(203): Xaa can be any naturally occurring amino acid
  misc_feature (238)..(238): Xaa can be any naturally occurring amino acid
  misc_feature (257)..(257): Xaa can be any naturally occurring amino acid
  misc_feature (267)..(267): Xaa can be any naturally occurring amino acid
  misc_feature (313)..(313): Xaa can be any naturally occurring amino acid
MAAAVVDAAVPVAAKANGAGARCCAAKGPGYATPREAMEKGPREGLLYVTCVYNGTGIDKPDYLATVDVDPNSATYSQVIHRLQATHIGDELHHSGWNACSSCHGDPSTSRRFLILPSLLSGRLYVVDTAKNPRAPALHKVVQAEDIAEKTGLGFPHTSHCLATGDIMISCLGDKEGNAAGNGFLLLDSEFNVKGRWEKPGHXPLFGYDFWYQPRHKTMISSSWGAPAAFRTGFDLQXHVQDGLYGRHLHVYDWPGXGELKQTLDLXGSTGLLPLEVRFLHDPSKDTGYVGCALTSNMVRFFKTADGSWSHEXLAISIKPLKVRNWILPEMPGLITDFVISLDDRYLYLVNWLHGDIRQYNIEDPAKPVLAGQVFVGGLLQKGSDVVYVTDDDKEEQYAVPEVKGHRLRGGPQMIQLSLDGKRVYVTNSLFSRWDEQFYGPDLLKKGSHMLQIDVDTEEGGLAVNPNFFVDFGTEPEGPSLAHEMRYPGGDCTSDIWI

SEQ ID NO: 6162 - protein, 372 aa, Triticum aestivum
  misc_feature (77)..(77): Xaa can be any naturally occurring amino acid
  misc_feature (85)..(85): Xaa can be any naturally occurring amino acid
  misc_feature (160)..(160): Xaa can be any naturally occurring amino acid
  misc_feature (203)..(203): Xaa can be any naturally occurring amino acid
MARPGHSTAWLPLLVLLFAAGATAQSCLSATFTGGRTFLKCNQLPVLGASLHWTYHAGNGTADIAFRAPSGADGWVXWGINPSGXAWPAAVLTTILRTTAPTLDTTTISIDLPHLPTPPSPSTCPSRPAPSTPAAPKHHVAEHGWHGTRPSPAAVVSQHXISGHNVQSLQRLDFLSGTSTGASNSRLHRRNLHGVLNGVGWGXLIPLGAMIARYLRVFEAADPAWFYLHIACQISGYALGVAGWGLGLKLGSESKGLTYTTHRSIGIAIFCLATLQVFALFLRPDKKNKYRVYWNAYHHSVGYSVIVLAAVNIFKGLNILKPVTGWKTSYVVILATLAGVALVLEAITWAIVLRRRKRNQAHGGANGTGVQL

SEQ ID NO: 6163 - protein, 193 aa, Triticum aestivum
FFFDFSLTYVGAGMICSHLVNLSLLFGAVLSWGVMWPLMSKQEGKWYSAKASASSMSGLYGYKAFLCIALLIGDGFYNFLKVILVTLKSIHEKSQRGRLNRVADEDSVAIDDLQRNEVFNRDNIPAWVTYAGYALLSAIAVVAIPLMFREVTRSRPSSALRSPFAPASSAPPLSSASHFYQLELPCMDEHLNL

SEQ ID NO: 6164 - protein, 236 aa, Triticum aestivum
  misc_feature (185)..(185): Xaa can be any naturally occurring amino acid
  misc_feature (196)..(196): Xaa can be any naturally occurring amino acid
  misc_feature (206)..(206): Xaa can be any naturally occurring amino acid
  misc_feature (208)..(208): Xaa can be any naturally occurring amino acid
  misc_feature (215)..(215): Xaa can be any naturally occurring amino acid
MAATIQSVKARQIFDSRGNPTVEVDVCCSDGTFARAAVPSGASTGVYEALELRDGGSDYLGKGVSKAVNNVNSIIAPALVGKDPTAQTELDNFMVQQLDGTKNEWGWCKQKLGANAILAVSLAVCKAGASVKKIPLYQHIANLAGNKQLVLPVPAFNVINGGSHAGNKLAMQEFMILSTGATSFXGGMKMGREVYXNLKSVIKEEXTXQDATNVXNEVVLLLNLRETKEGLELLNT

SEQ ID NO: 6165 - protein, 98 aa, Triticum aestivum
  misc_feature (56)..(56): Xaa can be any naturally occurring amino acid
MAAAEEEIAVKEPLDLIRLSLDERIYVKLRSDRELRGKLHAYDQHLNMILGDVERXVTTVEIDDETYEEIVRTTKRTIPFLFVRGDGVILVSPPLRTA

SEQ ID NO: 6166 - protein, 119 aa, Triticum aestivum
MEEGREGWPCAAAGEAVAAEEGEEEDQFDRLPDAVLLDVFNRIGDVKALGRCALVSRRFHGLVPLVDSVFVRVDCVIPDEPAPSSAGSPQAAAPSRGRGALAHIARLVLGGIVRPIQAL

SEQ ID NO: 6167 - protein, 87 aa, Triticum aestivum
RVEARGAEAYNCPFCGEDFDFVGLCCHIDDEHAVEAKSGVCPICATRVGVDLIGHLTMQHGSYFKMQRRRRVRKVSFGSHSLLSLVR

SEQ ID NO: 6168 - protein, 190 aa, Triticum aestivum
  misc_feature (156)..(156): Xaa can be any naturally occurring amino acid
  misc_feature (187)..(187): Xaa can be any naturally occurring amino acid
MLPYATAAEAEAALGRAMTRAEAAWLRYSAFVPDHLLYCHNVAILLILYTIAPLPLALLELRARAAPDGVAAAVMRPSTYKLQPRAQLSPAAFLRCYLDTGRVLLLTVGALSLVSYPAVKMVGIRTGLPLPSAGEVAAQMLVYLLVEDYLGYWIHXLLHTRWGYDNIHRVHHEFTAPFGYAAPYAHXPHP

SEQ ID NO: 6169 - protein, 325 aa, Triticum aestivum
RLAFTSLYLVYVLVVVFIHGRSHDGEAEAAWVDTTASSELCNVVETDFYPDQEPLLPERAPLLQYYAGDATKKKKGVFWSAVRVLELPLYLPRRLTIPDASEERWSKPAAVAAATLSPVFLSCLWSHATGSPLLAPLLGGIAGLFLGLLAFLGTNADAPPTKFLSAWLAGGFVMSVAWEYVIANELLSLLVSAGLVLGVDPATLGMTVLAWGNSLGDLIANVAVAVAARRGGAQVAVAGCYGGPVFNVLVGLGLSLLLSCWVGYPNPVAIPWEPRLYQTLGWVATGLFWAFVMLPRRGMKVDRTLGFGLLAIYLCFLCTTPCLFA

SEQ ID NO: 6170 - protein, 435 aa, Triticum aestivum
  misc_feature (90)..(90): Xaa can be any naturally occurring amino acid
  misc_feature (118)..(118): Xaa can be any naturally occurring amino acid
  misc_feature (161)..(161): Xaa can be any naturally occurring amino acid
ASASPHGLASGEPSAAPLFLWFCGDPHRQAPPEWTRTGMARLPCLGRCREGRAVRLGPPRRGHPETSAPGRPVLYLDGVLPTNGRLGPPXRHDEAWGDCVRRRGQQPKEQLDPALNGXRAIPCTKANGLVYTDIGANRYVSAPPSGACKSEIRRRDACTTXRHIVQMCMHVILVSIELGQFAHVTNYVSKAEQTPDTLDAVIVAKLRAAAGLANLETKKYKLAARKFLETGPELGSNYSEVIAPQDVAVCGALCALASFDRSELKSKVIDNINFRNFLELVPEVRELVNDFYASRYGSCLEHLEKLKPNLLLDIHLREHLGTLYNDIRHKAIIQYTLPFISVDLNTMASAFKSSVSMLEKELAALITENKIQARIDSHNKILYARHADQRNATFQRALQTGNEFERDIKAMLLRANLIKHDFNQKNWPGQRKMNL

SEQ ID NO: 6171 - protein, 104 aa, Triticum aestivum
IRDLTPHKFSRFIPLPMAMAIPFYIGSYFAIDMFLGSFILFVWEKVNKAKADAFGPAVASGLICGDGIWTLPQSILALAKVNPPICMKFLTRGDNVKVDKFLGG

SEQ ID NO: 6172 - protein, 246 aa, Triticum aestivum
MMDLHIKPDPQQEAHESAPSTKSFQHSPEATGTELERALHGRHLQFIAIGAAVGTGLFIGTGNALATAGPVSLLIAFIFVGTLLFSVMTALGEMAAYIPVAGAFTTYATRFLDPTFGFAMGWIYWFSWSITFALELTAAGLIIQYWEKDLSIGIWITVFWFLFTAANFMPVRWFGEFEMWFSSIKVITIIGFIIFSICVNAGVGDQGYIGFKYWKDPGAFNEHIVEGDIGRFVGFWSVLITAGFSY

SEQ ID NO: 6173 - protein, 174 aa, Triticum aestivum
MATGRGLPLLLVLAALLVGLASASPFISDGVFQAGAGSTTGRTLLQAKRDCPVNFEFQNYTVITSRCKGPKYPPKDCCDSFKEFACPFNNYINDESNDCASTMFSYINLYGKYPPGLFAHECREGKLGLSCEGVPQKDVVKSGVQRARSSSLALITLMCGLVALFFQYTVPWWW

SEQ ID NO: 6174 - protein, 198 aa, Triticum aestivum
GNNITQNQSVLHIWGQVGPEDRVGAGPSHRGARGALGQTAAASSGRPGRSRTFQSIYLMLQSFVANQLLDCPTADDTTQVKLLFGAKGTVSIQGKCVGGERRVAIYRMERGVDKWTVNCSCGAKDDDGERMLSCDSCHVWQHTRCVGISDFVQVPKRFVCASCKLLHKSKMYSSFPNKRCKTGSFSHASSGLWRPNIS

SEQ ID NO: 6175 - protein, 333 aa, Triticum aestivum
  misc_feature (113)..(113): Xaa can be any naturally occurring amino acid
  misc_feature (129)..(129): Xaa can be any naturally occurring amino acid
SSAKRRWHGRQTPVFPRILGHEAGGIVESVGEGVTELVPGDHVLPVFTGECKDCAHCKSEESNLCDLLRINVDRGVMIGDGQSRFTISGKPIFHFVGTSTFSEYTVIHVGCLXAKINPSAPLDKVCVLXSCGISTGLGATLNVAKPKKGSTVAIFGLGAVGLAAMEGAKMAGASRIIGVDLNPAKYEQAKKFGCTDFVNPMDHTKPLQEVLVEMTNGGVDRAVECTGHVDAMISAFECVHDGWGVAVLVGVPHKEAVFKTHPMNFLNERTLKGTFFGNYKPRTDLPEVVEMYMRKELDVEKFITHSVPFSQINTAFDLMLKGEGLRCVMRMDE

SEQ ID NO: 6176 - protein, 379 aa, Triticum aestivum
  misc_feature (72)..(72): Xaa can be any naturally occurring amino acid
  misc_feature (146)..(146): Xaa can be any naturally occurring amino acid
  misc_feature (241)..(241): Xaa can be any naturally occurring amino acid
MATAGKVIKCKAAVAGEAGKPLSTEGVEVAPPQAMEVRVTVLDPALCPKAVYFRVAKGQTPVFARLLGHEAXGLVDRGGGGGRGLGAGDDVARGLGEQREERPHCACEDSNLRHLFNTKVERSGMIGDGQCRVAIDGKPLSHHVGXSTFNVSTVIQVRGLPQSYPETPVAQVRLVRLSVPTGRGATLNVAKPKEGMTVTGSSLGAVGLAAMGGARMSGASRIVGVDLNPAKHEQAKKFGCXDFVNPKDHTKPVQEVLVEMTDGGVDRAVECTGNVDAMISAFECVHDGWGVAVLVGVAHKEAVFKTHPMNFLNERTLKGTFFGNYKPRTDLPGVVEMYMRKELELDKFITHSVPFSQINTAFDLMLKGEGLRCVIRMDE

SEQ ID NO: 6177 - protein, 186 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGAT

SEQ ID NO: 6178 - protein, 205 aa, Triticum aestivum
  misc_feature (73)..(73): Xaa can be any naturally occurring amino acid
  misc_feature (98)..(98): Xaa can be any naturally occurring amino acid
  misc_feature (134)..(134): Xaa can be any naturally occurring amino acid
MATSKKVVTREEWEGKPRDVKIRKEDMNRLVMNFLVTEGFVDAADRFPFRVESGTRPDIDLATITDRMEVNKXAVQSGNVQEAIEKINDLNPTILDTXNPELYFHLQQQKLIELIRAGKIKEALEFAQEELAPXCPSGARLAGGHRVNSATVGIAACLTSPSRWTVPRLPTLLDGLCWAQNQLSEKAAHPRINAPPSADLVDPAI

SEQ ID NO: 6179 - protein, 282 aa, Triticum aestivum
MPRYDDRYDRYDDRYDRYDDRFDRYNDRYDRYDRYGGNTKLYVGHLSTHTRTKDVEYLFGRYGRIRCVELKYDYGFVEFSDPRDADDARYELDGQEVDGSRIIVEFARGTPRGPGGSREYLGRGPPPGSGRCFNCGIDGHWARDCNAGDWKNKCYHCGEKGHIEKNCQNSPKNIKRGRSYSRSPPPHRERSLSRSYSRSPYPRRDDRAVGHEERRPRSSSYSPRRSASPSGLNRSPAPNGKSHPPKEQAEVNGSHNGVRGNSLSPARDSRPATNRMSPSPWE

SEQ ID NO: 6180 - protein, 167 aa, Triticum aestivum
  misc_feature (138)..(138): Xaa can be any naturally occurring amino acid
  misc_feature (146)..(146): Xaa can be any naturally occurring amino acid
  misc_feature (153)..(154): Xaa can be any naturally occurring amino acid
MNHGAMGGRCFLNLLPYSTTPCKDGVGIGTPGSSSWRHSVHHHHRTSKVVAGRRSAAASVSCSAASAQAPPSQSTIKVVIVGATKEMGRAAIAAVSRARGMELAGAIDTQCIGMDAGELSGMDEALEIPQRTDLTMVXGSIAQTRXTGVVVDXXEPSSVYDNVKQAA

SEQ ID NO: 6181 - protein, 591 aa, Triticum aestivum
SVEGYGSYGFRCGLFGMGHPLLDPYAKVIGDLVAANPLHVKGITAPSMSCLGSLATPPSYNWGRDKWPRLPLEKLVVYRANVALFTKDKSSGLPDNVAGTFSGVASRAQRVPRLRVNAVLLEPVFQFDQVKGPYFPYHFFSPMDSYGGEGCSASAITAMKDMVKAMHRNGIEVLLEVVFTHTAEGEADGQMISISGIDNSSYYIADEIAGCKSGILNCNSPVTQNLILDSLRHWVIDFHVDGFGFINAPFLVRGPRGEYLSRPPLLESIAFDPVLSKTKIIADPWSPLGISNVQFPFPHWKRWAEMNTRFSIDVRNFLKGEALISDLATRLCGSGDLFSNRGPAFSFNYVSRNSGLTLVDLVSFSNGDLASESSWNCGEEGPSEDSVVLQKRLRQIRNFIFILFVSLGIPVLNMGDECGHSSAGSTSYKDRVPLNWKALKTSFVKEVTGFISFLAALRSRRGDIFQRREFLKLENISWHGNNLSEPRWEDPTSKFLCMHIIAENDVNTPELTKGDLYICFNSNEEPASATLPAPAEGSVWLRLVDTSLALPGFFTTESNLKVHQVLGYSSYEVKAHSCVLFESKRDLPQFL

SEQ ID NO: 6182 - protein, 478 aa, Triticum aestivum
  misc_feature (186)..(187): Xaa can be any naturally occurring amino acid
MSTYLTPFTPLPSLFDGPAAADDHSSLLAFLMNDDLAAAPDAFPYYGGAEAAPAFFGHAAAPLPPPAAAPPAEMTGQGRKRGFVPAGDDGSSRPQAVRRKVQGSPPTSPAHSGGDAAPAARSGGRRVWVRERSTEWWDRLSGPACPDAEFRQAFRMSRATFDALCDELSAAVAKEDTALRAAIPVXXRVAVCLWRLATGEPLREVSRRFGLGISTCHNIVLQVCAALTAVLLPKAVRWPLESPAARFQALSGFPGVVGSVYTDHIPIGPPKDNVAEYYNRRLTERNNKASYSVAVQAVVDADGAFTDVCIGLPGSLSDAAVLERSALHARCETGMLGDDQCRLVGGASYPLTDWMLVPYAHQNLTWAQHAFNERIAAARAAAQGAFQRLKGRWRCLQRRTEPKLPDLHNMIGACCVLHNFCERSGEELDADFQSELSQQDDADVVAAANPVLSAAADKERDRIAHELLHGGHPSVTFL

SEQ ID NO: 6183 - protein, 149 aa, Triticum aestivum
MAEMNIDLGGLAGRPTTSQADPFQSALYGAGPGLIRSGLGAYSEKFLGSSSDFMQSNITQYLSNPQYYFQVNNQYVRNKLKVVLFPFLHRGHWTRITEPVGGRLSYKPPVQDINAPDLYIPLMAFATYIVVARYALGVLGRVLHTQDNF

SEQ ID NO: 6184 - protein, 171 aa, Triticum aestivum
MSLTIPSNLSKPAALRPKLSPKLRSAATTTIVCSTTNNNNNNNVSSDLKAFSAALALSSILLSAPLPAGADISGLTPCKESKQFAKREKQSIKKLESSLKLYEAQQRYWQLPHQGPLTHKQQDYVYHFFPQILSPARGCNTHPPYPTNDTITRYAPPQNLCQPLRVSSHPH

SEQ ID NO: 6185 - protein, 580 aa, Triticum aestivum
MAIRRQRRAFPLVPFLVSLLAVAAYGRLISDGMPATPSSSVLASPLSSAAIRLNSSSPATAAAPEECEQTYGFLPCTTTVFGNMFLVLTYGFLMFKAATFLSAGSELLLEIMGPGLVGGLLLPILGALPDALLVLVSGLSGTKETAQSQVLIGMGLLAGSTVFLLTLLWGTCVVVGKCDVGENGVAIDSTDTKGFSLTGSGITTDVQTSYAARIMAISVVPFVIAQFPKMLKTHHGERLAILLALIASFSLVLAYCLYQVFQPWVQKRKLAYAKHKHVISGILQHAQKQALGRLLNDDGSPNENVIRKLFHKIDNDDSRNLSRAELHALIIGINFDEIDFDKNDAVDKIMDDFDTSGNDTVEEDEFVAGMKTWLNEAKQKVAASGAYSNKFVNDYHARTREEHDQLVDRSDEAVESVENPGWCIAKAVGYLILGATICAAFADPLVDAVHNFSNATHIPSFFVSFIGLPLATNSSEAVSAIIFASRKKQRTCSLTFSEVYGGVTMNNTLCLGVFLALIYFRELTWDFSSEVLVILLVCVIMGLFTSFRTSFPLWTCLVAYLLYPLTLAVVYVLDFVFGWS

SEQ ID NO: 6186 - protein, 194 aa, Triticum aestivum
MLSKPPSDPAGKLSIETMEDEQSATYTVDDALISSGFGKYQILILSYAGIGLIAEAMEMMLLSFVGPSVQLEWNLTAHQESMITSVVFVGMLIGAYSWGVVSDNYGRRKGFLFTAIMTSGAGFLSAFSPNYVALMALRFLVGIGLGGGPVLGSWFLEFVPAPSRGTWMVVLSAFWTVGTIFEASLAWVVMPKYG

SEQ ID NO: 6187 - protein, 168 aa, Triticum aestivum
  misc_feature (35)..(35): Xaa can be any naturally occurring amino acid
MALARRFLFLFPAAVLTWLASASASPFLSDRVFQXQHRIHVRSLLQTKRDCPIDFEYQNYTIITSRCKGPQSPPTECCDAFKKFACPFAVYINNQSTNCADTMLTYINGRGSYPAGMFAAECLKGKQGVSCEGIPGIDTGVPSGGRRAHGISGRLIALLCGLGGLLFH

SEQ ID NO: 6188 - protein, 154 aa, Triticum aestivum
  misc_feature (90)..(90): Xaa can be any naturally occurring amino acid
MASPWDSSSSGLWAALGQASTMAQLVGVDALGLVSMVVQAALAARRHRDACMLLAQHVELIGGLLRELELAELMRREATSRPLEQLRGAXLRRCYALVTACQDCGYLRRLVLGARMADELRAAQHEIDMFIRLIPLISLVDNSTNSRRVQVAMF

SEQ ID NO: 6189 - protein, 154 aa, Triticum aestivum
MAAAVADAAVPAAARANGAGAGCCAAKGPGYATPREAMEKGPREGLLYVTCVYNGTGIDKPDYLATVDVDPNSATYSQVIHRLPATHIGDELHHSGWNACSSCHGDPSTSRRFLILPSLLSGRVYVVDTAKDPRAPALHTVVQAEDIAEKTGLG

SEQ ID NO: 6190 - protein, 165 aa, Triticum aestivum
MASEHAAAGEGKHEKQSLMDKAKEFVADKIAHIPKPEATLDAVTFKGLSRECITLHSSVNVSNPYDHRLPICEVTYTLRCAGREVASGTMPDPGWIAASGTTSLEIPAKVPYDFIVSIVRDVGRDWDLDYELQVGLTVDLPIVGNFTIPLSTSGEFKLPTLKDLF

SEQ ID NO: 6191 - protein, 352 aa, Triticum aestivum
  misc_feature (208)..(208): Xaa can be any naturally occurring amino acid
  misc_feature (270)..(270): Xaa can be any naturally occurring amino acid
  misc_feature (333)..(333): Xaa can be any naturally occurring amino acid
SKTHWPRPRTQADSFPSCPSLVASRCLLRFSTHNPGQNTRGAKQETEGSPPRRGSTSLPGRGPREALAFRSSSMRGKKMIYGFSISLILINLASIMERADENLLPAVYKEVSAAFDAGPTDLGYLTFIMNFLKSIASPLAGVLALQYDRPTILAVGTVFWALSTGAVGVSQYFQQVAFWRGVNGVGLAIVIPSLQSFIADSYREGTRXARFGLLSLIGSIGGIGGSIVATVMAGRDYWGFPGLRFAFIVVAFASLLIGLLVYFYTVDPRXNISTHTPETTTPMIGHVWMRNSELPPLPICDDSWITARSVMKARTYQIICLQGILCSLTWTAXVFFTMWIELLGFDNQSSAG

SEQ ID NO: 6192 - protein, 181 aa, Triticum aestivum
MGSEQNDSTSFTQSSEPKLCANGCGFFGSPSNMDLCSKCYRDICAEEAQTAVAKAAVEKSFKPSPSPPPPTLFIAEPDVAKPEKEKAVATVLVVAEPSSATGEATVPEQNEPPSKPARPNRCLCCNKKVGILGFKCKCGSTFCGEHRYPERHDCSFDFKEAGRGEIAKANPVIKADKLQRF

SEQ ID NO: 6193 - protein, 110 aa, Triticum aestivum
AFAINLLKDCVPAKVAKFVPIPMAVAIPFYLGPYFAMDMCIGSVILFCWEWMNKAEAQAFAPAVASGLMCGDGIWALPQAFLSLANVNPPICMKFLSRATNAKVDAFLGN

SEQ ID NO: 6194 - protein, 309 aa, Triticum aestivum
  misc_feature (280)..(280): Xaa can be any naturally occurring amino acid
  misc_feature (282)..(282): Xaa can be any naturally occurring amino acid
  misc_feature (294)..(294): Xaa can be any naturally occurring amino acid
MAAAGDAGEKKMVTLKSSDGEEFEVEEAVAMESQTIRHMIEDDCADNGIPLPNVTSKILSKVIEYCNKHVQAKPADAADAGAAAPDACASAGSNMCSALPFVVGPGMRRDGTTRFRDSQGEPLHDFLAVSSFSQYTVVDVNQVVKVDPAVPPKLACLLGCGAGTGVGAAWRLAKVQPGSSVVIFGLGAVGLSVAQGAKMCGAAKIIGVDLNPDKEELGKKFGVTDFVNPSKLGESPLSQVIIEMTGGGADYCFECIGAASVMTEAFRSAKQGNGKTVILXVXEKDGKPISLASXEVLFGKCVMGSLFGG

SEQ ID NO: 6195 - protein, 870 aa, Triticum aestivum
  misc_feature (362)..(362): Xaa can be any naturally occurring amino acid
  misc_feature (396)..(396): Xaa can be any naturally occurring amino acid
MERNGNANAGPPLEENKGADGKSGSRRSTRFKEENEYVEVTLDVGADDAVAVQGVRAAGETPEAALLPRSGGLSSRLKAELRRIASAKRGGGDNAPASQPRLDRSMTGAARALRGLHFLNQSVVTRGSWPEVDKRFDRLAVDGLLLRSRFGQCIGMVGSEEFAAQMYDALARRRGVVAQVLTKDELREFWEQLSDPGFDAKLQTFFDMVDKNADGRITEEELKEVLTLTASANKLTKILERVDEYTALIMEELDPDQLGYIELATLESLLLLPPSQAPTSLVAHSSNISQLISQRLVPARDANPLRRGLTAARYFLEDNWKRVWVMSLWLSINAGLFAWKFYAYRRHPTFDVMGYCVCVAKXGGAETTKFNMALILLPVCRNTLTWLRSRTSLGRXVPFNDNINFHKVVAGGVAVGVALHGVTHLTCDFPRLLHASDEAYEPMKRYFGQTRVPDYWWFVRGVEGVTGVLMVVLMAVAYTLAHPRFRRSKLGAGNPLKRLSGFNMFWYSHHLFVVVYVALVVHGVCLYINRTWYKQTTWMYLAVPVLLYAGERLLRALRSHGLTTVRIEKVAVYPGNVIAIHMSKPHGFRYRSGQYIYVNCGEVSPFEWHPFTITSAPGDDYLSMHIRCRGDWTSRFRAIFSQICRPPLAGQSGLLRADFTSMVEHNANAKFPRLLIDGPYGAPAQDYRKYDVLLLIGLGIGATPLISIVKDVLNNVHRQGQEQEGDEGFMTKRVYFYWCTREEGSFEWFRGVMNEVAERDAAGEESVVELHNHCTSVYEEGDARSAMVVMLQALHHAKSGVDVVSGTRVRTHFARPCWRDVFKRVACDHQGQRVGVFYCGDQKLTPELRRLSQDFSHRTTTKFVFHKENF

SEQ ID NO: 6196 - protein, 179 aa, Triticum aestivum
MAPPLPPPALISTTPIPTLRIVSPVPSLRWCRRARPLASAGLGAAARRDRRRSRSRRGRRGLRICAYTAEAEHGRWEEDVADDFYSVLGVMPDATSEEIKKAYYSCMKTCHPDLSGGHPDVTNFSMFINEVYTVLSDPVQRAVYDEIHGYTATATNPFVDDSAVKNHVFVDEFTCIGCR

SEQ ID NO: 6197 - protein, 298 aa, Triticum aestivum
  misc_feature (281)..(281): Xaa can be any naturally occurring amino acid
  misc_feature (288)..(288): Xaa can be any naturally occurring amino acid
DLLKRQTSEDFDGSFYTGDDPDLSFYNGDGIDRSFFNGDDPDRSFYERDGTDYNHESDDEPPRKRSEDIILTRAQSGFACRESLVKETKKVVRSEDDLGNKMINQYVHLGKIGAGSYGKVVLYRNIEDGKLYAVKVLNKPHMLKVRVVRSETAMTDVIREVSLMNMLSHPNIVNLIEVIDDPNSETVGLVLEWGGGNTAWGKGVGGAPCRPCLRVFGSGPSCLRSLIPIQCVSLPGLLSLTRTGSAWFGGFWGGQWCAVAVEVLRRSPGTSVFTAPECCQXSYHGRAXDTWQVVYSVL

SEQ ID NO: 6198 - protein, 107 aa, Triticum aestivum
ALCTKSRRPPAVFWRRVRPGGRRARVEASPGSGQQALGSGLWDTPTIGRLIIGQNGVLSTPAVSCIIRKIKAAGGIILTASHCPGGPGGEFGVKFNVANGGHTSWRK

SEQ ID NO: 6199 - protein, 390 aa, Triticum aestivum
ARGASQSNGWADEFQTQHNANANSWADQFVHEELSQGADNWVSEFSSEQNQSGLKEKWVDEFSKLNMDDWAEEFSGGAFGESSADPWADEFQNQLSASKSSGASRGVYVFSEMNPYVGHPNPMQEGQELFRKGLLSEAALALEAEVLKNPDNAEGWRLLGVTHAENDDDQQAIAAMLRAQEANPTNLEVLLALGVSHTNELEQGEALRYLSRWLQNHPKYGALAAPHQTDSPYGPDVVRLFNEAAQMSPEDADVHIVLGVLYNLSREYDKAIASFKTALQLKPQDYSLWNKLGATQANSIQSADAVLAYQQALDLKPNYVRAWANMGISYANQGLYEDSIRYYVRAVSMNPKADNAWQYLRISLGNASRSDMIAACDSRNLDVLQKEFPL

SEQ ID NO: 6200 - protein, 85 aa, Triticum aestivum
  misc_feature (16)..(16): Xaa can be any naturally occurring amino acid
  misc_feature (59)..(59): Xaa can be any naturally occurring amino acid
MSGVKKVTDVAGKACXAIDWDGLSKMLFSDEARTEFTNFRRTFEDINHQLHTNFSQERXAIEWEFYTKGIVSKVVDMYMEALDII

SEQ ID NO: 6201 - protein, 162 aa, Triticum aestivum
MQPKARIPADPPAPELDRIDCLPDSLVLLILNKLEDVHSLGRCAAVSKRFNDLVPLVHDVYVKIDRVVAVDGDPDDALNLSSPKPRNILSHFLKLMLFTIAKPFHGARGPGGAGGRPLFPRLAHHSPAQVLRSFTHVRNLHIELPSGDVGTEDGVLLKWRAE

SEQ ID NO: 6202 - protein, 148 aa, Triticum aestivum
MPSSTFSGTVSSPKLSVAVDMGNPFLNLTVDGFLKIGAVGVTKSLVEDTYKAIDKGSVSKSTLEHALKKMCKEGFYWGSVAGVYVGTEYGIERIRGTRDWKNAMLAGAATGAVISAATNKGKDKVVIDAIMGGALATASQFLNNHYFY

SEQ ID NO: 6203 - protein, 366 aa, Triticum aestivum
MRPTAAEDHVMKDVVLGMRHSYVHLSELDSTRSSTGNDDVAMNTGDGRICDADLPSIKNDWNNAGDRMIPGYEIAGGVTDVGKNETKFKAGDRVGVGCMVNSCQSCESCNKGFENHCPGIIPTYNTVDRDGTLTYGGYSSMVVVHERFVVRFPDAMPLDKGAPLLCAGITVYTPMKYHGLNAPGMHLGVLGLGGLGHVAVKFGKAFGMKVTVISSSPGKKQEALERLGADGFVVSKNADEMKAAMSTMDGIINTVSANIPMAPLFGLLKPNGKMIMVGLPEKPMEIPPFALVATNKTLAGSCIGGMRDTQEMLDLAAKHGVTADIEVIGAEYVNTAMERLAKADVRYRFVIDIGNTLDKAAATSSE

SEQ ID NO: 6204 - protein, 353 aa, Triticum aestivum
  misc_feature (106)..(106): Xaa can be any naturally occurring amino acid
  misc_feature (275)..(275): Xaa can be any naturally occurring amino acid
  misc_feature (298)..(298): Xaa can be any naturally occurring amino acid
  misc_feature (309)..(309): Xaa can be any naturally occurring amino acid
  misc_feature (322)..(322): Xaa can be any naturally occurring amino acid
  misc_feature (333)..(333): Xaa can be any naturally occurring amino acid
  misc_feature (340)..(340): Xaa can be any naturally occurring amino acid
MLGRGVGMSAPQWRGGALDLRAALRSGGNLLFGLFVAAVLAFTLLAAVHSPDDPLLHPSSHQLTAFLTSATSNSTFLADDSVLRTGEDFATGSNSSEDATPLSDPXFIELSDVGSEKTEVETEQSVTVDTDTDSNSAAQEDKPIVEAVSCDTEAPVDCTGDRELFNLLMRTSIERFPDLHFYRFGRPVVVPESPMACDLAWRFRPAEDARGRTTYYKDYRRFTLTRDINTCSLVVESIGEYHSGTGAKRSGRRKGQKGQKGKREAPVTTDFVPAXDQMRIDENGCYADTTTAADPGVXVGDAVNDSMRXVASEFDFRRGRYXIYIGRGERCRXDHYIWGXLCGLSEAQSESEL

SEQ ID NO: 6205 - protein, 182 aa, Triticum aestivum
  misc_feature (66)..(66): Xaa can be any naturally occurring amino acid
  misc_feature (72)..(72): Xaa can be any naturally occurring amino acid
  misc_feature (77)..(77): Xaa can be any naturally occurring amino acid
  misc_feature (88)..(88): Xaa can be any naturally occurring amino acid
  misc_feature (108)..(108): Xaa can be any naturally occurring amino acid
  misc_feature (126)..(126): Xaa can be any naturally occurring amino acid
MLVYQDKLSGDELLSDSFPYRELENGVLWEVDGHWVVQGAVDVDIGANPSAEGGAAVEGVDDQAVXKVVDIXDTFRXLQEQPAFDNEXFISHMKRYIKNLSAKLEGDXLDAFKNNVESATKYLLSXKLKDLQFFVRARACMIDGAARGVSAYYKGRELADPTVSCTFAHWAESRGEVLIAVC

SEQ ID NO: 6206 - protein, 266 aa, Triticum aestivum
  misc_feature (136)..(136): Xaa can be any naturally occurring amino acid
GDDQHSLVLRSDQEALVKLKDVGLQLAVSFSGEGSILATGGEDGHLRVFKWPGMETVIEEPDAKTSEKISWQCCHNENFVQHLLIAQSRVWDLKSCEGDECRIVSELEIFGFCGYSTTSHTRPDLFVTAMQGDYGXIISWNTTSWTRIGSKKVTRDAISAFSVSPDGTLLAIGTIEGSISVLGPRDMRVVLTVKKAHLGIVTTLAFSQDSRALLSTSFDSTTRVTSTESPKSDGISLWSMVLAIILGILVYYYMQHKEDLLAMLPQ

SEQ ID NO: 6207 - protein, 156 aa, Triticum aestivum
  misc_feature (121)..(121): Xaa can be any naturally occurring amino acid
MDASATVAAGKAKKGAAGRKAGGPRKKSVARSVKAGLQFPVGRIGRFLKKGRYAQRVGSGAPVYLAAVLEYLAAELLELAGNAAKDNKKSRIIPRHLLLAVRNDQELGRLLAGVTIAHGGXVIPNINPVLLPKKTAEKSPKEPKSPKKTAKSPKKA

SEQ ID NO: 6208 - protein, 155 aa, Triticum aestivum
MDASATVATGKGKKGAAGRKAGGPRKKSVSRSVKAGLQFPVSRIGRFLKKGRYAQRVGSGAPVYLAAVLEYLAAELLELAGNAAKDNKKSRIIPRHLLLAIRNDEELGKLLAGITIAHGGVIPNINPVLLPKKTAEKSPKEPKSPKKTAKSPKKA

SEQ ID NO: 6209 - protein, 152 aa, Triticum aestivum
  misc_feature (144)..(144): Xaa can be any naturally occurring amino acid
MAGAGVTTTGSPCGACKFLRRRCAAECVFAPYFCAEDGASQFAAIHKVFGASNAAKLLKQVAPGDRSEAAATVTYEAQARLRDPVYGCVAHIFALQQQVAALQAQVAHARTQAHLGPAATAMHPLLQQQLQQQAWQVAEQHDHXSMTSTQSS

SEQ ID NO: 6210 - protein, 327 aa, Triticum aestivum
  misc_feature (48)..(48): Xaa can be any naturally occurring amino acid
  misc_feature (83)..(83): Xaa can be any naturally occurring amino acid
  misc_feature (160)..(160): Xaa can be any naturally occurring amino acid
  misc_feature (236)..(236): Xaa can be any naturally occurring amino acid
  misc_feature (276)..(276): Xaa can be any naturally occurring amino acid
MPRYDERDRYGGNTRLYVGRLPSRTRTRDLEDLFGRYGRVRHVDMKHXVCICLSFSDPRDADEARYNLDGRDFDGSRMIVEFXAKGVPRGQGGGGDRDRGGRGGDREYMGRGPPPGSGRCFNCGIDGHWARDCKAGDWKNRCYRCGDSGHIERALPEQPXILKRGKSYSRSPAPRRGRVRDRSYRRSRRRSYSRSVSPIRDERRSTKPQVHRIPWWKVGASRCSCCGTPTKWSPDXRPRRSTFPSGMNRRSAPKWQTSHPPREQAEVNGSHNGERXPAPGENSRSPMKADSPNNMSPAANGRSPSPRDGEDNGNHRAPSGSASPGGG

SEQ ID NO: 6211 - protein, 256 aa, Triticum aestivum
  misc_feature (189)..(189): Xaa can be any naturally occurring amino acid
MNETNRDGIAHGSSTEKRPAEARRIQANSGSQLRKPLCSLLPASMPSPSLRLAVVGAGAAGLAAARELRREGHAPVVFERAAAVGGTWLYASPAPAAAADPLGAAATHSSLYASLRTNLPREVMGFLDFPFTAARGSVVDARRFPGHQEVLRYLEDFTQRFDLYGLVRFQTEVVGVRREAGGRWAVTSXRKLGEKGEPGPGRWDDAPRGFGNGHLFRAPPSPSITWRQKPWAREYPNRLPSHYTEWPGSHFLRNQS

SEQ ID NO: 6212 - protein, 504 aa, Triticum aestivum
  misc_feature (470)..(470): Xaa can be any naturally occurring amino acid
MGSNEGGGCDGKPVVVVPEIKYTKLFINGEFVDAASGKTFETRDPRTGDVLAHIAEADKADVDLAVEAAREAFEHGKWPRMSGYERSRAMNKLADLMEQHIEELAALDGADAGKLLLLGKIIDIPSAVQMLRYYAGAADKIHGESLRVSGKYQGYTLKEPIGVVGIIIPWNFPSLMFFLKISPALAAGCTVVVKPAEQTPLSALYYAHLAKLAGIPDGVINVVPGFGPTAGAAIASHMDVDSVAFTGSGEVGRLIMEASARSNLKTVSLELGGKSPLIIFDDADVDMAVELSRLAIFFNKGEVCVAGSRVYVQEGIYDEFVKRAVVAAQNWKVGDPFDVATNMGPQVDKEQFERVLRYIEHGKSEGATLLTGGKPASDKGYYIEPTIFADVKEDMKIAQDEIFGPVMSLMKFKTVDEAIEKANCTKYGLAAGIITKNLDIANRVSRSVRAGTVWVNCYFAFDPEAPFGGXYKMSGFGRDQGMMAIDKYMQVKSVITAVPDSPWY

SEQ ID NO: 6213 - protein, 136 aa, Triticum aestivum
EAIDSCPVDCIHWTSAAQVTLLEDEMRRVERVNVALMLSGMGSSFDVFRMASTRWEKRQAQVLNKVRMRMSQDDANKGSSWSDIWGSPTRYQKNEEDTKERVKRAAAAARRWREYSRKGADRPPTFKLPEAASNQE

SEQ ID NO: 6214 - protein, 348 aa, Triticum aestivum
METKAKDAWGLALVLFLGQLVAFSMAAASFASSFLANLGVNTPLTQSFFAYLLLTLIYVPILLHRRQKPRIPWYWYLALAFVDVQGNYLVVKAYQYSSITSVTLLDCWTVVWVIILTWYALGTRYSFWQFVGAGTCVAGLGLVLLSDAKSTDEQDGGQMPLLGDALVIAGTVCFAFSNVGEEYCVKKNDRVELIAMLGLFGLFVSAIQIFIFERKSLEAVAWSPTMISLFAGFAVALLVFYTITPFVPQMSGSTLFNLSLLTSDMWAVAIRLLFYQQQINWLYYVAFTVVAIGLIVYSLNESSSADGRATGTEVAPHYEQLPSEDGSTSGSNLDSQKTQQLEGAHGIC

SEQ ID NO: 6215 - protein, 275 aa, Triticum aestivum
  misc_feature (262)..(262): Xaa can be any naturally occurring amino acid
MGAPEVHHLFHNPIADHSFSADQSTLAVARDTSVELYGKVGSAFKLKDSLKGHDKTVTGVDIAPNSGRIVTCSQDRNAIVWEPSPEGYKPTLVLLRISRAATFVRWSPSENKFAVGSGDRVIAVCYFEEENDWWVSKHLKKPIRSTITSVAWHPNSVLLAAGSTDAHARVFSAFIKGMDARPPPGVWGERLPFNTVCGEYLNNSAGWVHSVSFSPSGDSLAFAAHDSSITVVYPSGPDQAPRAVVTVSTQQLPFQSLIWTQXDEIIAAGYDCEAF

SEQ ID NO: 6216 - protein, 227 aa, Triticum aestivum
VDTSGSGVKLTVEPAAGGEQTVIEADVVLVSAGRVPYTAGIGLDAIGVETDKGGRVLVDNRFMTNVKGVYAIGDAIPGPMLAHKAEEDGVACVEFIAGKEGHVDYDTVPGVVYTHPEVASVGKTEEQVKASGVAYQVGKFPLLANSRAKAIDDAEGMVKVISEKETDRILGVHIMSPGAGEIIHEAVLALQYGASSEDIARTCHAHPTVSEALKEACMNTYDKAIHM

SEQ ID NO: 6217 - protein, 106 aa, Triticum aestivum
MVSAAAEKGEDPRWRRSNTDCVFFLVSRVSCTKGSKCEYRHCEGARFNPRNCWYWFHGSCVNPSCTFRHPPMENFNRTKSLTVPPSSDGPISVKTANPCYFYYSSG

SEQ ID NO: 6218 - protein, 104 aa, Triticum aestivum
  misc_feature (81)..(81): Xaa can be any naturally occurring amino acid
MGPTVVAWGATSVDPFQGLKSTEGLHVRRRYNGARLGSVRNGGRVRCMQVWPIEGMKKFETLFYLPPFSTGALLKQVDYLXIRSKWGPCLEVSKGGFIFREHNA

SEQ ID NO: 6219 - protein, 206 aa, Triticum aestivum
MEVEAGAHGDTAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYF

SEQ ID NO: 6220 - protein, 168 aa, Triticum aestivum
  misc_feature (52)..(52): Xaa can be any naturally occurring amino acid
  misc_feature (141)..(141): Xaa can be any naturally occurring amino acid
  misc_feature (163)..(163): Xaa can be any naturally occurring amino acid
ERAHQWSQVYSEETKKQSIPVITAWQLNERMYGELQGLNKQETADLFGKEQXVHEWRRSYDIPPPNGESLEMCAERAVSYFKEQIIPQLVSGKHVMIAAHGNSLRSIIMHLDKLTSQEVISLELSTGIPMLYIFKEGKFIXRGSPAGPSEAGVYAYTKIWQYXQNLTH

SEQ ID NO: 6221 - protein, 538 aa, Triticum aestivum
MAMASRARTRWSALAASTLIQCFAGGSYCFGVYSPALKASQGYDQSALDAVAFFKDVGANVGVLSGLLAAWAPSGGRRRPWLVLLTGAALCAAGYLPMWLAVAGVVPAPLPLVCLYMLLAAQAQTFMNTADVVTAVENFPDRRGTVIGIMKGFLGLSGAILVQVQRTLRIDPGSFILMLAILPTAIALLLMYFVDVHSAHERYNKKFLDAFSLMAVTVAGFLMVVIICDQVFVISSAGQSVCFGILLLLILSPAAIVVRVQRTEPKQQEEPTPEEQTGLLLHEETAQQDSENASSSMALVGSNSQDMSSDKAENLNVVQAMCKLDFWLLFVAMACGMGSGLATVNNISQIGGSLGYTSRETSTLVSLWSIWNFSGRFGAGYVSDHFLRSRGVGRPFFIAATLLVMGVGHAIISSGFHASLYVGSVLVGLCYGSQWALMPSITSEIFGLNHFGTIFNTVAVASPVGSYILSVCVVGFIYDKESPQGELACAGKHCFALSFMIMACVCVFGSAVAFVLFVRTRKFYRRVIYARLLSFVDK

SEQ ID NO: 6222 - protein, 506 aa, Triticum aestivum
MAAVLPICLLLVLLLAIPLILFKSRRPAPHRGPGGRAVRLPPGPWALPVIGHLHHLAGALPHRALRDLARRHGPLMMLRLGELDAVVASSPDAAREIMKTHDASFASRPLTSMQQMAYGDAEGLIFAPYGDAWRQLRKICTVEIFSSRRVQSFRPAREEELGHLLRSVAAASASSSPVNLSERISAYVADSTVRAIVGSRFKQRDTYLEMLQEGLKIVPGMTLPDIFPSSRLVRLLSSVPGRIQRHSQDMKLFMDTIIQEHQVNSGPDCDGDKEEDLLDVLLRLQKEGDSQYPLTTDNIKTVMLDMFGAGSETSATTLQWAMAELIRNPRVMRKAQDEVRQQLAGHDKVREADLADLRYLGFVIKETLRMHPPAPLLLPRRCGSPCQVLGLDVPEGVMVIVNAWAIGMDPAHWEAPEEFAPERFEQNGRDFKGADFEFVPFGGGRRICPGMAFGLAHVELALAALLFHFDWELPGGAAAEDLDMTEEFGVTARLRSDLVVVAVATE

SEQ ID NO: 6223 - protein, 279 aa, Triticum aestivum
  misc_feature (170)..(170): Xaa can be any naturally occurring amino acid
MAKDIEAAPPGGEYGAKDYSDPPPAPLFDAEELTKWSLYRAVIAEFVATLLFLYITVATVIGYKHQADPAGPNAADAACSGVGILGIAWAFGGMIFVLVYCTAGVSGGHINPAVTFGLFLARKVSLVRALLYIIAQCLSAICGVGLVKGFQSAFYVRYGGGANELSSGFXKGTGLPAEVYTVFSATDPKRNARDSHIPVLAPLPIGFAVFMVHLATIPITGTGINPARSLGAAVIYNKDKAWDDQWIFWVGPLIGAAIAAYHQYVLRASAAKLGSYRSN

SEQ ID NO: 6224 - protein, 116 aa, Triticum aestivum
  misc_feature (59)..(59): Xaa can be any naturally occurring amino acid
DGVRLKKYRGMGSLEAMNRKDAKGAAMDRYFHNEMDKLKVAQGVSGAIVDKGSVRSFLXPYLACGIRHGCQDIGSRSLSALRSMMYSGELKLERRSNSAQAEGNVHSLFSYEKRLF

SEQ ID NO: 6225 - protein, 67 aa, Triticum aestivum
MVDVEHRMAGMAPAAHAAGLRRLSTRAAAGPSSASASPRHGLYSFQGVASSVLSHLRASGVAVLPGL

SEQ ID NO: 6226 - protein, 283 aa, Triticum aestivum
MALPAPRWLRREVLVGLALGQFVSLLITSTGFSSSELARRGVNAPTSQSLLNYILLALVYGGIMIYKRQHLTVKWYYYLILSIVDVEANYIVVKAYQYTSLTSVMLLDCWAIPCVLFLTWIFLKTKYGLRKLFGVGICVAGVVLVVFSDVHASERKSKGPSPLKGDMLVIAGASLYAVSNVTEEYIVKKSSRIEVMAMLGVFGAIISGIQICPLGRAQPRSALSSAGPLLPCLGCAPAWFLCHSAVPIILKICGATMLNLSLLTSDMWAVLIRIFAYHEKVDW

SEQ ID NO: 6227 - protein, 444 aa, Triticum aestivum
MDPQTFVRLSVGQLGLRLPGASARKACHCEIRLRGFPVQIAAVPLANSSEFNIDPHANAAVFSLDEPGLKALPTSRWFRAPEPPYLEIVVYVSRRDGGGHCVGLKRRLGGAVTVDVGPEWRDGKPVLLRHGWTGIGRAAELHVRVRVEADPRYVFRFEDEVALNPQVVQLHGGASQPIFSCKFIRDVRRASQPDHLGGQYWSSSGSGVEKETDMAGRRRERKGWKVAIHDLSGSAVAAAFMATPFVPATGCDTVARSNPGAWLIVRADTTGSSESWQPWGRLEAWRECAAPAGGKDAVCLRLHLLPERRDACVLVSETPLSCDKGGEFSIDMDRQSVLPEDAVASETPSASSYCAASMGESCAGGGFVMSCSVQGEAATSSRPPLVHLAARHVMCMEDAAMFLALAAAVDLSVKACRPFRSKTAPAKKKTAAGSSSPDPLELDT

SEQ ID NO: 6228 - protein, 85 aa, Triticum aestivum
PKSIHNPDILENFSKEYMYLACVMYVKKVKKGPFAEHSPMLDDISAVPNWKKVNSGLLKMYKAEVLEKVPIMQHFLFGSLIKWED

SEQ ID NO: 6229 - protein, 290 aa, Triticum aestivum
  misc_feature (177)..(177): Xaa can be any naturally occurring amino acid
  misc_feature (185)..(186): Xaa can be any naturally occurring amino acid
  misc_feature (199)..(199): Xaa can be any naturally occurring amino acid
MPPNGQSVHGGGGGLVSPTAAPAPSSKMDCFLTSVCTPLNLQFIDVAYRVKVERTAGPAKEPPGRISHSGGGGGGLGGVSAAVEERTILKGITGEARPGEVLAVLGPSGSGKSTLLSILGGRLAGRYSGTVLTGGRAPCRAVQRRTGFVAQDDILHPHLTVRETLAFCAMLRLPTSXPTSAKLAXXDAVIAELGLGACXDTIVGNAFVRGVSGGERKRVSIGHELLVTPSLLVLDEPDSGLDSNAASRLVARCRRCDPGAHGGACPCTAGQPGVPGVDSGCWLQGDGCLR

SEQ ID NO: 6230 - protein, 146 aa, Triticum aestivum
MAGRKGGDRKKAVTRSVKAGLQFPVGRIGRHLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKTTTKSPKKKVAAKE

SEQ ID NO: 6231 - protein, 173 aa, Triticum aestivum
MPIQRHRRQHHNISSSFQLAGEVASKMAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPKKSPAAAEKEAKSPKKKTTTKSPKKKTAATKE

SEQ ID NO: 6232 - protein, 147 aa, Triticum aestivum
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPKKSPAAAEKEAKSPKKKTTAKSPKKKTAATKE

SEQ ID NO: 6233 - protein, 147 aa, Triticum aestivum
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPKKSPAAAEKEAKSPKKKTATKSPKKKVAATKE

SEQ ID NO: 6234 - protein, 152 aa, Triticum aestivum
MAGRKGGDRKKSVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKTTTKSPKKKVATKAVEFRIA

SEQ ID NO: 6235 - protein, 85 aa, Triticum aestivum
WLSSATCVAPFQGLKCTGVLRVSRRSNGASLGSVSIGGRIRCMHVWSFEGIKKFETLSYLPPLSTVALLKQVDYLMRSKRVPWLE

SEQ ID NO: 6236 - protein, 151 aa, Triticum aestivum
  misc_feature (119)..(119): Xaa can be any naturally occurring amino acid
  misc_feature (122)..(122): Xaa can be any naturally occurring amino acid
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPRKSXAGXEKEAKSPRKKTTGKSSKKENGRTKGVARP

SEQ ID NO: 6237 - protein, 146 aa, Triticum aestivum
  misc_feature (7)..(7): Xaa can be any naturally occurring amino acid
  misc_feature (35)..(35): Xaa can be any naturally occurring amino acid
MAGRKGXDRKKAVTRSVKAGLQFPVGRIGRYLKKXRYAQRVGSGAPVYLAAVLEYLAAEVLELAGNAAKDNKKTRIIPRHLLLAVRNDQELGRLLAGVTIAHGGVIPNINSVLLPKKSAAAEKEAKSPKKKAATKSPKKKAVATKE

SEQ ID NO: 6238 - protein, 166 aa, Triticum aestivum
MDAGKLKKVAGKKFGGPRKKSVTRSIKAGLQFPVGRIGRYLKKGRYAQRVGSGAPVYLAAVLEYLAAEAGAGLSPPGAFVLELAGNAAKDNKKTRIIPRHLLLAVRNDQELGRLLAGVTIAHGGVIPNINSVLLPKKSPATAEKEAKSPKKKTTTKSPKKKVAAKE

SEQ ID NO: 6239 - protein, 147 aa, Triticum aestivum
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPAAAEKEAKSPKKKTTAKSPKKKVAATKE

SEQ ID NO: 6240 - protein, 250 aa, Triticum aestivum
MAAAAAASMARRLLSPTTTTSYSTTARLLISRRLASAASVPRAPAAAAKEMLRPAAVASSSALFLRGAGGARGMARRPGGGDGYAPARGGGGGDRAPTEMAPLFPGCDYEHWLIVMDKPGGEGASKHQMIDCYVHTLAKVLGSEEEAKRKIYNVSCERYFGFGCEIDEETSNKLEGIPGVLFVLPDSYVDPEHKDYGAELFVNGEIVQRSPERQRRVEPVPQRASDRPRYNDRTRYARRRENQQQQQPQR

SEQ ID NO: 6241 - protein, 226 aa, Triticum aestivum
MATSKKVVTREEWEGKPRDVKIRKEDMNRLVMNFLVTEGFVDAADRFRVESGTQPEIDLATITDRMEVKKAVQSGNVQEAIERINDLNPTILDTNPEIYFHLQQQKLIELIRVGKIHEALEFAQEELAPRGEENLAFLEEIEKTVALLVFEDVKNCPYGELLDVSQRLKTASEVNAAILTSQSHEKDPKLPSLLKMLIWAQNQLSEKAAYPRINNLSTADLEDPAI

SEQ ID NO: 6242 - protein, 520 aa, Triticum aestivum
  misc_feature (161)..(161): Xaa can be any naturally occurring amino acid
  misc_feature (202)..(202): Xaa can be any naturally occurring amino acid
MAGSMAPLGVKKERAAEYKGHMTFAVAMACIVAAIGGSIFGYDIGISGVNTMDPFLERFFPAVFRRKNLVTLNNYCKYDNQALSAFTSILYLSGQVSTLAAAPVTRNYGRRASIICGGISFLIGAALNAAAADLTTLILGRVMLGVGIGFGNQAVPLYLSXEMAPAHLRGGLNMMFQLATTLGIFSANMINYGTQKNQAWGXWRLSLGLVAAPALLMTVGGFLLPETPNSLIERGHDEEGRRVLELIRGTTDVDAEFTDMAEASELANTIKHPFRNILERRNRPQLVMAVCMPAFQILTGINSILFYAPVLFQSMGFGASGSLYSSMLTGAVLFLSTLISIATVDRLGRRKLLISGGIQMIVCQVIVAVILGVKFGTDKQLSRSYSIVVVVVICLFVMAFGWSWGPLGWTVPSEIFPLETRSAGQSITVAVNLFFTFVIAQAFLSMLCAFKFGIFLFFAAWITVMTVFVYIFLPETKGVPIEEMVLLWRKHWFWKKVMPDMPLEDGWGEGDAGRADNKGQ

SEQ ID NO: 6243 - protein, 129 aa, Triticum aestivum
MGNGLSPCVSMPAAAEAPAAARLVYWGGRTRALPVSDDEEGEGEGSGGLPCTAADVTAELLPADHVVCPADSFFVGLPVPVASPGERLLPGRTYFVLPRRLLSSPSPGGKAAVLTAATLASLSASPGGR

SEQ ID NO: 6244 - protein, 201 aa, Triticum aestivum
SRTECRANFAQEPRSFRAPLVLAHEKHPLQRLQRWLLARRFIFLFPAAVLAGLASASASPFLSDSLFQASTGSTGRSLLQTKNDCPMSFETQNYTILTNKCKGPQYPPTECCDAFKEFACPFAAYINNQSTNCADTMFSYINFRGYPAGLFADECLKGKEGVSCEGIPAVDTGVPSGGRQVQGVSRPLVVLLCGLGALLFP

SEQ ID NO: 6245 - protein, 102 aa, Triticum aestivum
RIPSPMGESFVDCGRIASKPDIAFSIGGKQFVLTPEQYILKIGEGDVTQCIRGFPAMDIPCPRGPFWILGEKFMGASQPVFDYGNIKIGFAKAAKGSPVVGG

SEQ ID NO: 6246 - protein, 375 aa, Triticum aestivum
PTTRTLLCTQAASFPFLFCLPSPLSAPTPQSTQPRPEEQEDGMSSGTGKVVCVTGASGYIASWLVKFLLQRGYTVRATVRDTADPKKTLHLQALDGAKDRLHLFKASLLEEGTFDDAVAGCDCVFHTASPFYHNVKDPKAELLDPAVNGTLNVLRSCKKASIKRVIVTSSMAAVAYNGKPRTPDVVVDETWFSSAEVCEKNKQWYVLSKTLAEEAAWKYANDNGLEIITINPTMVIGPLLQPTLNTSTEAILKFINGSSATYANFCFGWINVKDVALAHILAYEVPSANGRYCMVERVIHHSDLVKIIHEMYPEFPVPDKCADDAPFAPIYQVSKDRIRSRGVRNDPPGDISSPAYRSIPRTSAGGHDIRSYGEH

SEQ ID NO: 6247 - protein, 75 aa, Triticum aestivum
  misc_feature (16)..(16): Xaa can be any naturally occurring amino acid
  misc_feature (72)..(72): Xaa can be any naturally occurring amino acid
FVGNSFSTFSNLVVLXRTERLYKLGVESSCGEDVGLSSYAYNVIGDDGGPQRWMTDMLDTSLQRISYGTNNXSCH

SEQ ID NO: 6248 - protein, 280 aa, Triticum aestivum
METYTTDDALTTMGFGKLQGLVLVYAGMGWVAEAMEVMLLSFVGPLIREEWKISAQDESLLSSVVVLGMLIGACGWGYVSDKYGRRTGLLLSTLFTTGMGFLSALSPNYLCLMALRFLVGVGLGGSHVYSSWFLEFVPAQNRGFWMIIFSFFWTIGTVLEASLAWIVVSTLTWRWLLALTAIPCFLLLPFFGITPESPRYLCAQNRISDATLVLERIAETNQATLPPGVLVYPRDGEVDHSTLTSEADHLLPLREKDCTDDDVISPKSGSAAALRSLLSR

SEQ ID NO: 6249 - protein, 206 aa, Triticum aestivum
  misc_feature (139)..(139): Xaa can be any naturally occurring amino acid
  misc_feature (165)..(165): Xaa can be any naturally occurring amino acid
MSHRRVEACDSWRPPPAPAHAPALLLRAGNPWGRSYPPCAFASLSVREGGVKAEDVGEEKERTLAQAAAEVSGTKGKMPPVAQLLKHPLALLALVPSSVALFAAGAGAGAVAKTVTAPLDRVKLLMQTHSVRMAGESTXGIGFVQAMAEIGKEEGIKGYWKGNLXQVIRIIPYSAVQLFSYEVYKKVFRRKDGEPTGFGRLAAWAC

SEQ ID NO: 6250 - protein, 304 aa, Triticum aestivum
FRAAARAGVDESGKSVGPIVDGDAVVTFNFRADRMVMLAKALEFPDFDKFDRVRVPKVKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACKAADEAVKMVLDAVEQVGGIYLVTADHGNAEDMVKRNKAGEPMLDKSGSIQILTSHTLQPVPVAIGGPGLHPGVRFRSDIQTPGLANVAATVMNLHGFQAPADYETTLIEVVDK

SEQ ID NO: 6251 - protein, 276 aa, Triticum aestivum
  misc_feature (256)..(256): Xaa can be any naturally occurring amino acid
MTVVTLPEPFASIPRENFLFGASPLQPLPRISAALGGKVNVYAKREDCNSGLAYGGNKVRKLEYLAAEAQAEGCDTLVSIGGVQSNHTRAVTAVASKLGLKAATVQEHWVDWEDPGYEKVGNIQLSRLMGGDVRLDPSTFGIEHKTTLAKLKDELKSNGQKPYYIPAGASDHPLGGLGFARWAFEVEAQEKELGIFFDTVIVCAVTGSTFAGMIAGFKLAQKKNGSPARKIIGIDASGKVQQTFDQVLRIAKNTAXAKIGLSEDDITADDVILDPT

SEQ ID NO: 6252 - protein, 563 aa, Triticum aestivum
MPGAVKAGSRPPWLGLGAAVWLQASAGTSSAFALYSHALKVALGADQSRVALLGVACNVGDSLGLLPGVVCNKLHPALLLLVAAASGLLGYGVTWLAVSGVAPALPYWLIWIALCMGSNSGAWMSTAALVTNMRNFPLSRGAVAGILKGYSGLSAAVYTAIYTGALHGSAANLLLFLTLGVAIVCLLAMYFVRPCEPSLVENSSERVHFLFVQINSALLGVYLVCATTLDRFVTLTPALNYSLIAIMVILILAPFAIPVKMTLFRSVPRKVTSAAADSDHTEPFLLPSSSEQNFGKIEDEDAADIDLLLAEGEGAVKQKRRRPKRGEDFRFREALLKADFWLLFAVFFIGVGSGVTVLNNLAQVGTAAGVVGTTISVSLFSLGNFFGRLGGGAVSDYFVRSRTLPRTVLITCTQVVMIVNYLVFALGLKATLYISVAILGVCYGVHFSVMVSTSSELFGLKQFGKIYNFILLANPLGALVFSSLAGYVYDHEAAKQHSVAAVAGSDHVMVCYGPSCFRLTFFVLSGMACLGTFLSVILTVRIRPVYQTLYGGGPSSQPRSSAH

SEQ ID NO: 6253 - protein, 322 aa, Triticum aestivum
MLAAKLVCVTGGSGFVGSWLVRLLLDRGYTVHATVQNLQDEGETKHLQALDGADTRLRLFQMDLLDPASVRPAVEGVHGVFHLASPVILQPAQDPENELLLPAVNGALNVLRAARDSGVKRVVMVSSQTAMCPTTADWPAGKVIDDDCWADVEILKKLELWYNVSKTLAEKAAWDFAGEEGLQLVVLNPGLVLGPTLTPAPTGSLRLLMLLLGGQKLDMEPFFVGCVDVRDVAQSLVVLYENPSAQGRHLCMESAVRLVDFHDELANLYPEFPVHRIQEDKQGWVVRSKAPSKKLIDLGVRFTPFDKTVRDTVDCLRSKGEI

SEQ ID NO: 6254 - protein, 403 aa, Triticum aestivum
  misc_feature (42)..(42): Xaa can be any naturally occurring amino acid
STVESSTPGRHSFHQHKGPPPRTGGGRAEGGKEQTKEDEQDXLLTPYKMGRFDLSHRVVLAPLTRERSFGNVPQPHAILYYQQRTTKGGLLIAEATGVSDTAQGYKDTPGIWTKEQVEAWKPIVNGVHAKGGIFFCQIWHVGRVSNHTFQPNGQAPISSTDKPIKPATRADGIGLAKVSTPRRLTTDEIPLVIDDFRVAARNAIEAGFDGVEIHGAHGYLIDQFLKDQVNDRTDKYGGSLENRCRFALEVVQAVADEIGADKVGIRLSPFASYSDASDSNPEALGLYMAQALNKLGILYCHMVEPRMVNIGEKLETPHSLRAMRDAFKGTFIVAGGYGRDDGDKAIADGYADLVAYGRLFLSNPDLPRRFEIDGPLNKYNRDTFYLSDPVIGYTDYPFLPSDI

SEQ ID NO: 6255 - protein, 124 aa, Triticum aestivum
MGILLVSGRFLARRPPLALAPRCSRGSPDKRGRDEGDTSSTDWDKAWSTFKKKGKKTLFSEFSPNKYVTWNPRRSEYPLSEEVDPIKRAERSNLMLWTSPRFTLVGAIIIVSALLIYTLVVPPK

SEQ ID NO: 6256 - protein, 226 aa, Triticum aestivum
  misc_feature (38)..(39): Xaa can be any naturally occurring amino acid
MATSKKVVTREEWEGKLRDVKIRKEDMNRLVMNFLVTXXFVDAADRFRVESGTQPEIDLATITDRMEVKKAVQSGNVQEAIERINDLNPTILDTNPEIYFHLQQQKLIELIRVGKIHEALEFAQEELAPRGEENLAFLEEIEKTVALLVFEDVKNCPYGELLDVSQRLKTASEVNAAILTSQSHEKDPKLPSLLKMLIWAQNQLSEKAAYPRINNLSTADLEDPAI

SEQ ID NO: 6257 - protein, 226 aa, Triticum aestivum
MVVSPKIAPSMLSSDFANLAAEAKRMVDLGADWLHMDIMDGHFVPNLTIGAPVIESLRKHTSAYLDCHLMVTNPMDYVEQMGKAGASGFTFHVEVAKENWQELVSKIKSAGMRPGVALKPGTPVEEVYPLVEGETPVEMVLVMTVEPGFGGQKFMPNMMDKVRALRQKYPTLDIEVDGGLGPSTIEAAAAAGANCIVAGSSVFGAPESGKVISLLRTSVEKAQPTT

SEQ ID NO: 6258 - protein, 167 aa, Triticum aestivum
MEYQGQQHGQATNRVDEYGNPVAGHGAGTGMGAHGGVGTGTGAAAGGHFEPTREEHKAGGILQRSGSSSSSSSEDDGMGGRRKKGIKDKIKEKLPGGHGDQQHADGTYGQQGTGMAGTGAHGSAATGGTYGQPGHTGMTGTGTHVTDGAGEKKGIMDKIKEKLPGQH

SEQ ID NO: 6259 - protein, 216 aa, Triticum aestivum
  misc_feature (68)..(68): Xaa can be any naturally occurring amino acid
  misc_feature (164)..(164): Xaa can be any naturally occurring amino acid
MTVAAARCLILTPTISSSSAALRLPRIARRRPLSCSASPLAVFATMDSPPEGYRTNVGICLADPSLTXKIFSASRIDIPTAWQMPQGGIDPGEEPRAAAIRELREETGVRSAEVVAEAPNWLTYDFPADVKDKLNARWGTNWKGQAQKWFLFRLTGGDDEINLXGGDGSEKPEFSEWAWMTPQQVIEKAVDFKKPVYKETLKHFAPYLQSDPTASS

SEQ ID NO: 6260 - protein, 259 aa, Triticum aestivum
VFDGHGGKHAADFVCSNLPRFIVEGDGFPGEIEKAVSSAFLQTDAAFADACSVNSSLASGTTALAALIIGRSLLVANAGDCRAVVCCRGKAVEMSRDHKPSCNREKMRIEASGGYVYDGYLNGLLNVARAIGDWHMEGMKACDGLGPLSAEPEVMMRNLTEEDEFLIIGCDGIWDVFRSQNAVDFARRRLQEHNDPVACCKELVDEAIKRKSGDNLSVVVVCFNSIAPPVLTAPRPRVQRSISAEGLRELQGFLDSLAD

SEQ ID NO: 6261 - protein, 446 aa, Triticum aestivum
MAATIQSVKARQIFDSRGNPTVEVDVCCSDGTFARAAVPSGASTGVYEALELRDGGSDYLGKGVSKAVDNVNSIIAPALIGKDPTAQTELDNYMVQQLDGTKNEWGWCKQKLGANAILAVSLAVCKAGASVKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGVEVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 6262 - protein, 248 aa, Triticum aestivum
MDSEHWISRLAAAKRFYAAQLGHIDDMAGMGMEEVDMDMEDDGEMDMEMEMQLEEARWPEVACPYCYEDYDLGSLCVHLEEDHPYEPHPAPCPICSEKITRDMLNHITMHHGYLFKNGSRLRRFVIPERCALSLLSRDLRDAHLQALLGGGHSHRSRNTTTATTNIYADPLLSSFGLGFATSDAEEPLKSSVPVLDDTSILKEAPPQPWESSIDSSLTSEEREQKRKQATSRATFVQDLVLSTLFGDD

SEQ ID NO: 6263 - protein, 208 aa, Triticum aestivum
MDQEVKESKPSGEPNLFLQWGSRKRLRCVKSREDGSPSPARSDALRRTIPRVNRPLLGGNVAQFRSPRRPSTLHRRKSEAQASEARQSISLSPEKDRYYSTRGSPFPFEGNGFDFSGGVEEKGTAALPRFFISLSNKEKEEDFLAMKGCKLPQRPKKRPKLMQKCLLTVCPGAWLSDLSHERYEVREKKSSKKRARGLKALCMESDSE

SEQ ID NO: 6264 - protein, 148 aa, Triticum aestivum
  misc_feature (54)..(54): Xaa can be any naturally occurring amino acid
NFDLNKVFDSHAGIAHTRWATHGPPSRVNCHPHRSDPNWEFSVVHNGIITNYKXELKTLLESKGFKFETETDTEAIAKLTKYIYSEHPDLSFPSLVKAVIKELQGAFGLLLKSVHYPHEVVAARKGSPLVIGVRTQKKMKVDFVDVRV

SEQ ID NO: 6265 - protein, 179 aa, Triticum aestivum
  misc_feature (53)..(53): Xaa can be any naturally occurring amino acid
  misc_feature (85)..(85): Xaa can be any naturally occurring amino acid
QVLRLATQPSILVAATTTTTTTTIQSVKARQIFDSRGNPTVEVDIGLSDGSFXRGAVPSGASTGIYEALELRDGGSDYLGKGVLXAVNNVNAIIGPALIGKDPTEQTDIDNFMVQQLDGTSNEWGWCKQKLGANAILAVSLAVCKAGAMVKKIPLYQHIANLAGNKTLVLPVPAFNVIN

SEQ ID NO: 6266 - protein, 233 aa, Triticum aestivum
  misc_feature (206)..(206): Xaa can be any naturally occurring amino acid
GPRVCAFLVEPIQGEAGIIVPEAGYLMKAFNLCKKHNVLFIADEIQTGLCRTGKLLAVDYDGVKPDILILGKALSGGMYPVSAVLANKPVMECIQPGTHGSTYGGNPLGCAVAIAALKVLKEEKLAENAYNLGVKFRQALIDIKSPLITTVRGRGLLNAIVIDDTKMDKTAWHVCLMMKKYGLLAKPTHQNIIRLAPPLCITEEQXMDGVKIIDKVLKEIVSMNVKDIPGHEL

SEQ ID NO: 6267 - protein, 356 aa, Triticum aestivum
  misc_feature (270)..(270): Xaa can be any naturally occurring amino acid
  misc_feature (300)..(300): Xaa can be any naturally occurring amino acid
  misc_feature (318)..(318): Xaa can be any naturally occurring amino acid
  misc_feature (324)..(324): Xaa can be any naturally occurring amino acid
MLALVATFVFSCLLFLSKPCARDMRLFLASISQQLALSLLGFLAGYRLLGGVASTAADAMPLMPSFKRKRPAAKLETTDTTGEPSVLDLPELAIDCILAKLPPAELRNMAAVSRSMRERCRSDHLWERHMSDKWGSVLGTAARDEWRSYLSSSTAAGGGASGCGSAGSGKHRRWLAALSCVCPVVSWMRPRADGGAGTSGGPVLDDSIMSWYLHLESSEFWFPAQVYNREHGHVGFMMSCYDAELSYDFRTDTFHARYPPHGRRTVVLEXDGVQWDRVRGPPVGTPAHDLHASDCLHELXRPGDNIEIQRRRNKEFPXGWWNWXLVGHSGSCHGNEHLCRCHLSDTGLLVCSQKQL

SEQ ID NO: 6268 - protein, 273 aa, Triticum aestivum
  misc_feature (41)..(41): Xaa can be any naturally occurring amino acid
  misc_feature (78)..(78): Xaa can be any naturally occurring amino acid
LDFFTGRILTTFFRRFRYLKAADCSKITQTVPRTGNPSKVXTQSGRAPQASQLDTLLNLADLKGADGKTTLVHSAVQXIPRSEDEKSDEIPESHIQFGKHGLKVVSGLSSELGNVKKAATMDFDVLHGYVSKLETGVGKITSVILLENQCRKGERFFTAMRGFLKEAEQGIGQVRGEERKAMERVKEITGYFHGNTAREEAHPLRIFMVARDFVAILDRVCREVGQQDRAFLGSARSFRISATTPTPLLGMHGQQGGDGNSDEATLLGVGGGD

SEQ ID NO: 6269 - protein, 401 aa, Triticum aestivum
MATKRSVGTLGEADLKGKKVFVRADLNVPLDDAQKITDDTRIRASIPTIKYLLEKGAKVILASHLGRPKGVTPKFSLKPLVPRLSELLGLEVVMAPDCIGEEVEKLAAALPDGGVLLLENVRFYKEEEKNDPEFAKKLASVADLYVNDAFGTAHRAHASTEGVTKFLMPSVAGFLMQKELDYLVGAVANPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 6270 - protein, 146 aa, Triticum aestivum
MASSMLSSAAVATSPAQATMVAPFTGLKSSAAFPVTRKSNTDITSIASNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECK

SEQ ID NO: 6271 - protein, 185 aa, Triticum aestivum
TRLTRILQAILKVIFEHAKDRPILFSSFQPDAAQLMRKLQGTYPVYFLTNGGTELYTDVRRNSLEEAVKLCLASGMQGIVSEARGIFRHPAAVPKIKEANLSLLTYGTLNNVPEAVYMQHLMGVNGVIVDLVPEITDAVSELIALPEPDLEVDNLSNQAARGATTPNFSQREISFLLRLIPELVQ

SEQ ID NO: 6272 - protein, 102 aa, Triticum aestivum
  misc_feature (55)..(55): Xaa can be any naturally occurring amino acid
RDRRVRPRVRSSSSAVLRLPRIARRRPLSCWGSPLAVFATMESPSEGYRTNVGIXCLADPTLTKIFSVSRIDIPTAWQMPQGGIDPGEEPRAAAIREFVGRN

SEQ ID NO: 6273 - protein, 233 aa, Triticum aestivum
MMNGAAAPEPTEAPAPSPQVPLDWRFSQVFGERGAGEDVQDVDIISAIEFNKLGHHLATGDRGGRVVLFERTDAKDHVSRKDAEKADYSISRHPEFRYKTEFQSHEPEFDYLKSLEIEEKINKIKWCQETNGASFLLSTNDKTIKFWKVQEKKVKKICEMNMNPSNAPANGSPVGSTMCGSSARTPNGGILKPGGLPLLRLPVVVTSQETSLAANCRRVYAHAHDYHINSISN

SEQ ID NO: 6274 - protein, 619 aa, Triticum aestivum
  misc_feature (487)..(487): Xaa can be any naturally occurring amino acid
TSLYKKAGWYRSGIPGISSTHASVQSFSVAFVFAIVSNFTVLSDNGMAFVVAPSTRLSTFNAGQYLGILNVTDNGKPDNGVFAVELDTMLNPEFQDMNSNHVGVDLNSLRSVQNHSAGWYDDATGVFNNLSLISRRPMQVWVDYDGATTRLDVAMAPLDVPRPKKPLISAPVNLSAVVTDTAYVGFSAATGVIFTRHYVLGWSFALNGPAPPLDTSKLPSLPRFGPKPRSKVLEIVLPIATAAFVLALAIAFFMFVRTRIRYAEVREDWEVEFGPHRFAYKELYKATKGFKNRRLLGTGGFGRVYKGVLPRSNLEIAVKRVSHDSKQGMKEFIAEVVSLGHLRHRNLVQLLGYCRRQGELLLVYDCMPNGSLDKYLHDKTRPVLDWSQRFQIIRGVASGLLYLHEDWDKIVIHRDIKASNVLLDADMNGRLGDFGLARLYDHGVDPQTTHVVGTMGYLAAELVRTGKATPVTDVFAFGVFVLEVTCXRRPLGCIAPDEQNVLLDWVQEHERRRAGLDTVDPRLCGKYDADEARLAIKLGLMCAHPLPDARPGMRQVTQYLEGEVAMPEVVPTFLSYTTLALMQNDGFDSFAMSFPSTVTTDASPTSGDVSAVSGLSGGR

SEQ ID NO: 6275 - protein, 499 aa, Triticum aestivum
  misc_feature (21)..(21): Xaa can be any naturally occurring amino acid
  misc_feature (275)..(275): Xaa can be any naturally occurring amino acid
RPTLPKSSAETGNFRLTIPTXSAPTSGFSSPVGSPRRLSNADVSSTVASSHAPQAWSAPSIHTIDFLGALSPRTLPEKLTGASEPSPYSSTFRSPILMPRNTSAPPSPLPKLFPENQISRTEVNGSASLHPLPLPPSAISPMQTSFSNQPAPKVEMPSVSCQWQKGKLLGSGTFGCVYEATNRNTGALCAMKEVNIIPDDAKSAESLNQLEQEIKFLSQFKHENIVQYYGSDTIEDRFYIYLEYVHPGSINKYVQQHYGAITESVIRNFTRHILXGLAFLHGQKIMHRDIKGANLLVDINGVVKLADFGMAKHLSSAAPNLSLKGPPYWMAPEMIRATLVKDVGYDLAVDIWSLGCTIIEMFNGKPPWSGLEGPTAMFKVLNKDPPLPDNLSHEAKDFLKCCFKRNPAARPSARELLTHPFIRNSSHYSKHVQEVIIAGCEEVIRASCDPSLTRKTTTSGGNDARSSESLVSQLTLQPVQVVTPYFPPRNSGFVSNPGS

SEQ ID NO: 6276 - protein, 169 aa, Triticum aestivum
MSKEEVLKIQTCVLKVNIHCDGCQMRVKKILHKIEGVYQSSIDPEQGKVTVSGMVDPDTIIKKLTKAGKPAELWGSKAGMANQFQKLQLDGGGKGQAKDAGGKGQSKDAGGAKGQKGGGGGGGAGGASKDAKMMMPPPTAQQLQQLQQQMQMKGMKLPQFMDGKMPFAA

SEQ ID NO: 6277 - protein, 206 aa, Triticum aestivum
  misc_feature (102)..(102): Xaa can be any naturally occurring amino acid
SKSPPKTRGESAPREIHRSPSPPPSHPLSPMDSAPPAAGGGPGAGYPESTDSSPRSRGGDSWDEPFPSSAAAAAAGGGGRLRLMCSFGGRIVPRPTDKSLCXYLGGETRIVAVDRNASLADAPPPLSRPPLPPQSRTPNHQLPSPRPRPADEDLDNLVDEYDRVAATSSSGGASSRTSRIRLFLFPAKPESSSSLGSLLDDSSKSE

SEQ ID NO: 6278 - protein, 147 aa, Triticum aestivum
MMRHRARSSPSSPLTPSSNTRVKKIFGFSVSLILINLASIMERADENLLPAVYKEVGAAFNAGPTDLGYLNFVMNFLKSIASPLAGILALHYDRPAVLAIGTVFWALSTGAVGVSQHFQQVAFWRAINGLGLAIVIPALQSFIADSY

SEQ ID NO: 6279 - protein, 177 aa, Triticum aestivum
MDSAAAQAQPTHAPADEEEARRRRGTDCVYYLASPLTCNKGSECEYRHSDAARVNPRDCWYWFNGNCANAKCSFRHPPLDDLLGASATPRAPQQPALQVPVPAQAVPPNGTAKPVVPCYYYQKGMCAKGNLCTFSHGPQFAGNPAQPHLQLKNSNSWTKPSNSPQQSTTPAVHGELK

SEQ ID NO: 6280 - protein, 253 aa, Triticum aestivum
MNPRDSDDDRPGAAAGSSSAATEQQQSLEWRFAQVFGERAAGEDVQEVDIISAIEFDKSGDHLATGDRGGRVVLFERTDVRDEHANRRELERQDVPITRHPEFRYKTEFQSHEPEFDYLKSLEIEEKINKIKWCQTANNALFLLSTNDKTIKYWKVQEKKVKQVSVMALDTSRTVGDGTTSRASTSTSEPPLPNGGCSKKSDSLNSDLLFPPGGYPSLRLPVVTSQDVNLCARCRRVYAHAHDYHINSISNNR

SEQ ID NO: 6281 - protein, 461 aa, Triticum aestivum
  misc_feature (159)..(159): Xaa can be any naturally occurring amino acid
MAGAAAAAAAVASGISIRTVAAPKISRAPRSRSVVRAAVSLGEKAYTVQKSEEIFNAAKELMPGGVNSPVRAFKSVGGQPIVFDSVKGSHMWDVDGNEYIDYVGSWGPAIIGHADDEVNAALIETLKKGTSFGAPCALENVLAQMVISAVPSIENGSFXRLVRAFTGREKILKFEGCYHGHADSFLVKAGSGVATLGLPDSPGVPKGATVGTLTAPYNDAEAVKKLFEDNKGEIAAVFLEPVVGNAGFIPPQPAFLNALREVTKQDGALLVFDEVMTGFRLAYGGAQEYFGITPDVTTLGKIIGGGLPVGAYGGRKDIMEMVAPAGPMYQAGTLSGNPLAMTAGIHTLKRLMEPGTYEYLDKVTGELVQGILDAGAKTGHEMCGGHIRGMFGFFFAGGPVHNFDDAKKSNTAKFGRFHRGMLEEGVYLAPSQFEAGFTSLAHTTLDIEKTVEAAEKVLRRI

SEQ ID NO: 6282 - protein, 259 aa, Triticum aestivum
  misc_feature (78)..(78): Xaa can be any naturally occurring amino acid
  misc_feature (203)..(203): Xaa can be any naturally occurring amino acid
  misc_feature (254)..(254): Xaa can be any naturally occurring amino acid
  misc_feature (256)..(256): Xaa can be any naturally occurring amino acid
MAGAAAAAAAVASGISIRPVAAPKISRAPRSRSVVRAAVSLGEKAYTVQKSEEIFNAAKELMPGGVNSPVRAFKSVGXGQPIVFDSVKGSHMWDVDGNEYIDYVGSWGPAIIGHADDKVNAALIETLKKGTSFGAPCALENVLAQMVISAVPSIEMVRFVNSGTEACMGALRLVRAFTGREKILKFEGCYHGHADSFLVKAGXGVATLGLPDSPGVPKGATVGTLTAPYNDAEAVKKLFEDNKREIAAVFLEPXVXNAG

SEQ ID NO: 6283 - protein, 636 aa, Triticum aestivum
MASLPPHPRRIRPIAVASLVLFLLFLYTRSDGNPPRLPGSDSRPLHRRLLSGADPASPAASRGGNLSEVTGLNGEQLENPSTACAGIDRHEGFGSQCEFLRAHPQCSSGGFVDYLDFFYCRCERFRLLGYAVLAVCLAALFYMLGNTAADYFCCSLEKMSALLRLPPTVAGVTLLPFGNGAPDVFASIAAFMGSGAGDVGLNSVLGGAVFVTCVVVGAVSLSVAEKNVQIDWRCFVRDVGFFLITLVALSIMLIVGKVTVWGAMLFVSIYVVYAFVVAANELLRKHARMLKFDVVTPLLPVRGSIFSHGLEDDDSVYSSLLEEDTSDDAAQVNTSLPQWMWASHVAIYSNQGRDGSPDRPLWGWNEEGRVDTSTLNYSKLFLFLELPLTIPRKLTIPIVEEDRWSQEYAVASAGLAPLLLAFLWNSQDGVSTGASVAAYVIAGIFGIALAGLAFTFTSPDRPPRRYLLPWVFEGFVMSIVWFYIIANELVALLVAFGVILGINPSILGLTVLAWGNSMGDLMSNVALAMNGGDGVQIAMSGCYAGPMFNTLAGLGISMLLGAWSTAPNSYVLPQDRSLIYTMSFLVAGLIWALVTLPRSGMRPNKTLGVGLIALYSVFLFIRVSSAMGILPLPGLN

SEQ ID NO: 6284 - protein, 298 aa, Triticum aestivum
MAAPLPRAPVSSPASRAALCPARSNPCTAAAPSSGALGWRRRQPCPVLSIAPGSARSTPAALAVDPKVEALLDSVKWDVKGLAVAIAQNVDTGAILMQGFANKEALAATISTRKATFYSRSRSSLWTKGETSMNFINVHDIFLDCDRDSIIYLGTPDGPTCHTGAETCYYSSVYDALQGSKSNQERQVATTLYSLEDTISRRKEEIVTEGSGKPSWTKKLLLDNQLLCSKIREEAGELIETLLENEDKSRTASEMADLLYHAMVLLSVRDVKMEEVLEVLRKRFSQSGVEEKASRKKS

SEQ ID NO: 6285 - protein, 184 aa, Triticum aestivum
MMARRQRGFRLGRKLLGLWRWALCNRRRRGYARLQRCQLGAGAKPSHAAVGSAKLQQQQQLVVLPRERDEPRRMLGWGRSLARRMRLLPRRGERLLEDAGEATTPKGQVAVYVGGDEPGGESMRYVVPVVYFNHPLFGELLREAEEEFGFEHPGGITIPCAATRFERAAAMAAAGGGRKAPGWW

SEQ ID NO: 6286 - protein, 135 aa, Triticum aestivum
MAAATVHHRPQLQSRKVCVVGGGMAGLASARELRREGHAVTVMEQSGDVGGQWLYDPGTDGRVPSSVYACLRLLSPREAMGFSDFEFLPRAGAGRDPRRFPGHREVHSYLRDFCHAFGLMDAVRLNTRVLRVAIA

SEQ ID NO: 6287 - protein, 333 aa, Triticum aestivum
AYRQDQIVSVWLLQSTTFFSIWIKQHLQSIVHIFYSEGTDHSYSWYLQLRNLVWATSKHDVYMAQNNSVMHWSSLLQRGTEVLHVAGQVVPKQKAHGARTLSRVQISSMALKDNLMVAGGFRGELIFKYVDKPGPGVVFCTNVADNKNSVTNAVDVYESPSGATRATAANNDCTVKFLDAERCSLLSRFNFPWSVNEIATLKGHLDYSFSSAWHPGGNVLATGNQDKTCRLWDTRNLSAPFAVLGGRIGAVRGLRFSSDGRFLAAAEAADFVHVYDARAGYGAAQEIGLFGEIAGVAFSPDAGALFVGVADRAYGSLLEFGRRGRHAYLDSYL

SEQ ID NO: 6288 - protein, 437 aa, Triticum aestivum
  misc_feature (346)..(346): Xaa can be any naturally occurring amino acid
PGITSLYKKAGWYRSGIPGISSTHACGYSRAADVLGFVYLHPLSKCVASPAAAVSKVAGQPLEMEEVEVAPPRAHEVRIRILCTSLCHTDVTFWRLKDFPGQHPIILGHEAAGVVESVGEHVHEVAVGDTVVPVFSAQCGDCPDCLSDRSNICSGLPARPGMPRDGTTRFSFAATGEPIHNFIGVSSFTEYTVVDVARVVRIGPGVPPEKACLLSCGVSTGVGAAWKVAAVEPGSSVAVFGLGVVGLAVAQGCRMRGAKQIIGVDLNPEKWDIGKRLGITDFVNPNDIGEKAVSEVIKEMTGGGADYCFECIGSTSVMAEAFQSSRKGWGKTVVLGVSSGGAPMSXIPPHDILMGRSVVGSLFGGLKPKADIPILAQKYLDKELELDEFVTHEMGFHDINAAFELLTQGKCLRCIIWMDGAKANGVEALDNGRACKA

SEQ ID NO: 6289 - protein, 96 aa, Triticum aestivum
MGPATQQRHRTRAGRPAARRPRAAAGADDGGVRCEACGSGSHADELLLCDGCDRGLHIFCLRPILPRVPAGDWFCPSCAAPAAPAHSAKSAAAVQT

SEQ ID NO: 6290 - protein, 154 aa, Triticum aestivum
IRHEEATTVTDNFVADLRYNPTSTLFVNVPCVSRLQWHPFSVTSSSSLEPDTLSVVIKNRGGWTQKLYETVSSLPPSGGHLGVSVEGPYSPAAGVTSFLGHDSLVMISGGIGITPFISVIRELVYQSSVAETASTPKLLLVCVFRTSAELDMLD

SEQ ID NO: 6291 - protein, 112 aa, Triticum aestivum
  misc_feature (8)..(8): Xaa can be any naturally occurring amino acid
  misc_feature (10)..(10): Xaa can be any naturally occurring amino acid
  misc_feature (12)..(13): Xaa can be any naturally occurring amino acid
  misc_feature (23)..(23): Xaa can be any naturally occurring amino acid
  misc_feature (27)..(27): Xaa can be any naturally occurring amino acid
  misc_feature (73)..(73): Xaa can be any naturally occurring amino acid
  misc_feature (89)..(89): Xaa can be any naturally occurring amino acid
  misc_feature (99)..(99): Xaa can be any naturally occurring amino acid
  misc_feature (101)..(101): Xaa can be any naturally occurring amino acid
  misc_feature (111)..(111): Xaa can be any naturally occurring amino acid
RDWGIYPXCXGXXAQIVSQCNIXEGGXKKTVFKYMPEKAADREETAAGWIRSEGDAFLHGALPCLVDGPGAEXVFRPEEYYDRWTMEAXSPALKEVIQXCXGWQPVPRPPXC

SEQ ID NO: 6292 - protein, 538 aa, Triticum aestivum
  misc_feature (437)..(437): Xaa can be any naturally occurring amino acid
MSQAQHSLHELLLLLQARSPSPQAALVVSLLLFCPLLVLLVARRFRTPSTATATARAREDQLSKLPSPPSRLPIIGHLHLVGPLPHVSLRDLASQHGRDGLMLLRLGAVPTLIVSSPSAAQAVLRTHDHVFASRAYSPVTDILFYGSTDVAFCPYGEHWRQVKKIATTHLLTNKKVRSYRHARENEVRLVVAKIREAATTGAAMDLSDLLNAFTNDIVCHAVAGKSFRKQGHNKLFRELVEANSSLIGGFNLEDYFPVLVKLDFIKRMVCAKAQKVNKMWDELLNSLIDEHASRPTSEQGGDDSDFIDVLLSIQQEYNLTRDHIKAQLEIMFEAGTDTSFIVLEYAMVRLMQKPHLMNKLKNEVRSTISKGKDMIAEDDLSSLAYLKAVIKETLRLHMPAPLLVPHLSMADCKINGYTIPSGTRAIVNSWALARDPXSSWESAEEFMPERFMEGGSAATMDYKGIDFPYLPFGTGRRICPGINFAIVTIEIMLANLMYHFDWKLPSESMEAGISMTESFGVTVHRKEKLLLVPVVPEG

SEQ ID NO: 6293 - protein, 357 aa, Triticum aestivum
  misc_feature (193)..(193): Xaa can be any naturally occurring amino acid
LKPPLPFLPAPLPPPPLTIPPALLPSLSPRARPAIAGRGDLVANPAAVLVHGVPPVEGVSLAGGASVLKAPGGAPATVSAAAGGLIGDAGFGGAPGAVGFPRNLAARRRVPGVLGGPGVDAGGAGFALAVRTPRADGPRRPDGDRDSIADRHPSADVLLVGADLKVDVIDYASVSLIAEPCRSAHLRPKEIAXRADALLSYDPNVQEALGPVLDEDRTNILSIWDEADIVNVNEVQLEFLTGINSVEDDVAMKLWRPTFKLMLVTLGDQGCKYYTNDSRSTVPSYKVQQVDTTGAGDAFIGSLLRKIVQDPSALQDKTKLEGAIKFANACGAITATKKGAIPSLPNEVVEMLLLEKV

SEQ ID NO: 6294 - protein, 206 aa, Triticum aestivum
  misc_feature (101)..(101): Xaa can be any naturally occurring amino acid
  misc_feature (111)..(111): Xaa can be any naturally occurring amino acid
  misc_feature (134)..(134): Xaa can be any naturally occurring amino acid
MLTRTVNRVTSKEHHRFQRGSSSVNGFIGTDFRRAWRVTSAAQGPRPRAQGFLGVAAGCGPAAAAPAVVLLGTCPAARAGPPRRPPPGRRTYPASITNFLXAVLIALTFGXQIGGDTPETPNFLTQLTWPQDCXPSIVFAPGSTAGHTSGSRSPRSWSQHVAFSGSDLSASGLKVVIGTTLNYFLDGRINRAEVLFPGVGCFLIAA

SEQ ID NO: 6295 - protein, 377 aa, Triticum aestivum
MLLLCKSSVLAVLLLHALSLPASALAVGLGRRHRRDVLPGPKGCDVFSGSWVRDDGSAEAAYTGYKCPVIDAEFNCQLYGRPDSDYLRYRWKPASCELPRFDGADFLTRMKGKTVMFVGDSLGRNQWESLVCLLHAAAPQSPSQLVSADPLYTYRFMEYELVVSFYRAPYLVDIDVVQGKRVLMLDDIAENAQAWRGADVLSFNSGHWWTHTGALQGWDYMGEGGRYSEDMDRMVAFQRGMTTWANWVDLNVDPAKTRVFFQSMSPTHYSSKEWPNPVSKNCYGETVPLAGLNSTAQPMGQEQVTKTVLQGMKSPVRLLDITALSALRKDAHPSVYSGDFSPAQRGNPAGSADCSHWCLPGLPDTWNQLFYTLLFYQ

SEQ ID NO: 6296 - protein, 276 aa, Triticum aestivum
  misc_feature (123)..(123): Xaa can be any naturally occurring amino acid
  misc_feature (162)..(162): Xaa can be any naturally occurring amino acid
TRPAALSQAIAAGVLRGVGSAPGPGSGDKVALTDRLVDKLFSDSGERLASAVAGSFARHLVMAFYSAPSPPGQTSSSPDWVNVVATGKGHKAISSWVEVLVGTAVGVFIDKTIHINTYEQLFXGLTNPTHDAKVKELLVSVCNGAVETLVKTSHQVISKANXNWDNNGDGNSNSSGSGASIPPEGWVETVSSTLAVPSNRNFVLDVTGRVTFETVRSFLEFVLWKLHDGARKSGDTVCDSGLRAVRYMSDKSMVVATICITLCLHVLNGTRFLVTA

SEQ ID NO: 6297 - protein, 235 aa, Triticum aestivum
  misc_feature (172)..(172): Xaa can be any naturally occurring amino acid
MLRAAASRCAGGAIRRLSVASYPEAVGARRKPPLDEGDWSYYKEWWGEDDGPGVGAHTVFCRHSEHGNGVVSVVAYPATRPASDQWPVTERWLQERNSAMYPESSGADQFKILGYQWRVMRFNDHTRQSTAKVMACYRSGGDRALYSMQQPYTQCSNPVVCLVSAGLTAAPXCSYDLPQAVSEPNTMKILCIGHGGGSIPLFLASKFRGADVHIVEIDPVVVSASVESMGFPASC

SEQ ID NO: 6298 - protein, 168 aa, Triticum aestivum
MLVYQDKLSGDELLSDSFPYRELENGVLWEVDGHWVVQGAVDVDIGANPSAEGGGDDEGVDDQAVEVVDIVDTFRLQEQPAFDKKQFISHMKRYIKNLSAKLEGDDLDAFKKNVESATKYLLSKLKDLQFFVGESMHDDGGVVFAYYKEGAADPTFLYFAHGLKEVKC

SEQ ID NO: 6299 - protein, 123 aa, Triticum aestivum
MAAAAASMARRLLSPTTSSPSTAKRKIYNVSCERYFGFGCEIDEETSNKLEGIPGVLFVLPDSYVDPEHKDYGAELFVNGEIVQRSPERQRRVEPVPQRASDRPRYNDRTRYARRRENQQQQR

SEQ ID NO: 6300 - protein, 153 aa, Triticum aestivum
MPKSSPRARPRHHHAPPGLCALPAFSYNAHRGLVLGLTFLAYALYHASRKPPSIVKRALSKSWPPFHDPALLGETDVAFLAFYSLGMFGAGHLGDRLDLRLFLAAGMVGSGAAVAFFGAGYWRRVHVGHGCWLSISFVRCRRNHWWNSCWVHV

SEQ ID NO: 6301 - protein, 230 aa, Triticum aestivum
RTFQIIVLQGIVGSLPWTAVVFFTMWFELIGFDNKSSAGLNSLFAIGCASGSFLGGVIADRVSRRYPDSGRIMCAQFSAFMGIPFTWILLTVIPQSVDYWYSYAVTLFLMGLTISWCATCANNPMFAEVVPPKHRTMIYAFDRAFEGSFSSLAAPAVGMVTEKVYGYNSKTVNLADGSVAGAYALSRGLLTMMIVPFGLCCLFYTPLYFVFKRDRENARLAASTKDLELM

SEQ ID NO: 6302 - protein, 196 aa, Triticum aestivum
  misc_feature (61)..(61): Xaa can be any naturally occurring amino acid
ESFGTGSDHIREKDGIWAVLAWLSIIAFKNKDNLGGDKLVTVEDIVRQHWATYGRHYYTRXDYENVDAGAAKELMANLVSMQSSLSDVNKLVKEIRSDVSEVVAADEFEYKDPVDGSVSKHQGIRYLFGDGSRLVFRLSGTGSVGATIRVYIEQYERDSSKTGRDSQDALAPLVDVALKLSKMQEYTGRSAPTVIT

SEQ ID NO: 6303 - protein, 483 aa, Triticum aestivum
  misc_feature (116)..(116): Xaa can be any naturally occurring amino acid
MGMEKGKADPAAFSIAEAGFGDRTDIDDDGRERRTGTLVTASAHIITAVIGSGVLSLAWAIAQLGWVIGPAVLVAFSVITWFCSSLLADCYRSPDPVHGKRNYTYGQAVRANLGVXQYRLCSLAQYVNLVGVTIGYTITTAISMGAIGRSNCFHRNGHNAACEASNTTNMIIFAAIQILLSQLPNFHKIWWLSIVAAVMSLAYSSIGLGLSIAKIAGGVHAKTTLTGVTVGVDVSGREKIWRTFQSLGDIAFAYSYSNVLIEIQDTLRSSPAENTVMKKASLIGVSTTTTFYMLCGVLGYAAFGSSAPGNFLTGFGFYEPFWLVDIGNVCIVVHLVGAYQVFCQPIYQFVEGWARSRWPDSAFLHAERVLRLPAVLGGGEVPVSPFRLVWRTAYVVLTAVVAMLFPFFNDFLGLIGAVSFWPLTVYFPVEMYMAQAKVRRFSPTWTWMNVLSVACLVVSVLAAAGSVQGLIKDVAGYKPFKVS

SEQ ID NO: 6304 - protein, 143 aa, Triticum aestivum
  misc_feature (129)..(129): Xaa can be any naturally occurring amino acid
HASGFYFDFSCTYVGVGMICPHIVNVSILLGGILSWGIMWPLIANKRGSWFSADLPESSLRGMQGYRVFIAIAVILGDGLYHFLKMLILTVYSLRSRLKTGSASPFPVSDDETCNGTAAISYDEQRRKXLFQKDQIPWYIAYG

SEQ ID NO: 6305 - protein, 204 aa, Triticum aestivum
MEKIDDHLKPSHSVSAGAATEKWEEVSTGIRTAETMLRVAPVGLCVAALVIMLKDSQTNEYGEVSYSNLTAFRYLVHANGICAGYSLLSAAIAAMPGSSSTMPRVWTIFCLDQILTYVVLAAGAVSTEVLYLAYKGDDAITWSDACSSFGSFCHKATASVIITFVVVCFYVVLSLISSYKLFTRFDPPATVDSNKNVEVAVFGS

SEQ ID NO: 6306 - protein, 326 aa, Triticum aestivum
  misc_feature (160)..(160): Xaa can be any naturally occurring amino acid
  misc_feature (197)..(197): Xaa can be any naturally occurring amino acid
MEALTLTSLLKAAAAAFPDRRAIAVHGKIDLTHAALDALVDAAAARLAAGAHGLRPGQTVALCFPNTVELVVVFLAVIRARGVAAPLNPAYTQDEFEFYLSDSGARLLVTGADGNAPAQAAASKLGLPHAVAATLTDAAGPLGLTGLPAPTTAPSIRTEXNEPSDVALFLHTSGTTSRPKGVPLTQRNLPASVQNIXPVYRFPETDATGVTLPLFHVHGLMCALLSSLASGASVALPAAGRFSASTFWGDMLAAGATWYTAVPTIHQIILDRHASLPEPRYPALRFVRSCSASLAPVILERLEAAFGAPVLEAYPMTEASHMMTSN

SEQ ID NO: 6307 - protein, 279 aa, Triticum aestivum
MDALTLTSLLKAAAAAFPDRRAIAVHAKIDLTHAALDALVDAAAARLAAGPDGLRPGQTVALCFPNTVELVVVFLAVIRARGVAAPLNPAYTQDEFEFYLSDWGARLLVTGADGNAPAQAAAAKLGLPHAVAATLTDAAGPLDLAGLAGDIQDNNPPPQNDGTVPPHVALVPPDAAPSRRPSGAPRPPRGVPLTQRNLAASVQNIRAVYRFAETDATVVTLPLFHVHGLMCALLSSLASGASVALPAAGRFSASTFWADMLAAGATWYTAVPTIHQIIL

SEQ ID NO: 6308 - protein, 326 aa, Triticum aestivum
  misc_feature (234)..(234): Xaa can be any naturally occurring amino acid
  misc_feature (264)..(264): Xaa can be any naturally occurring amino acid
MAAKMVISLGGSRRRKRGEVLFRFDSFCQPGYPAQLAGAFRDNVRTLLGLAHLEAGVQGETRCWSFQLELHRHPPTVVRLFVVEEEVAASPHRQCHLCRVIGWGRHLICSKRFHFVLPKRESSVETDGLCYGIGHGGGGAEKASKGTATSRGHLLHGVVHLNGYGHLVALHGFEGGSDFVSGHQIMDLWDRICSALHVRTVSLVDTARKGHMVLRLLHGVAYGDTWFGRWGLQXGRPSYGVALQSYQQSLHALQSIPLCVLEPXLSCFSQELPMVVHKYQAISGHKLLNSATSSVHAQARDLPATSGTGMNTGDHVRPVGRWVAKA

SEQ ID NO: 6309 - protein, 175 aa, Triticum aestivum
MPCLNVSTNVNLEGVDTSAVLADASSTVATIIGKPENYVMVVLKGSVPMAFGGTQEPAAYGELVSIGGLNPDVNKKLSAGIASILESKLSIPKSRFYLKFHDSKAHPAQEHAQCCMLGIKSRSSLGLGVERIDLLDASYGVESCMNFRVPNILSIAYLRRNRCSKTSCQFNGQCP

SEQ ID NO: 6310 - protein, 397 aa, Triticum aestivum
MDAAALLPVALALVAIPVTALLLNRLRFGRLPPGPRPWPVLGNLLQIQPVRCRCFPEWAARYGPIMTVWFGSTPMVVVSTPELAQEVLRTHDQHLADRSRNRSSERFSRGGMDLIWADYGPHYIKVRKLCNLELFTQKRLEALRPIREDEVTAMVESVHRAAAGPGNEGKPLVVRNHLAMVSFNNITRLAFGKRFMNADGDIDEEGQEFKLIVNNGIKIGASLSVAEYIWYLRWLCPLNEELYNTHNERRDRLTKKIIEEHAQALRESGAKQHFVDALFTLREKYDLSDDTVFGLLWDMITAGMDTTVISVEWAMAELVRNPRVQKKLQEELDSVVGRDRVMSETDFQNLPYLMAVVKESLRLHPPTPFMLPHKASASVKVGGYSIPKGANVMVERV

SEQ ID NO: 6311 - protein, 507 aa, Triticum aestivum
MEVEASAHGDAAASKFTLPVDSEHKAKSFRLFSFANPHMRTFHLSWISFFTCFVSTFAAAPLVPIIRDNLNLAKADIGNAGVASVSGSIFSRLAMGAVCDLLGPRYGCAFLVMLSAPTVFCMAAIDDASGYIAVRFLIGFSLAAFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTDNVIAEYYYDHFHLDLRAAGTIAACFGMANIVARPMGGYLSDLGARYFGMRARLWNIWILQTAGGAFCIWLGRASALPASVTAMVLFSICAQAACGAVFGVAPFVSRRSLGIISGLTGAGGNVGAGLTQLLFFTSSQYSTGRGLEYMGIMIMACTLPVTLVHFPQWGSMFFPASADATEEEYYASEWSEEEKGKGLHIAGQKFAENSRSERGRRNVILATSATPPNNTPQHV

SEQ ID NO: 6312 - protein, 195 aa, Triticum aestivum
LLQFVVQEIMKPEGHSNLNPACKTDASMSPPYDVDCRKHGLQVVSKLTAELTSTKKAACVDMTGLSRSVSELGVGLGKVHDVLRLNGMAASAESARRFHNAMSAFLRQAEEEIVRLQGQESVCLSSVREMAEYFHGGDEAGDGEARLIRVFAGVREFVAMLDRICREAGEVQGDRVGSTPVSWVAAGAPPVGTTP

SEQ ID NO: 6313 - protein, 369 aa, Triticum aestivum
MEPHAESKPIPLMTPYKMGSSLDLAHRVVLAPLTRQRSYGNVPQPHAAVYYGQRATPGGMLITEATGVSDTAQGYTDTPGVWTAEQAEAWRPVVDAVHAKGALFFCQLWHVGRVSSYGFQPGGAAPVSSTQRMVGPQVRHDGTTEEFSPPRRLAVEEIPMIVDDFRKAARNAINAGFDGVEIHGGNGYLIEQFLKDSANDRDDGYGGSLENRCRFALEVVAAVAKEVGAHRVGIRLSPFMDYMDCHDSDPHALGLHMATKLNDHNILYLHMIEPRMALVDGRREVPHRLLPYREAFKGTFIANGGYDREEGDRAVVSGYADLVSFGRLFLANPDLPKRLELNAPLNKYNRLTFYISDPVVGYTDYPFLP

SEQ ID NO: 6314 - protein, 169 aa, Triticum aestivum
MAPTVMASSATAVAPFQGLKSTATLPVARRSTTSFAKVSNGGRIRCMQVWPADGNKKFETLSYLPPLTEEQLLKQVDYLLRNNWVPCLEFSKEGFVYRENSTSPCYYDGRYWTMWKLPMFGCTDASQVYKELQEAIASYPDAYVRILGFDNIKQTQCVSFIAYKPAGSE

SEQ ID NO: 6315 - protein, 131 aa, Triticum aestivum
  misc_feature (16)..(16): Xaa can be any naturally occurring amino acid
LAALLVDKVGRKLSMXSVCFSVLLSVAPLAAPLEEGLATVLLFSARTCITGSYAVLYIYGPEIYPSSCRNTGVGVATSLGRIGGMIAPLIAVGLLESCHQKEAVFVFDLVLFLAAVACALFPLETKGCQIQ

SEQ ID NO: 6316 - protein, 280 aa, Triticum aestivum
HASGDDEISRGWGPKKLEAAPAVRDHGAVLGALTRALASTEAAYLDMTDQSMGSHPELAVTGACLLVALVRDDDVYVMNLGDGRATGQGPVGYPMIGLEALQLSIDHSTSIEEEVQRIKREHPDDDQCIVNDRVKGRLKVTRAFGAGYLKQAKLNNGLLEMFRNEYIGDAPYISCIPSLCHHKLTSRDQFLVLSSDGLYQYLSNEEVVLHVENFMERFPEGDPAQSLIEELLSRAAKKAGMDFYELLDIPQGDRRKYHDDVTVMVVSLEGRIWKSSGTYV

SEQ ID NO: 6317 - protein, 291 aa, Triticum aestivum
  misc_feature (114)..(114): Xaa can be any naturally occurring amino acid
MAKDIEAAPPGGEYGAKDYSDPPPAPLFDAEELTKWSLYRAVIAEFVATLLFLYITVATVIGYKHQADPAGPNAADAACSGVGILGIAWAFGGMIFVLVYCTAGVSGGHINPAXVTFGLFLARKVSLVRALLYIIAQCLGAICGVGLVKGFQSAFYVRYGGGANELSSGYSKGTGLAAEIIGTFVLVYTVFSATDPKRSARDSHVPVLAPLPIGFAVFMVHLATIPITGTGINPARSFGAAVIYNNEKAWDDHWIFWVGPFIGAAIAAAYHQYVLRASATKLGPSASFGRS

SEQ ID NO: 6318 - protein, 340 aa, Triticum aestivum
MAAQAVVAPSMMSDPESTTAKSSTTQEEEDVLPPKDFVAALPVREGWSEPLVQYKNYWFRPRLLEQILLVQHAFVPRADDIILATQPKCGTTWLKALAFTIANRSRYGFSDHPLRTRHPQHVVPFIEIPGAGPNHTDIHTLPPPRLLATHMPMSLLPPGTRSVGCRVVYLCRDPKDALVSRLHFENKAFQGTNLSMDSAFSMFCEGFSPYGPFWDHCLEYWRESVARPDNVLFLKYEEIKSDPVPVVRKLAKFLGVPLTEEEESSGVAQEVVKLCSFETLTSLQVNQVGGVRHGDKFFLSNSVFYRKGEVGDWANHMSHVMGEELDRIVQQKLEGSGLVF

SEQ ID NO: 6319 - protein, 120 aa, Triticum aestivum
VLVNASRGPVIDEVALVEHLKANPMFRVGLDVFEDEPYMKPGLADMKNAVVVPHIASASKWTREGMATLTALNVLGKIKGYPVWGNPNQVEPFLDENSTPPRACPSIVNAKQLGLPSAKL

SEQ ID NO: 6320 - protein, 138 aa, Triticum aestivum
  misc_feature (85)..(85): Xaa can be any naturally occurring amino acid
  misc_feature (132)..(132): Xaa can be any naturally occurring amino acid
HIKDGSVSILKFDKEKEKPASVQRALSVLEMEVEQIKKGSYDHFMQKEIHEQPHSLTTTMRGRLKDSGVVLGGLKEHLKTLRRSXRVIFIGCGTSYNAALAARPFVEELTGIPVTMEVASDLLDRQGPIYRXNTAVFV

SEQ ID NO: 6321 - protein, 671 aa, Triticum aestivum
MSSLVRLILTISLGLNLAALITTANDQFIYSGFSGSNLAVDDTATITPDGLLELTNGTAYQKGHAFHPAPFRLRDSTANGVGDGKVRSFSVAFVFGIVSAYPDFSAHGMAFVIAPRRNFSDALPAKYLGLTNVQNDGNASNSIFAVELDTIQSVEFKDINANHVGIDINGLQSLRSYNAGYYDDESGDFRGMKLISREAMQVWIDYHGERKEINVTLAPFDMAKPARPLLSASYDLSTVLTELVYLGFSAATGRVNSRHFVLGWSLGVSRQAPAIDMAKLPKLPRVGPKPRSKVLDIVLPIVTATFVLGLGGILVLVMRRRSRYAELREDWEVEFGPHRFLYKDLFRATDGFKDKHLLGAGGFGRVYRGVLETSKLEVAVKRVSHESRQGMREFIAEITSIGRIRHRNLVELLGYCRRKGELLLVYAYMPNGSLDKHLYNTREDQPTLNWALRFQTVKDVASGLLYLHERWEKVVIHRDIKASNVLLDKDMNAQLGDFGLARLYDHGADSQTTHVVGTMGYLAPELIRTGRASPLTDMFAFGIFLLEVACGQKPIKENAQGGQIALVDWVLEHWRDGTLMETVDARLQGEFDIDQAGLVLTLALMCSHLLASARPGIGQVMRYLTGVTPLPELTPTDVLTLMQNKGFDESAMSYPDLVSSFGTISTLSGGR

SEQ ID NO: 6322 - protein, 294 aa, Triticum aestivum
MDGEWWRKKWVAWAAAAAIFVVLMLVTPAIPQDEDYHDFADQRVLFLGIPNTLNVLSNIPFLFVGLAGLILCHYKNYFRLCSQGELWSWTLFYAGVTTVGVGSSYYHLYPNDATLVWDRLPMTIAFTSIVAIFIIERVDDRAGTKSLAPLVIAGALSILYWSFFDDLRPYAIIQFVPCIVIPVMAIVIPPMYTHSSYWLWAAGFYLLAKVEEAADKPIYRWTHDIVSGHTLKHLCAAMVPVFLTLMLAKRTIEPDRVSLLQMWKISWRERGSQDSNTVDVKYDYAAVSTTSEQQ

SEQ ID NO: 6323 - protein, 286 aa, Triticum aestivum
MGKEVDVGALEAGGARDYSDPPPAPLVDVDELGKWSLYRAVIAEFVATLLFLYITVSTVIGYKHQTDASASGPDAACGGVGILGIAWAFGGMIFVLVYCTAGISGGHINPAVTFGLFLARRVSLVRALLYMAAQCLGAVCGVGLVKGFQSGLYARHGGGANEVGAGYSVGAGLAAEIVGTFVLVYTVFSATDSKRNARDSHVPVLAPLPIGFAVFMVHLATIPITGTGINPARSLGAAVIYNGDKAWSDQWIFWVGPFIGAAIAALYHQTILRASARGYGSFRSNA

SEQ ID NO: 6324 - protein, 111 aa, Triticum aestivum
  misc_feature (20)..(20): Xaa can be any naturally occurring amino acid
FQNQLSASKSSGSSQGVYVXSEMNPYVGHPNPMQEEQELFRKGLLSEAALPLEAEVLKNPDNAEGSRLLGVTHAENDDDQQWEQKQIQIPEGGMERIRYGRVHYRWRKKNP

SEQ ID NO: 6325 - protein, 247 aa, Triticum aestivum
  misc_feature (235)..(235): Xaa can be any naturally occurring amino acid
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTGKVATTEQAQEVHKAIRDLLRSISDKVADETRILYGGSVNEKNCGELSKQADIDGFLVGGASLXPAFVDIINATKQ

SEQ ID NO: 6326 - protein, 168 aa, Triticum aestivum
  misc_feature (135)..(135): Xaa can be any naturally occurring amino acid
MGSSTESRSRMGSIKPMGIQLIECVRGGPLSFRSSQALVLVLTFLSYASYHATRKTTSIVKSVLDPKTTNLGLLHWPSHMYLQELKGAANNTALQSGWAPFNGEDGTGLLGEIDLAFLGVYAIGMFFAGHLGDRXDLKILLTIGMVGTGLFTAAFGAGYWLNIHRDYY

SEQ ID NO: 6327 - protein, 145 aa, Triticum aestivum
MDPSRPLLGRGAFLSSSAHAAAAIILIAFLLLTLLRLPLSPSISIYTPPPLASTPHHHLQHQDHEDQEQEDASSCDLSSPLDCADPRLFHLMMRSAIDAFPAVHFARFGRPVPGDPPSASCDMAWRARTNASASASPTGTTKDYR

SEQ ID NO: 6328 - protein, 232 aa, Triticum aestivum
  misc_feature (196)..(196): Xaa can be any naturally occurring amino acid
  misc_feature (209)..(209): Xaa can be any naturally occurring amino acid
  misc_feature (211)..(211): Xaa can be any naturally occurring amino acid
MTSKEEKVDIGTHTPPSHEVAPGHQKDVFTGDIEGVREDFREDDFMTRNGLNLKSFQRRDYGTGVVELDRSMKKRHLHMIAIGGSIGAGFFVGSGGAFTKGGPGAVLICFMIAGVMIFNVVHALGELAVMYPVSGGFYTYSTRFIDPSWGFAMGWNYVFQWVIVLPLELTVASFTVQYWNPNINEGIWITRLLAVXIIFINVFGTLGYXRXREFWSSCFKLAAIIIFMIVAV

SEQ ID NO: 6329 - protein, 87 aa, Triticum aestivum
  misc_feature (14)..(14): Xaa can be any naturally occurring amino acid
PAGFRKKSLNAYQXVIARGGKPIVICNPDDEEFKASEAEKIEIPKTVDVLQGLLNVIPLQLIAYWLAVLEGLNVDFPRNLAKSVTVE

SEQ ID NO: 6330 - protein, 149 aa, Triticum aestivum
KKKKKKTACQISGYVLGVAGWGLGLKLGSESKGLTYTTHRNIGIAIFCLATLQVFALFLRPDKKNKYRVYWNAYHHSVGYSVIVLAAVNIFKGLNILKPVTGWKTSYIVILATLAGVALVLEARPGPVVLRRRKRNQAYGGANGTGVQL

SEQ ID NO: 6331 - protein, 158 aa, Triticum aestivum
  misc_feature (112)..(112): Xaa can be any naturally occurring amino acid
RHEDLFGMLQGTRSALYANDRESISVTVQEVTPRAVGALVALYERAVGIYASLVNINAYHQPGVEAGKKAAGEVLALQKRGLTVLNEATCENPGEPLSIDEIADRCHCPEEXIEMIYKIIQHMAANDRALIAEGSCGSPRGVKVYLGECDVDEDMQAA

SEQ ID NO: 6332 - protein, 145 aa, Triticum aestivum
  misc_feature (15)..(15): Xaa can be any naturally occurring amino acid
  misc_feature (89)..(89): Xaa can be any naturally occurring amino acid
MASSMISSPAVTTVXNRAGAGMVAPFTGLKSMAGFPTRKTNNDITSIASNGGRVQCMQVWPPVGKKKFETLSYLPDLDDAQLAKEVEYXLRKGWIPCLEFELEHGFVYREHNRSPGYYDGRYWTMWKLPMFGCTDASQVLKELQE

SEQ ID NO: 6333 - protein, 327 aa, Triticum aestivum
  misc_feature (217)..(217): Xaa can be any naturally occurring amino acid
MPGDTEPRVVEDFLGVVQLLSDGSVVRGDEAVLRSNEPLPDVPGVQWKDVLYHAAHGLSVRVYRPASSVAGGSKLPVLVYFHGGGYCLGSFAEPNFHSFCLRAAAEISAVVLSVQYRLAPEHRLPAAIDDGASFLSWLRGQAELGAGADPWLAESADFAGTFLSGHSAGANLAHHVTVQVASGEIATTPVRIVGYILLSAFFAGADRTATEADPPGXVSLTTAMADQLWRMSLPVGASMDHPLANPFGPESPSLAPVELPPALVVAPLSDVLRDRVLGYGARLKDMGKAVEVVQFEGEQHGFSVRQPFGEAADELLRVIKRFVYSGN

SEQ ID NO: 6334 - protein, 160 aa, Triticum aestivum
  misc_feature (113)..(113): Xaa can be any naturally occurring amino acid
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLGXGVTIAHGGVLPNINPVLLPKRMAEKEPKEGKSPKKTAKSPKKADKKA

SEQ ID NO: 6335 - protein, 160 aa, Triticum aestivum
  misc_feature (61)..(61): Xaa can be any naturally occurring amino acid
MDASATGAGAKAKKGAAGRKAGGPRKKSVTRSVKAGLQFPVGRIGRYLKNGRYAKRVGTGXAPVYLAAVLEYLAAELLELAGNAAKDNKKSRIVPRHLLLAVRNDQELGRLLAGVTIAHGGVLPNINPVLLPKRTAEKEPKEGKSPKKVAKSPKKADKKA

SEQ ID NO: 6336 - protein, 159 aa, Triticum aestivum
MDASATGAGAKAKKGAAGRKAGGPRKKSVTRSVKAGLQFPVGRIGRYLKKGRYAKRVGTGAPVYLAAVLEYLAAELLELAGNAAKDNKKSRIVPRHLLLAVRNDQELGRLLAGVTIAHGGVLPNINPVLLPKRTAEKEPKEGKSPKKTAKSPKKADKKA

SEQ ID NO: 6337 - protein, 156 aa, Triticum aestivum
MDASATGAGAKGKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKAAKSPKKADKKA

SEQ ID NO: 6338 - protein, 159 aa, Triticum aestivum
MDASATGAGAKAKKGAAGRKAGGPRKKSVTRSVKAGLQFPVGRIGRYLKKGRYAKRVGTGAPVYLAAVLEYLAAELLELAGNAAKDNKKSRIVPRHLLLAVRNDQELGRLLAGVTIAHGGVLPNINPVLLPKRTAEKETKESKSPKKTAKSPKKADKKA

SEQ ID NO: 6339 - protein, 159 aa, Triticum aestivum
MDASATGAGAKAKKGVSGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKRTAEKESKEGKSPKKTAKSPKKAEKKA

SEQ ID NO: 6340 - protein, 329 aa, Triticum aestivum
  misc_feature (149)..(149): Xaa can be any naturally occurring amino acid
  misc_feature (156)..(156): Xaa can be any naturally occurring amino acid
  misc_feature (171)..(171): Xaa can be any naturally occurring amino acid
IRTRVTSSSSLEPDRLSVVVKRAGRWTEKLYETISSLPPSQPGHLDVSVEGPYSQATPASFLQYDSLVMISGGGGITPFISVIRELVHRSGTAAEAATPSLLLIAVFKTSADLAMLDLIVPASGGFSDISRLELRIEAFVTRESVPSAXAMSSQSXQGARRGGLVQAVAVXAPIAPVLGHNGWLWLAAVVSSSFFIFLLFVGAVQRLYIYPVDGNSNRVYPWAARTLLNLLLLCVGIAVAASAAVLWNKRRRAEEAKQVENVATPASSPATWLDKPRRGDAEVESSPLHYLEQATAVHFGPRPDLRSTMHRSILFSFWVELVLLPLKSA

SEQ ID NO: 6341 - protein, 256 aa, Triticum aestivum
MAPRKFFVGGNWKCNGTGDDVKKIVTFLNEAEVPSEDAVEVVVSPPFVFLQQAKGLLRPDFAVAAQNCWVRKGGAFTGEISAEMLVNLQVPWVILGHSERRALLNESNDFVADKVAYALAQGLKVIACIGETLEQREAGTTMEVVSAQTKAIAEKTSDWTNVVLAYEPVWAIGTGKVASPAQAQEVHDGLRKWLHANVGPAVAESTRIIYGGSVNGANCKELAAQPDLDGFLVGGASLKPEFVDIIKSATVKSSSA

SEQ ID NO: 6342 - protein, 256 aa, Triticum aestivum
MNPRDSDDDRPGAAAGSSSAAPEQQQQQQSLEWRFAQVFGERAAGEDVQEVDIISAIEFDKSGDHLATGDRGGRVVLFERTDVRDEHANRRELERQDVPITRHPEFRYKTEFQSHEPEFDYLKSLEIEEKINKIKWCQTANNALFLLSTNDKTIKYWKVQEKKVKQVSVMALDTSRTVGDGTTSRASTSTSEPPLPNGGCSKKSDSLNSDLLFPPGGYPSLRLPVVTSQDVNLCARCRRVYAHAHDYHINSISNNR

SEQ ID NO: 6343 - protein, 181 aa, Triticum aestivum
  misc_feature (14)..(14): Xaa can be any naturally occurring amino acid
EEAEETRGGEEEAXGLPAMASLMDKAKGFVADKIAHMPKPEASLDKVTFKGMTREAITVHSHVNVTNPYSHRIPICDISFNLKCGGKEVASGTIPDPGWIEDSGEVTKLEVPAKVPYDFLISLMKDLGRDWDIDYELLVKLTIDLPIIGNFTIPLDTAGEFKLPTLSDFFGGSAKTEEATA

SEQ ID NO: 6344 - protein, 133 aa, Triticum aestivum
MASLMDKAITVHSHVNVTNPYSHRIPICDIAFNLKCGGKEVASGTIPDPGWIEDSGEVTKLEVPAKVPYDFLISLMKDLGRDWDIDYELLVKLTIDLPIIGNFTIPLETAGEFKLPTLSDFFGGAAKTEEATA

SEQ ID NO: 6345 - protein, 109 aa, Triticum aestivum
  misc_feature (6)..(6): Xaa can be any naturally occurring amino acid
SPPPPXRIVPFNDNLKFHMAIAVGITVGAGLHIISHLACDFPRLLHAMDDEYEPMKPFFGDAKPPNYWWFVRGTEGWTGLVMLALMAVAFTFATAPLRKGKLRLPKLKK

SEQ ID NO: 6346 - protein, 68 aa, Triticum aestivum
MAADDGFSAARLFSQGVSYTYDDVIFLPGFIDFPADAVDLSTRLSRRVPLSIPCVASPMDTVSRRPAA

SEQ ID NO: 6347 - protein, 85 aa, Triticum aestivum
  misc_feature (21)..(21): Xaa can be any naturally occurring amino acid
  misc_feature (39)..(39): Xaa can be any naturally occurring amino acid
PTPIEQWNMANMAEGTEVWIXRDDLSCMQLRGNKVPKLXLVLTDAAPHGADCAMTGGGIHSNHWRATVAAGKHVNIECYPILRTS

SEQ ID NO: 6348 - protein, 115 aa, Triticum aestivum
MADLALGAGPEEIWRRRPKTKIVCTLGPASRSVEMCSRLLRAGMCVARFNFSHGSHEYHQETLDNLHKAMDITGILCAVMLDTKGPEIRTGFLKDGKPVKLNQGQEITITTDYTI

SEQ ID NO: 6349 - protein, 286 aa, Triticum aestivum
  misc_feature (98)..(98): Xaa can be any naturally occurring amino acid
  misc_feature (143)..(143): Xaa can be any naturally occurring amino acid
  misc_feature (147)..(147): Xaa can be any naturally occurring amino acid
QDVCPIIFHGNLVITHEHGKISEQRVSRLQSGDLLQYGPPNRQAENGQPYLRTMKQGRDWNWNVHSDHPLCNLQHAFAEANPRLGSNAELKFGDNLEXPDEQLGHVLQGVLKLVYEYAKDGLTIFATFQHDAAQLLRKLRSAXPVFXMSNGGSEVYANVRKYSLEEAVKLCLASGMQGIVSEARAVFRFPTAIPKIKEADLSLLTYGTLNNVPEAVYMQHLMGVNGVIVDLVPEITGAVSDLIAVPETDVEINDLSGQVAKDAASTPNFTQREISFLLRLMPELVQ

SEQ ID NO: 6350 - protein, 216 aa, Triticum aestivum
MATAARALVAARPARPLLPSRRLPSSSSIRPPRQRGGGVGSVRCMARRPDSSYSPLRSGQGGDRAPTEMAPLFPGCDYEHWLIVMDKPGGEGATKQQMIDCYIQTLAQVVGSEEEAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQSYQR

SEQ ID NO: 6351 - protein, 194 aa, Triticum aestivum
MGAGQDLEAGAGDGGEKKMAHSSSSGPLPPSEPPHLRGQDPAQYQYGTFHPPAPHPDVRPHPPVGFPQPAPPPGFAAGGYQQQQQKQPYAPADPYYAQGYQAAPGYGPVVQGRPVEGRPVRMRRLPCCGLGMGWLLFIAGFFLAAIPWYIGAFVLICVRVHDHREKPGYVACTVAAIIAAIVIPLGVTKGTDSW

SEQ ID NO: 6352 - protein, 128 aa, Triticum aestivum
  misc_feature (17)..(17): Xaa can be any naturally occurring amino acid
  misc_feature (28)..(28): Xaa can be any naturally occurring amino acid
  misc_feature (45)..(45): Xaa can be any naturally occurring amino acid
  misc_feature (58)..(58): Xaa can be any naturally occurring amino acid
  misc_feature (68)..(68): Xaa can be any naturally occurring amino acid
  misc_feature (70)..(70): Xaa can be any naturally occurring amino acid
SVVDDSCEINGLRTDPXCSACEMAVVWXQNQLAQNKTQDLILDYXYQVSSVTFGEVCXCTSVVALCLXCXILQLCNRLPSPMGESAVDCASLGSMPDIEFTIGGKKFALKPEEVRLLLHDFPLLFVPL

SEQ ID NO: 6353 - protein, 508 aa, Triticum aestivum
MGTRGLAVLLLAAVLLQGLLPASEAEGLVRIALKKRAIDRNSRVAKSLSDREEVHLLGGASNTLPSEEEGDIVSLKNYMNAQYFGEIGVGTPPQKFTVIFDTGSSNLWVPSAKCYFSIACYLHARYKAGASSTYKKNGKPAAIQYGTGSIAGYFSEDSVTVGDLVVKDQEFIEATKEPGVTFLVAKFDGILGLGFKEISVGKAVPVWYNMVEQGLISDPVFSFWLNRHADDEGEGGEIIFGGMDPKHYVGEHTYVPVTQKGYWQFDMGDVLVGGKSTGFCAGGCAAIADSGTSLLAGPTAIITEINEKIGAAGVVSQECKTIVSQYGQQILDLLLAETQPKKICSQVGLCTFDGTRGVSAGIRRVVDDEPVKSNGLRTDPMCSACEMAVVWMQNQLAQNKTQDLILDYVNQLCNRLPSPMGESAVDCASLGSMPDIEFTIGGKKFALKPEEYILKVGEGAAAQCISGFTAMDIPPPRGPLWILGDVFMGPYHTVFDYGKLRVGFAKAA

SEQ ID NO: 6354 - protein, 144 aa, Triticum aestivum
MPRAGLSAGSNKLDIAIDLGNPLLNRTVDGLLKIGAVGACRVAAEDAFDCLQSGSVSKRKLEQTLKKMCKEGAYWGAVAGVYVGMEYGVERVRGQYDWKNALIGGITSGALISAVSNNKGNKIAQDAITGGAIATAVEFINYLT

SEQ ID NO: 6355 - protein, 227 aa, Triticum aestivum
  misc_feature (20)..(20): Xaa can be any naturally occurring amino acid
  misc_feature (34)..(34): Xaa can be any naturally occurring amino acid
  misc_feature (49)..(49): Xaa can be any naturally occurring amino acid
MRATPQIDGWDDQPGTGGHXHGFCKPQPRLSGLXDVPDWTGKPSLPYDXSPHVLRFLGQPLLPAPSNESLDADAIVRGRPDNCNCQIPGSVACVRFHVTEKRIKLKRELGSAFYAMGFDRIGEDAALTWRRDEEKKFNAVIQNNLPSSKYRFMEEVFAAMGSKGRKDIVSYYPNVFQVRRRAYQNRLTPNDVDSDDDSLEPGFLHLRQGGTQGNSMSASSSGTQRGS

SEQ ID NO: 6356 - protein, 147 aa, Triticum aestivum
  misc_feature (106)..(106): Xaa can be any naturally occurring amino acid
MAGRKGGERKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVXPNINSVLLPKKSPTAAEKEAKSPKKKAATKSPKKKTAATKE

SEQ ID NO: 6357 - protein, 147 aa, Triticum aestivum
MAGRKGGERKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSPTAAEKEAKSPKKKAATKSPKKKTAATKE

SEQ ID NO: 6358 - protein, 529 aa, Triticum aestivum
  misc_feature (72)..(72): Xaa can be any naturally occurring amino acid
  misc_feature (103)..(103): Xaa can be any naturally occurring amino acid
  misc_feature (106)..(106): Xaa can be any naturally occurring amino acid
  misc_feature (149)..(149): Xaa can be any naturally occurring amino acid
  misc_feature (173)..(173): Xaa can be any naturally occurring amino acid
  misc_feature (207)..(207): Xaa can be any naturally occurring amino acid
  misc_feature (218)..(218): Xaa can be any naturally occurring amino acid
  misc_feature (222)..(222): Xaa can be any naturally occurring amino acid
LLSRSILLANQPWQPPATSCSSSCVLLHALLAVPAEGLVRVPLTKRPVDEDSPVVAGEDAQRLLAGRHGLVXKADVPTRGEKGHPVALKNHLNALDYGEVGLXTPXPNFTLNFDTDRAGFWAPSHNCFLCAGSQLHPSYKTRTAAKFQXKNGNWGHTYVRETGRQFLGYIIAXNKVARVVVLLEKIMFKVTLSDNLVGIAFLVMSLXKFDGILGLGFXEIAXGPVLNPVWYNMVNQHLVGSPVFSFWFNRHAGEGHGGEIVFGGIDPKHHKEEHKYVPVTKKGYWQFDMGDVLIGGKSTGLCTSRCAAIADSGTSLLVGPTAIITQINEKIGAPGIFSQECKEVASQYGQRILDLLLNEIDPTKICPSVGLCTHSGTQGVNDVSFGIRTVVDDETGRSNDAVCHVCEMAVMWAKNQLAQDQTRDLILKYINTLCGYIPSPMGESSVDCKRLASMPDVAFSIGGKKFALTPEQYILKIGEGDATKCISGFVAMDIPPPRGPIWILGDIFMGAYHTVFDYGKMKVGFAKAA

SEQ ID NO: 6359 - protein, 358 aa, Triticum aestivum
MEVTPNHTQAVSGWAAMEPSGEVVPFAFKRRENGVDDVTIKVHYCGMCHTDLHFINNDWGITMYPLVPGHEITGVVTRVGANVSGFRPGDRVGVGCIAASCLDCDHCRRSEENYCDKVALTYNGIFWDGSVTYGGYSSMLVAHKRFLVRIPDALPLDAAAPLLCAGITVYSPMKQHGMLQAGRRLGVVGLGGLGHVAVKFGKAFGLKVTVISTSPAKEREARESLKADDFVLSTDEKQMQAMARSLDYVIDTVSAQHSLGPILELLKVNGKLVLVAAPDKPVELPSFPLIFGKRTVSGSMTGGMKETQEMMDLCGEHGITADIELVSTDGINDALARLARNDVRYRFVVDVAGSGSRL

SEQ ID NO: 6360 - protein, 148 aa, Triticum aestivum
  misc_feature (105)..(105): Xaa can be any naturally occurring amino acid
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELRRLLAGVTIAHGGXVIPNINSVLLPKKSPAAAEKEAKSPKKKTAAKSPKKKTAATKE

SEQ ID NO: 6361 - protein, 147 aa, Triticum aestivum
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSAAAAEKEAKSPKKKTSTKSPKKKTAATKE

SEQ ID NO: 6362 - protein, 148 aa, Triticum aestivum
  misc_feature (57)..(57): Xaa can be any naturally occurring amino acid
MAGRKGGDRKKAVTRSVKAGLQFPVGRIGRYLKKGRYAQRVGSGAPVYLAAVLEYLXAAEVLELAGNAAKDNKKTRIIPRHLLLAVRNDQELGKLLAGVTIAHGGVIPNINAVLLPKKSPAAAEKEAKSPKKKTSTKSPKKKTAATKE

SEQ ID NO: 6363 - protein, 200 aa, Triticum aestivum
MSAVNITNVAVLDNPTAFLNPFQFEISYECLVPLDDDLEWKLTYVGSAEDETYDQQLESVLVGPVNVGTYRFVFQADPPDPLKIREEDIIGVTVLLLTCSYVGQEFMRVGYYVNNDYDEEQLREEPPAKLLLDRVQRNILADKPRVTKFPINFHPEPGTSSEQPQQDAEQQQQPTSPEPQTAPVEPHMAPLENVPIAADQ

SEQ ID NO: 6364 - protein, 146 aa, Triticum aestivum
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSAAAEKEAKSPKKKAATKSPKKKAVATKE

SEQ ID NO: 6365 - protein, 208 aa, Triticum aestivum
  misc_feature (187)..(187): Xaa can be any naturally occurring amino acid
  misc_feature (201)..(203): Xaa can be any naturally occurring amino acid
MAANAGAGAGGSKIRNAKLVLLGDVGTGKSSLVLRFVKGQFVEFQESTIGAAFFSQTLAVNDETVKFEIWDTAGQERYHSLAPMYYRGAAAAIVVYDITNAASFTRAKKWVQELQAQGNPNTVMALAGNKADMLEARQVPVEEATTYAQENGLFFIETSAKTAINVNDVFYELAKRLLAGQQAQTAXRGWCPQKRPAESGXXXSCCSS

SEQ ID NO: 6366 - protein, 103 aa, Triticum aestivum
TLSPFAGLAFHPLDGILQALPHSLCLFFMPIHFTTHLVLIFIEGIWTANIHDCIHGKLWPVMGAGYHTIHHTTYRHNYGHYTIWMDWLFGTLHNPEEDEGKAM

SEQ ID NO: 6367 - protein, 99 aa, Triticum aestivum
MAGKLYQLMARLHLAKGRASADVPKGHFAVYVGEQRKRFVIPTAYLRHPSFLVLLKRVEDEFGFDHRTGGGLTIPCSEGDFADIVGGCSSSSSPAVDYH

SEQ ID NO: 6368 - protein, 204 aa, Triticum aestivum
MKPTRPLKTVAKEKKTKATNNWMTILGLPPKKASANDQVPPNEQQQTQHKTSEDTKKLAANALAAVRDAATAASGRGKVEITEVRDFAGKDIEIKKLVDADSKEAVEKASAAGASPSAVDNILEQIRKKQKLSVLDKTKKDWGEYKAEKGVEEELGAYKKSSNQYLDRQSFLKRADYREYELERDARLSLMAKRKSESMQDDDV

SEQ ID NO: 6369 - protein, 360 aa, Triticum aestivum
MDALAPTPTRRRRLLAGAAAATACYGLYRLYLHHRRRIAAALSLADALSQAGSDLADFLRSDSDQVPRSLRQLSKLAASDHVSSAASALSESLASGALRAFSSHRAARGPDPSSPPLQDRILDRLLSPAGAGFASAVLGSFARNLVLSCRDPAARPRAPGQPDWLAALCSDRGKEAAAELVRVFVSTAVAAYLDRTAAVRTSDQVLAGVSNPKHDAKLKDLLVSVCNGAVETFVRTSRQVTKEASISRAEAAVAVRDVCNSGPSCVMERVSTTLAMPSNRRFVLDVTGRVTAEMVRSFLEFSTQRVSAGARKSIVVARDEIAERGLVAVKYLSAKSMAIFTLCLTMCMHISVGIRFPLPA

SEQ ID NO: 6370 - protein, 150 aa, Triticum aestivum
LDPRFLYCFRAMSGVKRDSWLRKMAFYQSFGLSEGELLQAFKKQPTIFLFADESINKKVRFLLDELKLGISDVIARPVVLGYSLEKCILPRCAVLSVLMREGRIRRDIKLLQALLGSSRNFETRYVLRHADDVPDVVKAYQGKIKFEGFK

SEQ ID NO: 6371 - protein, 191 aa, Triticum aestivum
  misc_feature (39)..(39): Xaa can be any naturally occurring amino acid
MQSRHRVFAEDLLLAQLQGEDHFDSVPDSLVLLIFNKAXDARSLGRCSAVSRRFNALVPLVDDACLHIDRVIAAGDADDALGASGGPRQRGVLSSLLKTVLLAVLKLFGHCDAGARPGGHAGGKHAPHHSPAQVLKNFSSIRNLRMELPVSDVGTDDGVLLRWKAVFGTTLQSCVILGGDRLEHASHPAPS

SEQ ID NO: 6372 - protein, 147 aa, Triticum aestivum
VGKNGGGHGAVVEEIHGLIRVYKDGHVERLPAIPDVPCTWGSTAAGSGVLARDVAVDRATGVWARLYAPASAAGKVPVVVYFHGGGFSVGSAAWSCYHEFVAQLPARAGCAVMSVDYRLAPENRLPAAFDDGLTALRWLRQQAGRNN

SEQ ID NO: 6373 - protein, 271 aa, Triticum aestivum
MYKQGAAGGAGPDRKRISDALDKHLEKAAASPSTSRGSAGARGNHNRVVVPSSIPKGRCSEGESESDSEASDVSGSDGEDTSWISWYCNLRGNEFFCEVDDDYIQDDFNLCGLSSQVPYYDYALDLILDIESSHGDIFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYDHLKPQKPSQRYVPRVFGFKLHNHKP

SEQ ID NO: 6374 - protein, 199 aa, Triticum aestivum
  misc_feature (75)..(75): Xaa can be any naturally occurring amino acid
  misc_feature (145)..(145): Xaa can be any naturally occurring amino acid
MQDKDFRVLYNLSLENAEQRKLDVAALYAKKLLKLENGSELRSWLLVARITSAQKRFEDAESIVNAALDQTAKWXKEILLQTKAKIQAANGQFKKAVETYTQASLLSSQLRKEKFQLLGILYYRARTDDGSMETEAWYNLALLYXSLSQWRDTELCISKIKAISAYSPLAYHATGKLLEARGFLKEALGAYSKALDLEP

SEQ ID NO: 6375 - protein, 221 aa, Triticum aestivum
RLHPRIRQLQADGRVEFADGSSVVADTVIYCTGYAYSFPFLDTGGAVTVSDDGYVVGPLFEHVFPPSLAPSLSFVGVPRKIPIPWFLEVQARWVAQVLSGRRELPPEEEMLRSVEEHLRAREAAGVPRKLTHNIGSIEPHTIFEFGEKYCDFTPLEEWKKELMVSSVVSMMDDVETFRDLANDSENVHKGLQEWRLGAAALLKVKQNRPITTPVDTEGDGL

SEQ ID NO: 6376 - protein, 512 aa, Triticum aestivum
  misc_feature (163)..(163): Xaa can be any naturally occurring amino acid
MDVASLLPFAIALVAIPISLALLDRLRLGRLPPGPRPWPVLGNLRQIKPVRCRCFQEWAERYGPIISVWFGSSLTVVVSTSELAKEVLKEHDQQLADRPRNRSTQRFSRNGQDLIWADYGPHYIKVRKLCNLELFTQKRLEALRPIREDEVTAMVESVHRAAXAPGNEGKPLVVRNHLAMVSFNHITRLAFGKRFMNANGDIDEEGQEFKIIVNHGIKIGASLSVAEYIWYLRWLCPLNEELYKTHNERRDRLTKKIIEEHAQALQERGAKQHFVDALFTLREKYDLSDDTVFGLLWDMITAGMDTTVISVEWAMAELVRNPRVQKKLQEELDSVVGRDRVMSETDFQNLPYLMAVVKESLRLHPPTPLMLPHKASASVKVGGYSIPKGANVMVNVCAVARDPKVWSSPLEFRPERFLEESIDIKGSDFRVLPFGAGRRVCPGTQLGINLVASMIGHMLHHFEWSLPEGARPEDISMMESPGLVTFMGTPLQAVATPRLENEELYKRVPVEI

SEQ ID NO: 6377 - protein, 119 aa, Triticum aestivum
  misc_feature (111)..(111): Xaa can be any naturally occurring amino acid
  misc_feature (117)..(117): Xaa can be any naturally occurring amino acid
MAPPPEEERGGGGCRARWLRREVLLALALGQLVSLLITSTGFSSSELARRGINAPTSQSLLNYILLALVYGGILLYRRQPLTTKWYYYLILGIIDVEANYIVVKSYQYTSXLTSVMXLD

SEQ ID NO: 6378 - protein, 181 aa, Triticum aestivum
DSGIHSGNIQTAIETLNDFDPEILDEDKALHFSLLRLQLVELIRTCNTPGGDIGPALKFATEQLGPRAPTNNKFLGDLEKTMALLMFPSDSLEPELAALLKPELRLEVADNVNRAILERQSQRRESAIRQLVRMRVWAENTARDKGKSLPEYLELGLYNDVPDLGRLPPQTRNGHDPMITT

SEQ ID NO: 6379 - protein, 217 aa, Triticum aestivum
  misc_feature (81)..(81): Xaa can be any naturally occurring amino acid
  misc_feature (99)..(99): Xaa can be any naturally occurring amino acid
  misc_feature (103)..(104): Xaa can be any naturally occurring amino acid
  misc_feature (124)..(125): Xaa can be any naturally occurring amino acid
  misc_feature (136)..(137): Xaa can be any naturally occurring amino acid
  misc_feature (144)..(144): Xaa can be any naturally occurring amino acid
  misc_feature (150)..(153): Xaa can be any naturally occurring amino acid
  misc_feature (157)..(159): Xaa can be any naturally occurring amino acid
  misc_feature (163)..(165): Xaa can be any naturally occurring amino acid
  misc_feature (168)..(168): Xaa can be any naturally occurring amino acid
  misc_feature (171)..(175): Xaa can be any naturally occurring amino acid
  misc_feature (181)..(181): Xaa can be any naturally occurring amino acid
  misc_feature (183)..(183): Xaa can be any naturally occurring amino acid
  misc_feature (185)..(187): Xaa can be any naturally occurring amino acid
  misc_feature (189)..(189): Xaa can be any naturally occurring amino acid
  misc_feature (191)..(193): Xaa can be any naturally occurring amino acid
  misc_feature (195)..(195): Xaa can be any naturally occurring amino acid
  misc_feature (197)..(197): Xaa can be any naturally occurring amino acid
  misc_feature (199)..(205): Xaa can be any naturally occurring amino acid
  misc_feature (207)..(209): Xaa can be any naturally occurring amino acid
  misc_feature (214)..(214): Xaa can be any naturally occurring amino acid
RGEREGERERERERERERERERERERERERGQFDMGDVLVGGKSTGFCAGGCAAIADSGTSLLAGPTAIITEINEKIGAAXGVVSQECKTIVFQYGQQXLDLXXAETHPKKVCSQFVFAPFNGXXGVMLEIRTVSXXPFKIKWXPYPSHXXXXKMVXXXIQNXXXQNXTQXXXXXSFNQFXQXFXXXMXKXXXAXPXLXXXXXXXPXXXQKIFXLNP

SEQ ID NO: 6380 - protein, 194 aa, Triticum aestivum
  misc_feature (174)..(174): Xaa can be any naturally occurring amino acid
VIGMDVTASEFFRAGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKNGAPCRFERLAKYNQLLRIXEELGSKAKFAGRNFRNPLAK

SEQ ID NO: 6381 - protein, 220 aa, Triticum aestivum
  misc_feature (101)..(101): Xaa can be any naturally occurring amino acid
  misc_feature (190)..(190): Xaa can be any naturally occurring amino acid
  misc_feature (198)..(199): Xaa can be any naturally occurring amino acid
  misc_feature (202)..(202): Xaa can be any naturally occurring amino acid
  misc_feature (205)..(206): Xaa can be any naturally occurring amino acid
  misc_feature (211)..(211): Xaa can be any naturally occurring amino acid
  misc_feature (216)..(216): Xaa can be any naturally occurring amino acid
  misc_feature (218)..(218): Xaa can be any naturally occurring amino acid
GLAGAAGMGQELALNIAEKGFPISVYNRTTSKVDETVQRAKLEGNLPLYGFHDPASFVNSIQKPRVVIMLVKAGAPVDQTIATLAAHLEQGDCIVDGGNEXWYENTERREKAMEERGLLYLGMGVSGGEEGARHGPSMMPGGSLEAYQYIEDILLKVSAQVPDSGPCVTYIGKGGSGNFVKMVHNGIEYXDMQLIVEXXHVXKSXXKLTNXELATXFXRW

SEQ ID NO: 6382 - protein, 223 aa, Triticum aestivum
  misc_feature (135)..(135): Xaa can be any naturally occurring amino acid
MARKGGERKKAVTRSTKAGLQFPVGRIGRFLKKGRYAQRVGSGAPVYLAAVLEYLAAEVLELAGNAAKDNKKTRIVPRHLLLAIRNDQELGKLLAGVTIAHGGVLPNINPVLLPKKALEKAEKESQSPKSPKRKXPAPAPAAKKTPKKKAADKKTAAADKKTAAADKKKAAADAEEEARRRRVKRAKLRRVVLHLRGERRKRSCDPEWNGCSGVQLGTSCKVD

SEQ ID NO: 6383 - protein, 157 aa, Triticum aestivum
  misc_feature (129)..(129): Xaa can be any naturally occurring amino acid
  misc_feature (131)..(131): Xaa can be any naturally occurring amino acid
MDASATGAVSKVKKYVVGRKLGGGPRKKAVARSVKAGLQFPVGRIGRFVKKGRYAQRVGMGAPVYLASVLEYLAAELLELAGNAAKDNKKSRIIPRHLLLAIRNDQELGKLLAGVTIAHGGVLPNINPXVXLPKKTAEKSTKEPKSPKKTAKSPKKA

SEQ ID NO: 6384 - protein, 173 aa, Triticum aestivum
  misc_feature (73)..(73): Xaa can be any naturally occurring amino acid
MEASAAGAVPKAKKYVVGRKLGGGPRKKAVARFVKAGLQFPVGRIGRFLKKGQYAQRVGMGAPVYLASVLDSXEYLAAELLELAGNAAKDNKKSRIIPRHLLLAIRNDQELGRLLAGVTIAHGGVLPNINPVLLPKKTAEKEPKSPKKAAKSPKKAAEKEPKSPKAAKSPKKA

SEQ ID NO: 6385 - protein, 513 aa, Triticum aestivum
  misc_feature (88)..(88): Xaa can be any naturally occurring amino acid
MDPKSPDDRPEAAAPQPLEWRFAQVFGERGAGEDVQEVDIISAIEFDKSGDHLATGDRGGRVVLFERTDARGNASRTELERQDYSVAXRHPEFRYKTEFQSHEPEFDYLKSLEIEEKINKIKWGQTANNALFILSTNDKTIKYWKVQDKKVKRISVMNLDTSQSADNGTTSSSSTSSSRGLPNGGSSEKSYNCANNDLPFPPGGYASLRLPVVVTGQELNPVARCRRVYAHAHDYHINSISNNSDGETFISADDLRINLWNLEINSQSFNIVDVKPANMEDLTEVITCAEFHPTHCNTLAYSSSKGAIRLIDLRQSALCDNHSKLFEEHEAPGSKSFFTEIIASVSDIKFARDGQHILSRDYMTLKLWDLSMDSGPVATFQVHEHLRPKLCDLYENDSIFDKFECCLSGDGHRLATGSYSNLFRVFGCTPGNTEATTLEASRNPMRRQVANPTRPTRTLTSLTRAVRRGGENAGADGNGNSNDFSTKLLHLAWHPTENSIACAAGNSLYMYYA

SEQ ID NO: 6386 - protein, 672 aa, Triticum aestivum
TARLIRKPPAPVVDAVVPLPEEVAATAASVVDVERAVAAPVNRRRAPNGVAEQEPRSGGIRGEVKPRIIDVPNGVVGEHVAAGWPRWLTEVATEAVRGWQPRKAESCEKLDKIGQGTYISVYKARDLENGKIVALKKVRFANMDPESVRFMAREIHILRRLDNPNVIKLEGLVTSRMSSSLYLVFEYMEHDLAGLAATPGIKFTEAQVKCYMHQLLSGLGHCHSPGALHRDIKGANLLLDNNGALKIADFGLATFFNPNHKQNLTSRVVTLWYRPPELLLGATNYGATVDLWSAGCILAELLSGKPIMPGRTEVEQLHKIFKLCGSPSEEFWANLKLSRATIFKPQHPYRRCVNDVYKDFPPSALALLDRLLAVEPDNRGTAASALESEFFTTKPYACDPSSLPKYPPSKEYDAKLRDEEARRQRAAAAKGHESETGRRKQLAAQNGTIDLQQRRVPVNPKSSSNKFTPKEDGVTGFPMDPLVVDNGHARHVPLMNAGRSSSTLGRSSGTDPNGQRFYTSQIAAAEMSNPSTATGQRGNTGKLSNLGDSARKQYLREHRSSSRYSQLAAADQSDKPKWSQSHQFQERPSSSHRKDEVVADKEPTGVNGTRKNRIQYSGPLMPPGVNMEEILKEHERQIQQAVRRARLDKGKGKHAERDQSESLLYAAHNGRS

SEQ ID NO: 6387 - protein, 139 aa, Triticum aestivum
MCGIFAYLNYNVSRERRYVLEVLLNGLRRLEYRGYDSSGIAVDADLPAPPAPGSAPAPYAGAPPLVYRQEGKIENLVRSVYAEVDEKDVNLDAAFNVHAGIAHTRWATHGVPAPRNSHPQSSGAGDEFLVVHNGIITNY

SEQ ID NO: 6388 - protein, 410 aa, Triticum aestivum
  misc_feature (322)..(322): Xaa can be any naturally occurring amino acid
TVGSLGGLAALTVFVFYLLHQRKKRKQAVASNEFMRSGSSMTSYSKDLELGGSPHIFTFEELEVATDGFSASRELGDGGFGTVYKGKLKDGRVVAVKRLYKNNYRRVEQFLNEVDILSRLLHQNLVILYGCTSRMSRDLLLVYEFIANGTVADHLHGSRSAERGLTWPLRLNIAIETAEALAYLHAVEIIHRDVKTTNILLDNNFHVKVADFGLSRLFPLEVTHVSTVPQGTPGYVDPVYHQCYKLTDKSDVYSFGVVLVELISSKPAVDMSRSHSEINLANMALNRIQNHEVVKLIDPELGYDTDPETKRTIDRVAEVAFXCLQLERDLRPSIKEVVEILTCVRDGDCRANSMKKKKASQKEDASLLKDGLQFSPDTVIHRFYSQSTNHSVASNASGLSITANAEKNAA

SEQ ID NO: 6389 - protein, 442 aa, Triticum aestivum
REWHQKVISSVRRLNEEKGYAVAVMMDTEGSEIHMGDLGGAPAAKAEDGEIWTFSVRSFEAPLPELTVHVNYEGFAEDVRVGDDLLVDGGMARFEVVEKLGPDVKCRCTDPGLLLPRANLTFWRDGSVVRAKNAMLPTITSKDWLDIDFGIAVGVDFIAVSFVKSAEVINHLKSYIAARSRGSDIAVIAKIESIDSLTNLEEIIRASDGAMVARGDLGAQIPLEQVPSIQQKIVKLCRQLNKPVIVASQLLESMIEYPIPTRAEVADVSEAVHQRADALMLSGESAMGRYPDKALSVLSSVSLRIERWWREEKHHEPLELEDVSSSFADKISEEICISAAKMANKLEVDAVFVYTKGGHMASLLSRCRPDCPIFAFTNSTSVRRRLNLQWGLIPFRLTFSDDMESNLNRTFSLLKARGMIKPGDLVIALSDMLQSIQVMNVP

SEQ ID NO: 6390 - protein, 208 aa, Triticum aestivum
  misc_feature (185)..(185): Xaa can be any naturally occurring amino acid
MSKMADEKVISAPATGGGEDGLIAGDLSAAEARVRPLETLLRAAPLGLCVAAMAVMLRDTQTNEYGTVSYSDLGGFKYLVYANGLCAAYSLVSAFYTAVPRPATLSRSWIVFLLDQVFTYLILAAGAASAELLYLAYNGDKEVTWSEACGVFGGFCRQARTSVAITFGSVVCYILLSLISSYRLXFSAYDAPMPSLGNKGVEIAAFPR

SEQ ID NO: 6391 - protein, 248 aa, Triticum aestivum
  misc_feature (93)..(93): Xaa can be any naturally occurring amino acid
MSKMADEKVISAPATGGGEDGLIAGDLSATEARVRPLETLLRAAPLGLCVAAMAVMLRDTQTNEYGTVSYSDLGGFKYVAPSHLDSSVPGVHXLRNFPSLPCSLTNSCPCGFLAQNRRYLVYANGLCAAYSLVSAFYTAVPRPATLSRSWIVFLLDQVFTYLILAAGAASAKLLYLGYNGDKKVTWNKAFGVFGGFCRQARTSVAIPLGSVVCYILLSLIWSYRLFSAYDAPMPSLGNKGVEIAPFPR

SEQ ID NO: 6392 - protein, 83 aa, Triticum aestivum
  misc_feature (42)..(42): Xaa can be any naturally occurring amino acid
MAPTGMGVSATFVAPFQGLKSTVGLPVSRRSNGASLGSVSNXGGRIRCMQVWPIEGIKKFETLSYLPPLSTEGFLKQVDYLIR

SEQ ID NO: 6393 - protein, 111 aa, Triticum aestivum
MAAKCALSAPCLSAHRPLCRNRLAPCLPSPRPARAVALRVSAAKLPPGVEVPRVQPKLSEPFLGFTQTAEIWNSRACMIGLIGTFIVELVLNKGILQMIGVEVGKGLDLPL

SEQ ID NO: 6394 - protein, 187 aa, Triticum aestivum
MASPSSSLCSSLGYPRAASLGGRRRVGFSSSRKLFQVKASRVDSFSKSDIIVSPSILSANFAKLGEQVKAVEVAGCDWIHVDVMDGRFVPNITIGPLIVDALRPVTDLPLDVHLMIVEPEQRIPDFIKAGADIVSVHCEQTATIHLHRTVDQIKSLGAKAGVVLNPGTPLSAIEYVLESVDLVLIMS

SEQ ID NO: 6395 - protein, 117 aa, Triticum aestivum
  misc_feature (22)..(22): Xaa can be any naturally occurring amino acid
MAEHLFEDIFNVTRIDPDGKKXDRVIRIEAKSEQLEMYMQLDVATDVYPMHVGDKFTMVLAPTLNLDGTPDTGFYTQAGRKTLADKYDYVMHGKLYKISEDISSEKEATKVYDFSEL

SEQ ID NO: 6396 - protein, 108 aa, Triticum aestivum
MAVASMLHAPSLLAVQTFRGQRNAAANRSPRAAAFRVRAAKLPAGVQVPRAQPKLSEPFLGFTKTAEVWNSRACMMGLIGTFIVELILNKGVLEIIGFEVGKGLDIPL

SEQ ID NO: 6397 - protein, 109 aa, Triticum aestivum
MAVASMVHAPSLLAVQALRGQKNAASARCSPRATAFRVRAAKLPAGVQVPRAQPKLSEPFLGFTKTAEVWNSRACMMGLIGTFIVELILNKGVLEIIGFEVGKGLDIPL

SEQ ID NO: 6398 - protein, 91 aa, Triticum aestivum
MAAAANTAVFVSPSQPLSSKRNFLYSPTVSPIQRRFPRRKLELQVKAVATTLAPLEEIKEYKLPSWAMFEMGTAPVFWKTMNGFPPTAGEK

SEQ ID NO: 6399 - protein, 302 aa, Triticum aestivum
  misc_feature (98)..(98): Xaa can be any naturally occurring amino acid
  misc_feature (231)..(231): Xaa can be any naturally occurring amino acid
IYMGGGERCKRMNHYIWGFLCALGEAQFLNRTLVMDFNVCLNSRYTASGKDGEEDYRLYFDFEHLKESASVIDQSQFWTDWGKWHKKDRLKNHYTEDXKVTPMKLRDVKDTLIMRKFGHVEPDNYWSRVCEGETEAMIKRPWHFLWKSRRLMEIVSAIASRMSWDFDSMHVVRGEKAQNTQLWPNLDADTSPENLLTTLNDKVGAGRYLYIATDESDKSFFDPLKNKYKTXFLDDFKDLWDENSEWYAETKELNNGNPVEFDGYMRVAVDTEVFLRGKRKLETFNDLTRDCKDGVNTCAAAS

SEQ ID NO: 6400 - protein, 102 aa, Triticum aestivum
  misc_feature (49)..(49): Xaa can be any naturally occurring amino acid
  misc_feature (52)..(52): Xaa can be any naturally occurring amino acid
  misc_feature (80)..(80): Xaa can be any naturally occurring amino acid
MGSWATSVSPLEGLKSTVGLPVRRRSNGSSLCSVSNCGRIRCMQAWPIXGHXKLETLSYLSPIRTDAILKHVYYLIRSKXLPWLTFNTVGSILREHNACARY

SEQ ID NO: 6401 - protein, 498 aa, Triticum aestivum
  misc_feature (193)..(193): Xaa can be any naturally occurring amino acid
  misc_feature (230)..(230): Xaa can be any naturally occurring amino acid
  misc_feature (266)..(266): Xaa can be any naturally occurring amino acid
  misc_feature (276)..(276): Xaa can be any naturally occurring amino acid
  misc_feature (481)..(481): Xaa can be any naturally occurring amino acid
MAAAVADAAVPAVAKANGAGAGCCAAKGPGYATPREAMEKGPREGLLYVTCVYNGTGINKPDYLATVDVDPNSATYSQVIHRLPATHIGDELHHSGWNACSSCHGDPSTSRRFLILPSLLSGRVYVVDTAKDPRAPALHKVVQAEDIAEKTGLGFPHTSHCLATGDIMISCLGDKEGNAAGNGFLLLDSEFNXVKGRWEKPGHSPLFGYDFWYQPRHKTMISSSWGAPAXLRTGFDLQHVQDGLYGRHLHVYDWPGGELKQTLDLXGSTGLLPLEXVRFLHDPSKDTGYVGCALTSNMVRFFKTADGSWSHEVAISIEPLKVRNWMLPEMPGLITDFVISLDDRYLYLVNWLHGDIRQYNIEDPAKPVLAGQVFVGGLLQKGSDVVYVTDDDKEEQYAVPQVKGHRLRGGPQMIQLSLDGKRVYVTNSLFSRWDEQFYGPDLLKKGSHMLQIDVDTEEGGLTVNPDFFVDFGTEPEGPSLXAHEMRYPGGDCTSDIWI

SEQ ID NO: 6402 - protein, 395 aa, Triticum aestivum
  misc_feature (118)..(118): Xaa can be any naturally occurring amino acid
MVDVEHRMAGMAPAAHAAGLRRLSTRAAAGPSSASASPRHGLYSFQGLASSVLSHLRASGVAILPGLSDTELARAEAEMGFTFPPDLRAVLALGLPSGPGFPDWRSRAGLRAAFDLPXAAASLQIARGALWPRCWGKRPADPDRARRLARSAIRRAPLLVPLFDRCYLPCTPSLAGNPVFFVTDDRVLCCGLDVVHFFTRESSFQPMDISSPFAAMPSSGTSTPCTRRSLDAACGGQAPRWIEFWSDAASDRRRRDSSSSEASTASTSSSGCCSPPRRSTPRWVDNYLDKLGSVLKKGGWRDREVDEMVEVAASGMFDGEEAPPAADAEAVLDTLLLKTDRCSDSLRRAGWSSEDVSDALGLDLRRCKEPHRSVVRVPPEIAAKVQRLARTVARS

SEQ ID NO: 6403 - protein, 359 aa, Triticum aestivum
  misc_feature (124)..(124): Xaa can be any naturally occurring amino acid
  misc_feature (174)..(174): Xaa can be any naturally occurring amino acid
  misc_feature (205)..(205): Xaa can be any naturally occurring amino acid
MAKETEYYDALGVSPAASDDEIRKAYYIKARQVHPDKNPDDPQASDKFQALGEAYQVLSDPLQRKAYDGYGKTSISRDNILDGALVFTLLFGSELFEDYIGHLAMATMASDFQGHRGSQSAPKXMTRSLGRVRCYKGRKRRYLNPNRSFSIMEGDMRICSSSDVGEKVFSINTXWTLVDPWISLFPTSSQELGKKAKYLGVPFLXRWVRDKGHFWRSQITAAKGALQLLQLQEEACRQSAKDGGAATEKDVDMQMRMNKDLMMSSIWKLNVVDIEVTLLHVCEMVLHENNVKKEDLKARAMALRNLGKIFQREKEALPGPSKPTILDDDSSSDESSDEEASRTVTYRTPCAYSGNWQAI

SEQ ID NO: 6404 - protein, 143 aa, Triticum aestivum
NARTPMQWDASPNAGFTTADANPWMRVNDNYTDINAASQTSDSNSVYSCYRQVLGKRKEYKDIFVYGNFQLVDESNDKIFAYSRRADSGETALVVCNFSVDSVAWKLPGEAREVLTSPAGRTLNDLNSGEIKLAPCEAFALLK

SEQ ID NO: 6405 - protein, 194 aa, Triticum aestivum
  misc_feature (8)..(8): Xaa can be any naturally occurring amino acid
  misc_feature (14)..(14): Xaa can be any naturally occurring amino acid
  misc_feature (23)..(23): Xaa can be any naturally occurring amino acid
  misc_feature (113)..(113): Xaa can be any naturally occurring amino acid
ALASGQHXSELNPXNREPFRFDXRYERYLRPAGLMRLANICRAGLPSIDRALVSALVDRWRPETHTFHMPCGEITITLQDVAMILGLPISGHAVIVNKTESYIELYQRYLGKXPPSDKSRPGLRVAWVRAEFNKCPEDADEETIKQHARAYILSLVGGLLFPDASGDRYTVYPFPLIADLENIGSYSWGSATLA

SEQ ID NO: 6406 - protein, 371 aa, Triticum aestivum
  misc_feature (303)..(303): Xaa can be any naturally occurring amino acid
MAAIISRRGAARALALAMARRGMCSAPAPAAALSSEELIRMEQDCSAHNYHPIPMVFSKGEGSHILDPEGNKYIDFLSAYSAVNQGHCHPKVLRALIEQAERLTLSSRAFYNDKFPVFAQYLTSMFGYDMMLPMNTGAEGVETAIKLARKWGYEKKNIPKNEALIVSCCGCFHGRTLGVISMSCDNDATRGFGPLVPGHLKVDFGDIDGLEKIFKEHGDRICGFLFEPIQGEAGVIIPPDGYLKAVRDLCSRHNILMIDDEIQTGIARTGKMLACDWEDVRPDMVILGKALGAGVVPVSAVLXADKDIMLCIKPGEHGSTFGWKPIGQCCGIPSLKGAKDEGLVERPPVGRQAFTFQSQQIPQITRNTGKL

SEQ ID NO: 6407 - protein, 152 aa, Triticum aestivum
MEYGQQGQHGHGTTGRVDQYGNPVGAGTGGMGTGTGGMGQLGEHGGAGMGGGQFQPAREEHKTGGILHRSGSSSSSSSEDDGMGGRRKKGIKEKIKEKLPGGHKDNQHATATGGGAAYGQQEHTGAGTYGTEGTGEKKGIMDKIKEKLPGQH

SEQ ID NO: 6408 - protein, 371 aa, Triticum aestivum
LYSSYSYNELADITSNFSSECIIGQGGTSQVYKGCLTNGKELAVKILKYSDEVLKEFTSEIEIVSSVVHKNVIAPAGFSFKNNDLLLVYEYLQRGSLEEILHGEKECKSMFGWTERFNVAVGVAHALDYLHGNGNSRPVIHRDVKSSNILVSEDFEPKLSDFGLALWAADATPQITCNDVAGTFGYLAPEYFMHGKVNDKIDVFAFGVVLLELVSGRKPLCTGCPKGQESLVMWANSIIQGGKLTQLADPSLPTEGHTDEIERMTLAASLCIRPTPQHRPHIAVVLKLLDGDNDILKWARSHVGLSYKSDGDEDMVTLAPPENNTNIQSYINLAFDVDDDSASVSSNDFITANTSLEEYLQGRWSRSSSFD

SEQ ID NO: 6409 - protein, 424 aa, Triticum aestivum
  misc_feature (159)..(159): Xaa can be any naturally occurring amino acid
MTKDEDFKLVKIQTHVLRVNIHCDGCKHKVKKLLQRIEGVYSVAIDVDNHKVTVTGSVDSETLIRKLTRGGKHAELWSHQKGGNGGNNNNQGHKGGGGGGNNNQQKQQQQQQQQKQAANVSKDGGGKGNGGQKEQGKLGGGGVGSLMQGLKAFKSQHSXKHQLPELSSDDDDDDMYDDEDDEDDDEFDDEYEDDLRFLGDKMSQLGILRQRAEAAAAINAKNKNAANVGGKKGAPAGNNHHQSNQNQKMNMGAAAGNAKMGNGAPKNTGGIGGLMGLNHGGLGAAGAAPGIQGYTGGGGFSHPSSYGAAGYGGLQQQQQQQQQQQNGNLMASMQGYHNNPAAAAAMMNNLRGNMMMHQPQAQPQMMYHRSPQISPYTAYYNPYSYYYQQPGGGGGGSSAYHPGAGTGDVETMFSDENTKGCAIM

SEQ ID NO: 6410 - protein, 191 aa, Triticum aestivum
MGRRLLLPHTRRLMLFLRPMRYSASATATATAGSSRDPLHVCVVGSGPAGFYTAEKMLKGHEGVRVDIIDRLPTPFGLVRSGVAPDHPETKIVVNQFSRVAANPRCSFFGNVTLGSDLSLSELRKTYDVVVLAYGAESDRSFGIPGEDLRGIHSAREFVWWYNGHPDMCNLAPDLTNTDSAVVLGQGKCCA

SEQ ID NO: 6411 - protein, 330 aa, Triticum aestivum
ACRYRSGISGSTHASGLERLDQDPGGILTTICNHSFHCSCISKWTDSSCPVCRYCQQQPEKSMCSVCGTSENLWICLICGNVGCGRYKGGHAIEHWKETEHCYSLELETQKVWDYAGDNYVHRLIQSKTDGKLVEYNCYGGHEADGICSICSGDAGMDEALLNSKVEAIVEEYNDLLTSQLDKQRNYYESLLSEVKEENEKEISAATSKSVSMMKLQKLQAKLDKCLEEKSFLDDINTNLVKNQEMWKERVRKVQEREQAALKLKDEKIEKLEAELRDLIAHIECQNAVAAVPGSISSDIQGGTILPGPSTPSPSSSPVRPTKDRKRYPD

SEQ ID NO: 6412 - protein, 517 aa, Triticum aestivum
  misc_feature (296)..(296): Xaa can be any naturally occurring amino acid
  misc_feature (441)..(441): Xaa can be any naturally occurring amino acid
MDVASLLLPFVLALVAIPILLALHDWPRLPPGPCPWPVVGNLRQIKPVRCRCFQEWAERYGPIFSVWFGSSLTVVVSTPELAKEVLKDHDQQLANRTRNRSTQRFSRNGQDLVWADYGPHYIKVRKLCNLELFTQKRLEALRPIREDEVTAMVSSVHRAATGPGNEGKPLVVRSHLAMVSFNNITRLVFGKRFMNANGDINEEGQEFKSIVNNGIKIGASLSIAEYVWYLRWLFPLNEELYKTHNERRDQLTKKIIEEHAKALKESGSKHHFVDALLTLREQYDLSDDTVFGLLWXFVPRAQDIITTGMDTTVISVEWAMAELVRYPRVQKKLQEELDSVIGRDRIMSETDFQNLPYLLAVVKESLRLHPATPLMLPHKASASVKVGGYNIPKGADVTVNVWAIARNPDVWSNPLEYRPERFLEESIDIKGGDFRVLPFGXGRRVCPGAQLGINLVASMLGHLLHHFEWSLPEGTMPEDVDMMESPGIVTFMNTPLQAVAKPRLDKEELYNRVPVEM

SEQ ID NO: 6413 - protein, 257 aa, Triticum aestivum
  misc_feature (66)..(66): Xaa can be any naturally occurring amino acid
MNSDLGGLGPRPANAPPNPFESAMYGAGPGLIRTGLGAYGEKFLGSSSEFMQSNITQYLSDPQYYXKLKVVLFPFFHRGRWARITAPVPGRLSPSYKPPIQDINAPDLYIPLMAFGTYIVIAGYALGVLGRFTPEALTLQFTRGLVGWFLQVVLIKGLLYSLGSGEAPLLDIVAYAGYGFAGTSLAMLARIFWSYLYYFIMPWFCLCTGVFLVKTMKRVLLGGPRSYERHPSRNHYFLLFLAVVQFPMLFWLGNISG

SEQ ID NO: 6414 - protein, 161 aa, Triticum aestivum
MEEKREGGDIGREGSGRMPRAGLSAGSSKVDVAIDLGNPLLNRTVDGFLKIGAVGACRVAAEDAFDCLQSGSVSKHKLEKTLEKMCKEGAYWGAVAGVYVGMEYGVERVRGEYDWKNALIGGIASGALISAASNNKGNKIAKDAITGGAIATAIEFINYLT

SEQ ID NO: 6415 - protein, 328 aa, Triticum aestivum
  misc_feature (99)..(99): Xaa can be any naturally occurring amino acid
AEFRVAPRPASSPSSSWSPPSPPPCWPPRSSTFSPAAAAAGPSLNPKRPAPTVIRASAGAVHPEESPQSEEKDVDSGAAALPKLKPLHWDKFRASSGRXTVWDQLKASSFRVNEEMIETLFVSNSTRRMPKNGFKEANGAPCNQENKVLDAKKSQNIAIMLRALDATKEEVCKALLDGQADSLGTELLEMLLKMAPTREEELKLREYREDAQSKLGPAESFLKAVLGIPFAFKRAEAMLYIANFDSEVDYLKTAFKTLEAACEELRGSRLFHKILDAVLKTGNRMNTGTNRGNAHAFKLDSLLKLVDIKGTDGKTTLLHFVIEEITKS

SEQ ID NO: 6416 - protein, 197 aa, Triticum aestivum
GRVGGRVGGRVGELQPSREDNQDQHLCKSARWSTRVQQQHGQATIRVDEYGNPVAGHGVGTGMGAHGGSGTGAATGGHFQPTREEHKAGGILQRSGSSSSSSSEDDGMGGRRKKGIKDKIKEKLPGGHGDQQHADGTYGQQGTGMAGTGAHGSAATGGTYGQPGHTGMTGTGTHVTDGAGEKKGIMDKIKEKLPGQH

SEQ ID NO: 6417 - protein, 259 aa, Triticum aestivum
AGAGVKEIIMLSASANKLARLKEQAEEYAALIMEELDPEGLGYIELWQLETLLLQKDTYVNYSQALSYTSQALSQNLAGLRHKSPIRKMSSKLSYYLEDNWKRLWVLALWIGIMAGLFIWKFIQYRNRYVFSVMGYCVTIAKGAAETLKLNMALILLPVCRNTITWLRNTRAARALPFDDNINFHKTIAAAIVVGVILHAGNHLACDFPRLIDSSDEKYDPLRMYFGETKPTYLALVRGVEGVTGVIMVVCMLIAFTLA

SEQ ID NO: 6418 - protein, 92 aa, Triticum aestivum
  misc_feature (14)..(14): Xaa can be any naturally occurring amino acid
  misc_feature (73)..(73): Xaa can be any naturally occurring amino acid
MAFSMLSFGTMAAXSAAQATMVAHFNGLMSSAVFPATATANNDTTCMTSNGGRGNCMQVWPTIVKKKIETLSXLSDPTDSAWAYEVDYLIRN

SEQ ID NO: 6419 - protein, 205 aa, Triticum aestivum
  misc_feature (145)..(145): Xaa can be any naturally occurring amino acid
LRLRAASSRPSWWVLLGDRGAGKTSIVVRFAKGLYYECQESTIGAAFFSQALPVSGGGEDATVRFDIWDTAGQERYHSLAPMYYRGAAAAVVVYDITSMNDSYIRAKRWVDELQRQGNPHLVMALVGNKVDLEKKRKVGTQEALXYAERNGLFFLETSAKTAQNVGELFYELAERLVKVRPNHPAGMVLHDGQRGVGGRWFCCSG

SEQ ID NO: 6420 - protein, 160 aa, Triticum aestivum
  misc_feature (10)..(12): Xaa can be any naturally occurring amino acid
  misc_feature (20)..(20): Xaa can be any naturally occurring amino acid
  misc_feature (24)..(24): Xaa can be any naturally occurring amino acid
  misc_feature (28)..(28): Xaa can be any naturally occurring amino acid
  misc_feature (32)..(32): Xaa can be any naturally occurring amino acid
  misc_feature (34)..(34): Xaa can be any naturally occurring amino acid
  misc_feature (48)..(48): Xaa can be any naturally occurring amino acid
  misc_feature (51)..(51): Xaa can be any naturally occurring amino acid
  misc_feature (68)..(68): Xaa can be any naturally occurring amino acid
  misc_feature (70)..(70): Xaa can be any naturally occurring amino acid
  misc_feature (73)..(73): Xaa can be any naturally occurring amino acid
  misc_feature (75)..(75): Xaa can be any naturally occurring amino acid
  misc_feature (83)..(83): Xaa can be any naturally occurring amino acid
  misc_feature (85)..(85): Xaa can be any naturally occurring amino acid
NCPGLNLQQXXXLYRDTFVXSLAXIPGXIVSXVXVEWIGRKATMWSMXFTXAAFLGPLVLHQDELFTXAXLFXAXACAMGSSXVXCLYAPEVYPTSVRSTGVGIATSIGKIGGVICPLVAVGMLRTCHQMEAVFVFELVLCLAGVACILFPVETKGREID

SEQ ID NO: 6421 - protein, 260 aa, Triticum aestivum
YDGTLSPIVGHPANAVMSDEMRAAVRHVASLFPTAIISGRSRDKVFDFVKLTELYYAGSHGMDIMGPIRKSESNGHHVECVRSTDSEGKEVNLFQPASEFLPMIAEVFENLSESIKDIEGARMEDNKFCVSVHYRNVAPHDYETVHQRVTAVLKDYPCLRLTHGRKVLEVRPVIDWNKGKAVEFLLESLGLSESDDVLPIYVGDDKTDEDAFKVLKANNHGFGILVSSVPKDSDAFYSLRDPSEVMEFLRTLAAWKEGSS

SEQ ID NO: 6422 - protein, 143 aa, Triticum aestivum
  misc_feature (17)..(17): Xaa can be any naturally occurring amino acid
GGRTGLTALTASLYFTXALFITPLLASIPSWAVGPPLVLVGVMMMRAVAEVDWEDMRQAVPAFMTLALMPLTYSIAYGLIGGIASYMLLHSWDWACEAAGRLGCRPRRKVGGGEATRADTPVSNESASGNGEHGKGVSHVELS

SEQ ID NO: 6423 - protein, 83 aa, Triticum aestivum
AIIDGTGSLGAALGPFVTGFISKTGWDSVFIMLILCALIAGACLSGLVKSEIQQIIQNWRNRSSDTPNGTADPGAQPLLEGSS

SEQ ID NO: 6424 - protein, 161 aa, Triticum aestivum
SSKRLRLSDSMETYTTDDALSAMGFGRFQALVLAYAGMGWVVEAMELNLLSFVGPLVREEWQVSAQDESLLSSVVFAGMLTGSRAWGFVSDRYGRRTVWLFSALFTSAMGFLSAWSPNYLCLIALRFLVGVGVGGGHVFSSWFLEFVPAQNRGTCVVLFSL

SEQ ID NO: 6425 - protein, 447 aa, Triticum aestivum
  misc_feature (358)..(358): Xaa can be any naturally occurring amino acid
MSTGRRQASLKVRRRVGTYELGRTIGEGTFAKVRFAKDTESGDPVAIKILDKAKVHKHGLVEQIRREICTMKLIQHPNVVRLHEVMGSKARIFIVLEYVTGGELHDIIAARGSLKEDEARRYFQQLINAVDYCHSRGVYHRDLKLENLLLDTAGNLKVSDFGLSAISEQAKADGLLHTTCGTPNYVAPEVIQDKGYNGALADLWSCGVILFVMLAGYLPFEDDNVSALYKKISGAQFTCPSWFSDGAKRLIPRILDPNPSTRITIPQLLKDPWFKKGYKPPVFDEKHQTSLDDVDAAFGDSEEKQVEEEMEGQPASMNAFELISLNKGLKLDNFFEADKKYRRETRFTSQCPPEEIIXRIEEAAKPLGFDIQKKNYKMRMKNLEAGRKGNLNVATEVFQVAPSLFVVELKKAKGDTLEFQKFYKTLSAQIKDVVWVCESEAEERGST

SEQ ID NO: 6426 - protein, 509 aa, Triticum aestivum
MAFVSFLELSLSLLCFVVFYYFHARSKRKNPVIPLEWPLVGMLPALLANLPRLHDWVTSLLTASPLNFRFVGPPRSGMELFLTSDPANVRHVFTSNFANYPKGPEFAEIMDILGGGIFNADGDSWRRQRAKAQLLMSGPRFRAFVTRCSRRKVERDLLPLLAHVAGGGTGVCDLQDVFLRLTFDTTTTLVFGVDPGCLAIGFPEVPFARAMDDAMDVLLVRNVLPPSWWKLVRWLGVGYERKMAVAWRDIDRFIGETIAKRREAVKARGGIEDSADLLSSYIDDDDEASTVVDAFLRDTTMNLMLAGRDTTGSGLSWFFYLLTRNPGVVSKILAELDTVSSSTTTPDGMVTYDPDELGRLTYLHAALCESLRLYPPVPMEHKGVVAAEALPSGHEVRPGDKVMVSLYAMGRMEAVWGKDCREFRPERWIGEDGKARYVPSYKFVSFNSGPRTCLGKDMAFVQLKAVAAAVVRNFEVEAVPGHAVEPKISIILHIKNGFKARIKRRHADA

SEQ ID NO: 6427 - protein, 156 aa, Triticum aestivum
MEVSGAAAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTAEKEGKEPKSPKKATKSPKKATKA

SEQ ID NO: 6428 - protein, 159 aa, Triticum aestivum
MDATATGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTAEKEGKAPKSPKKTAKSPKKAATPKKA

SEQ ID NO: 6429 - protein, 105 aa, Triticum aestivum
  misc_feature (75)..(75): Xaa can be any naturally occurring amino acid
  misc_feature (79)..(79): Xaa can be any naturally occurring amino acid
MAAIMLCTCSGDQSKFEEMPRSPESLATRDFSASGSCSRPGKREAMPDDSQVNEVESDLRETLSLNYEEARALLXGRLXYQRGNFDAALQVLQGIDIRSLKPRMT

SEQ ID NO: 6430 - protein, 533 aa, Triticum aestivum
  misc_feature (462)..(462): Xaa can be any naturally occurring amino acid
MLTCPRGTAAAGRVTGSPSPEGAKLPHPRVQFLGAPRGAPFFRGLVLCFGSGGEVRGFKNFPTLGLEAYKNRFYFDFSPTYIGVGMICPHIVNVSVMLGGIISWGIMWPLMGKKKGSWYPASLPESSLHGLQAYRVFISIALILGDGLYNFVKVLIRTIAGFISMVHKNSKAMLPVSDNGSPTAEAMSFDDERRTELFLKDQIPMATAYGGYAVVASISIGTLPQIFPQLKWYYILVAYVVAPVLAFCNAYGSGLTDWSLASTYGKLAIFVFGAWAGLANGGVLVGLAACGVMMSIVSTASDLMQDFKTGYLTLASPKSMFISQVIGTSMGCVISPCVFWLFYKAFSDIGISGSEYPAPYAIVYRNMAILGVDGFNTLPKNCLTLCYIFFAAAIAINLIRDLTPHKFSRFIPLPMAMAIPFYIGSYFAIDMFLGSFILFVWEKVNKAKADAFGPAVASGLIXVGNGIWTLPQSILALAKVNPPFCMKFLTRRRQWSKWTKFLGLSHGPFYGRTRGQRQATATHQHPACNYSHF

SEQ ID NO: 6431 - protein, 381 aa, Triticum aestivum
  misc_feature (257)..(257): Xaa can be any naturally occurring amino acid
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECKDCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSIVAVFGLGTVGLAVAEGAKSAGASRIIGIDIDTKKFDVAKNFGVTEFVNPKDHDKPIQXVLVDLTDGGVDYSFECIGNVSIMRAALECCHKGWGTSVVVGVAASGQEIATRPFQLVTGRVWKGTAFGGFKSRSQVPWLVEKYMNKEIKVDEYITHNMNLTDINKAFDLLHEGGCLRCVLAMEH

SEQ ID NO: 6432 - protein, 384 aa, Triticum aestivum
HSITSLYKKAGWYRSGIPGISSTHASARNGLLEVQKAFRDAGLDFSKQGVAITQENSLLDNTARIEGWLDRFPMFDWVGGRTSELSAVGLLPAALQGIDVKEMLVGAALMDEETRNTVVKENPAALLALSWYWATDGIGSKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVEEVTPRAVGALVALYERAVGIYASLVNINAYHQPGVEAGKKAAGEVLALQKRVLTVLNEASCKDPAEPLTLEQIADRCHCPKDIEMIYKIIQHMAANDRALIAEGSCGSPRSVKVYLGECNVDDL

SEQ ID NO: 6433 - protein, 259 aa, Triticum aestivum
  misc_feature (237)..(237): Xaa can be any naturally occurring amino acid
MSLSNKLSIADVDVKGKKVLIRVDFNVPLDADKNITNNQRIVGALPTIKYALENGAKSVILMSHLGRPNGSPNEKYSLKPVVAELEKLLSKKVTFAPDCVGPEVEEIVNKAEDGSVILLENLRFHIEEEGSSKDKEGNKTKADKAQVEAFRKGLTALGDVYINDAFGTAHRAHSSMVGVDLPQKASGFLVKKELEYFAKALENPQRPFLAILGGAKVSDKIQLIDNLLDKVNTLIIXGGMAFTFKKTLENVSIGTPSST

SEQ ID NO: 6434 - protein, 231 aa, Triticum aestivum
VMADFDTSRNDIVEEEEFVQGMKKWLNEFKRNMPAGGAFSSKFNEYHERTRQEHDQLIDRSDEAVESVENPGWCITKAVALRLLGAAIAAAFADPLVDAVHNFSNATHIPSFFISFIALPLATNSSEAVSAIIFASRKKQRTCSLTFSEVYGGVTMNNTLCLGVFLALIYFRNLTWDFSSEVLIILLVCVVMALFTSFRTTFPLWTCLVAYMLYPFSLVIVYILDYVFGWS

SEQ ID NO: 6435 - protein, 521 aa, Triticum aestivum
  misc_feature (303)..(303): Xaa can be any naturally occurring amino acid
  misc_feature (342)..(342): Xaa can be any naturally occurring amino acid
MAATPPSSRDPSPQPRRPAAAAGRPAASGTGTIGNGKRGGLLLGRYELGRVLGHGTFAKVYHARHADTGETVAIKVLDKEKALRAGLVPHIKREITILRRVRHPNIVRLFEVMATKSKIYFVMEFVRGGELFARVAKGRLKEDTARRYFQQLISAVGFCHARGVFHRDLKPENLLVDERGDLKVSDFGLSAVADQFHPDGLLHTFCGTPSYVAPEMLARRGYDGAKADIWSCGVILFVLMAGYLPFHDQNLMAMYRKIYRGEFRCPRWFSRDLTSLLNRLLDTNPETRITMAEVMQSRWFQKXGFRPVRFYVEDDQLHSLGDSESEELGLVEPTEPPLPPPXFPPPLPPPPQQEDDDSGWESDSSVASCPATLSCEERQRPAGRLTRPASLNAFDIISFSKGFDLSGLFEERGSEVRFISAQPMETIVTKLEEIAKMKSFSIRRKDWRVSIEGTREGEKGPLTIGAEIFELTPSLLVLEVKKKAGDKAEYDDFCNKELKPGMEPLVHHQSGSARNVPSDTE

SEQ ID NO: 6436 - protein, 518 aa, Triticum aestivum
  misc_feature (35)..(35): Xaa can be any naturally occurring amino acid
  misc_feature (194)..(194): Xaa can be any naturally occurring amino acid
DMVDSAPGGPCTAVEVKEIIALSASANKLSKIKEXADEYAALIMEELDPKNLGYIELESLESLLLQTPSEAVARSTITHSSKLSKALSMRLAPSKDTSPLRHYWLQFTFFVQENWKRIWVAALWLSICIALFIWKFIQYRNRAVFNIMGYCVATAKGAAETLKFNMALVLFPVCRNTITWIRSKAQRGAGLPFXSERTVRLFRRHDSVKIQKVAVYPGNVLALYMSKPPGFKYRSGQYIFINCGAVSPYEWHPFSVTSAPGDNYLSVHIRTRGDWTSRLRTVFSEACRPPTEGESGLLRADLSVGITDSNARFPKLMIDGPYGAPAQDYREYDVLLLIGLGIGATPLISIVKDVLNHIQRGESVGGTEPDGSGKAKKKPFMTKRAYSYWVTREEGSFEWFRGVMNEVAEKDKDGVIELHNHCSSVYQEGDARSALIVMLQELNHAKKGVDILSGTSVKTHFARPNWRSVFKRIAVNHENQRVGVFYCGEPVLVAQLRQLSADFTHNTNTKFDFHKENF

SEQ ID NO: 6437 - protein, 480 aa, Triticum aestivum
MAIAVSPTHTKQKQQQQDHRRIPSQSNHTRRQARMAIAVSGQWTRLRTLGCGASGAVVTLAADAASGELFAVKSVRAADAAQLSREQGILSGLSSPHVVGCIGGGGDRDGSYHLFLEFAPGGSLADEAARNGGRLEERAIRAYAADVLRGLAYIHGKSLVHGDVKSRNVVIGADGRAMIADFGCARALGSAGPIGGTPAFMAPEVARGEEQGPAADVWALGCTVVEMATGRAPWGEMDNVLAAVHRIGYTDAVPEVPTWLSAEAKSFLAMCFARNARDRCTAAQLLEHPFVALQAGEAKARWVSPKSTLDAAFWESETDEEEEEEEEVSESPSERIKSLSCSVLPDWDSDEGWIDVLGEQCEACDSPAATKGPADVSSRAPSKVLGSPAVPAEDVAVVGTLSSDEHEVDAEDEPFGDDTILAADPSVDRQNQVCSSSDRDVLSSSHVPCNNRVLAIEKFRFPQKKKKKKKKKKKKKKKKK

SEQ ID NO: 6438 - protein, 263 aa, Triticum aestivum
MCGCREVMHAMWRPQKFKGIYLMATAYVLTLTLPSAASVYWAFGDELLTHSNALSLLPRTPFRDAALVLMLVHQFITFGFACTPLYFVWEKLIGLHDCRSLCKRAAARLPVVVPIWFLAIVFPFFGPINSAVGSLLVSFTVYIIPALAHMITRGAARAREGAADRVLAIVGRWTGTYVINAFVVVWVLVVGFGFGGWASITNFVRQIDTFGLFTKCYQCPTPPIPDASWPFPGGLRNLTMLPPAPAPSPAHFLRHHRHHSHRL

SEQ ID NO: 6439 - protein, 198 aa, Triticum aestivum
EAMIPRPVHALIFITPAPMWAHVRESDPGSKELTYNGSGPDEPVMWYRQTIGHACGLIALLHSVSNGTAKDFISPDSLLDKIVKETQDLKPLARANFLYNSVELEKAHMDAAVTGDSAAPTSQEPVGYHFISFVKGSDGHLYDLEGGWGEPVDCGILDEGNDLLSDQALEATVKRYTKVADGNLEFSIIALSTVPEED

SEQ ID NO: 6440 - protein, 173 aa, Triticum aestivum
HPNRKDFFGERAKMCLRYSLCLILFSLISLQGFAKKTGDVSELQIGVKFKPATCEVKAHKGDMIKVHYRGKLTDGTVFDSSFERDEPFEFELGSGQVIKGWDQGLLGACVGEKRKLKIPAKLGYGEQGSPPTIPGGATLIFDTELIAVNEKPAGGEQEQEEEDVDDTYGADEL

SEQ ID NO: 6441 - protein, 293 aa, Triticum aestivum
  misc_feature (3)..(3): Xaa can be any naturally occurring amino acid
  misc_feature (6)..(6): Xaa can be any naturally occurring amino acid
  misc_feature (8)..(9): Xaa can be any naturally occurring amino acid
  misc_feature (22)..(22): Xaa can be any naturally occurring amino acid
  misc_feature (31)..(32): Xaa can be any naturally occurring amino acid
  misc_feature (90)..(90): Xaa can be any naturally occurring amino acid
  misc_feature (108)..(108): Xaa can be any naturally occurring amino acid
  misc_feature (122)..(122): Xaa can be any naturally occurring amino acid
MAXDIXAXXPGGEYAAKDYSDXPPAPLFDAXXLTKWSLYRAVIAEFVATLLFLYITVATVIGYKHQADPAGPNAADAACSGVGILGIAWXAFGGMIFVLVYCTAGVSXGGHINPAVTFGLFXWPRKVSLVRALLYIIAQCLGAICGVGLVKGFQSAFYVRYGGGANELSSGFSKGTGLAAEIIGTFVLVYTVFSATDPKRSARDSHVPVLAPLPIGFAVFMVHLATIPITGTGINPARSLGAAVIYNNEKAWDDHWIFWVGPFIGAAIAALYHQYVLRASATKFGSSASFGSR

SEQ ID NO: 6442 - protein, 293 aa, Triticum aestivum
  misc_feature (63)..(63): Xaa can be any naturally occurring amino acid
  misc_feature (162)..(162): Xaa can be any naturally occurring amino acid
  misc_feature (209)..(209): Xaa can be any naturally occurring amino acid
MAKDEVMETGGGGDFAAKDYTDPPPAPLIDAAELASWSLYRAVIAEFIATLLFLYITVATVIXGYKHQTDPAVNAAADAACGGVGVLGIAWAFGGMIFVLVYCTAGISGGHINPAVTFGLFLARKVSLVRALLYMIAQCLGAMCGVGLVKAFQSAYFVRYGXGGANTLAAGYSKGTGLAAEIIGTFVLVYTVFSATDPKRSARDSHVPXVLAPLPIGFAVFMVHLATIPITGTGINPARSLGAAVIYNKDKAWDDQWIFWVGPMIGAAIAAFYHQYILRAGAIKALGSFRSNA

SEQ ID NO: 6443 - protein, 319 aa, Triticum aestivum
MAFALNASCYPSSFQSSLLPRRMAAAVMIPRRRNVLPVIRAVAVAPPAPAPAKPAAVRSRPVSVTMAKLMAKGKTALIPYITAGDPDLATTAEALHLLDACGADVIELGVPCSDPYVDGPIIQASSARALAGGATMDGVLAMLKEVTPELSCPVVLFSYYRPILCRGLAEIKEAGVHGLIVPDLPYVAAHALWSEAKKNNLELVLLTTPAIPEERMKGITKASEGFIYLVSVNGVTGPRENVNLRVESLIQEIKKVTDKPVAVGFGISKPEHVKQIAGWGADGVIIGSAMVRQLGEAASPREGLKRLEAYARSMKNALP

SEQ ID NO: 6444 - protein, 202 aa, Triticum aestivum
MAPLLSPPLLADLVAKSHSSSTAVRCSGSVRRWAVAGLAGAGRRDRHRRRRTWGRRGFRVSAVATEPRSPEGSAAEDYYAVLGVMPDATPQQIKKAYYNCMKACHPDLSGNDPDVTNFCMFINEVYTVLTDPIQRAVYDEINGFTATATNPFLDDAPRDHVFVDEFSCIGCKNCANVCSKVFEIEEDYGRARVYNQSGNEEL

SEQ ID NO: 6445 - protein, 157 aa, Triticum aestivum
MGILRKKKHERKPSFKSVLTSILATQAATFLLLISGVSLAGTATAFIATMPLFVVFSPILVPAGITTGLLTTGLAAAGGAGATAVTIILWLYKQATGKEPPAVLSKVLKKIIPGAAAAPAAAPAAAPAAAPAAAPAAAPAPKPAAAPAPKPAAPPAL

SEQ ID NO: 6446 - protein, 169 aa, Triticum aestivum
TTFCTPTPWPGAAMLSWATIRAPCQGLKSTDGLTVRRRYISPSLSSVSNGGRIRCMQVWPIEGIKKLETLSYLPPLYTEALLKQVDYLIRCKWVPCLQLSKVDLVFREHNNYGGFYDGRYWTMWKLPMFGCTDTTQVLNEVEEVKKEYPDRYVRGIGLDNLRQVQCVSF

SEQ ID NO: 6447 - protein, 252 aa, Triticum aestivum
MASETSVADEKAPAGLSRYEADAEDGQEGGGDEKSRLSGLLWHGGSAYDAWFSCASNQVAQVLLTLPYSFAQLGMVSGILFQLFYGLLGSWTAYLISILYLEYRTRKEKDKVDFRNHVIQWFEVLDGLLGRHWRNVGLAFNCTFLLFGSVIQLIGCASNIYYVNDHLDKRTWTYIFGACCATTVFIPSFHNYRVWSFLGLLMTTYTAWYIAVASLMHGQADAVKHSGPTTIMLYFTGATNILYTFGGHAVTV

SEQ ID NO: 6448 - protein, 195 aa, Triticum aestivum
  misc_feature (47)..(47): Xaa can be any naturally occurring amino acid
MGSGLSHNHRSSVAPQQQPSSARVIAADGSLTEFATSSPVSVSDVLXGNAGGPFFLCSSDALYFDEDVPALGGGELLRPGQIYFVLPQAMLGRPLSSADMAAMAVRASEALAARARPRGRGAGIRKVRVTPVHAEGGRGDVDAQVNAKLNERTLGEYSVKASGNPAKLGKKVAVAAFPPAKKALKPLSTIEEDAE

SEQ ID NO: 6449 - protein, 205 aa, Triticum aestivum
  misc_feature (135)..(135): Xaa can be any naturally occurring amino acid
  misc_feature (147)..(147): Xaa can be any naturally occurring amino acid
  misc_feature (154)..(154): Xaa can be any naturally occurring amino acid
  misc_feature (158)..(158): Xaa can be any naturally occurring amino acid
  misc_feature (167)..(167): Xaa can be any naturally occurring amino acid
  misc_feature (172)..(172): Xaa can be any naturally occurring amino acid
  misc_feature (186)..(186): Xaa can be any naturally occurring amino acid
MPTKRSVGTLGEKDLSGKKVLLRADLNVPLDDGQRIADDNRIRASVPTINFLMGKGAKVILASHLGRPKGVTPKYSLKPLVPRLSELLGVDVVMANDCIGEEVEKLATALPDGGVLLPGVSGVSCMGGSARNDPXSAQETTSVADLXMLNDPFXTAHXRHMLQTEGXTNYFXPAVPGSLMQEGLDXLLTVSNPTTICGFKCQLIG

SEQ ID NO: 6450 - protein, 129 aa, Triticum aestivum
NFTISDAEAGIETVALQNVCWLEVQGKLELSHLTPGATYEVFFEVRLDDPAYGWSMPVNLRLKFPDGTIQQHKENLEEKPRGKWLLVKVGEVKPHKGQNGEAEISMFEYDGGQWKRGLLIKGIKIIPKE

SEQ ID NO: 6451 - protein, 104 aa, Triticum aestivum
  misc_feature (9)..(9): Xaa can be any naturally occurring amino acid
  misc_feature (11)..(11): Xaa can be any naturally occurring amino acid
  misc_feature (14)..(14): Xaa can be any naturally occurring amino acid
  misc_feature (16)..(16): Xaa can be any naturally occurring amino acid
  misc_feature (23)..(25): Xaa can be any naturally occurring amino acid
  misc_feature (27)..(27): Xaa can be any naturally occurring amino acid
  misc_feature (30)..(30): Xaa can be any naturally occurring amino acid
  misc_feature (33)..(33): Xaa can be any naturally occurring amino acid
  misc_feature (37)..(37): Xaa can be any naturally occurring amino acid
  misc_feature (39)..(39): Xaa can be any naturally occurring amino acid
  misc_feature (63)..(63): Xaa can be any naturally occurring amino acid
  misc_feature (69)..(70): Xaa can be any naturally occurring amino acid
  misc_feature (88)..(88): Xaa can be any naturally occurring amino acid
  misc_feature (91)..(91): Xaa can be any naturally occurring amino acid
MAPTVMASXAXFVXPXQGLKSTXXXPXSRXSNXASLXSXSNGGRIRCMQVWPIEGIKKFETLXYLPPLXXRRPFLKHVDYLIRSKWPXCLXFIPGSFFPLPFLL

SEQ ID NO: 6452 - protein, 143 aa, Triticum aestivum
  misc_feature (57)..(57): Xaa can be any naturally occurring amino acid
  misc_feature (92)..(92): Xaa can be any naturally occurring amino acid
QPRPRAVEPSRSLPSQTLRPQISPGEKRDFAAMAAAGGTSSDDVPVIQAENLTSNVXSILYSRTFLSIISGVVAGIWGFTGLTGFVFYFLIXLVASIGLLAKSKFSVHTYFDSWSRILVEGVLAGLMSFVLFWTFAYDIVHIF

SEQ ID NO: 6453 - protein, 142 aa, Triticum aestivum
NILIENEPSRSLPPQTLRPQISPGKERAFAAMAAAGGTSSDDVPVIQAENLTSNVRSILYSRTFLSIISGVVAGIWGFTGLTGFVFYFLIMMVASIGLLAKSKFSVHTYFDSWSRILVEGVLAGLMSFVLFWTFAYDIVHIF

SEQ ID NO: 6454 - protein, 312 aa, Triticum aestivum
  misc_feature (303)..(303): Xaa can be any naturally occurring amino acid
MNTAISCVLTVLYFARHHTPMASDQGGATFRGSCSPQDNSSEAVKTNSTCKMESNSDAAQIKQGSNGSSNNNDMGSSTKSAIAKPCTDRERVMLPSLVKSNQQTSAFHPVQHQVSPAHVARKDKAAEEIANAVKVGHSSEAQQSSVQHHHHAHYYRHVMAQQQTLIDGASNARCGSSNASDSPMEGHAANYGVNVSVSGSNNGSNTQNGSSSAPNIARPNMESGTMDKIEADGGNGSGSRPSGSGNDMVCQNQLSQREAAVNKFRQKRKERNFGKKVRYQSRKRLAEQRPRVRGQFVRQSGQXDEAGQAEDR

SEQ ID NO: 6455 - protein, 173 aa, Triticum aestivum
  misc_feature (143)..(143): Xaa can be any naturally occurring amino acid
  misc_feature (154)..(154): Xaa can be any naturally occurring amino acid
MAPHTTEADAAAGGGGDEEAAVEAGTLRHRHNAAKADDEDEIKGSVPPGEDGAEASLERAFEGKPVPTWREQLTFRAFVVSFFLAIMFSVIVMKLNLTTGIIPSLNVSAGLLGFFFVRLWTSAIERMGFLRQPFTRQENTVIXTCVVAAYDIAXSGGFGTYLFAMSGTIASQA

SEQ ID NO: 6456 - protein, 208 aa, Triticum aestivum
  misc_feature (25)..(25): Xaa can be any naturally occurring amino acid
  misc_feature (48)..(48): Xaa can be any naturally occurring amino acid
  misc_feature (91)..(91): Xaa can be any naturally occurring amino acid
MNGASAECDTKAEAGTAEYLIELEXRRSIKVFGSSTFIGLGIFFFSGXCFSLFSPAINLATNDQWHTPKDGVPHLVVYTAFFYFSISCFVXVGIGLNILFLYRPMAGVPKSSFKAYLHDWEGRQWALLAGFLCGFGNGFQFMGGQAAGYAAADAVQALPLVSTFWGILLFGEYRKSSKKTYTLLVFMLLMFIAAVATLMASAGHRSTK

SEQ ID NO: 6457 - protein, 354 aa, Triticum aestivum
PRVRISPRVQKFGKALIVPSDGEVSKSETNIVEYTKEYKDTAEASKSSWKNSSVSLSTVDDRKSISISSRPSYINHKVQDSRESDTESLMELTSREVCISLLERDIVLIEKSELSSTSTTLTHDDNESNTLFACKSCGSFEDPCRMLICDRCEEAFHLLCCHRRIKKIPDNDWYCLDCSRKKPKRQREMLPSTKGSAKHIQRPLQVLGSKGDMLTNAEPYETQVRIGRDFQAEVPEWSGPISGSDDYFVEPAELDATEMTNLSLSLRREDKKTSIGNWIQCQEVLDTGAICGKWRRAPLFVVQSSDWDCSCSVLWDPIHADCAVPQELGTAEVLQQLKYINKLKLRLDSYKQKR

SEQ ID NO: 6458 - protein, 288 aa, Triticum aestivum
  misc_feature (116)..(116): Xaa can be any naturally occurring amino acid
  misc_feature (130)..(130): Xaa can be any naturally occurring amino acid
EGEGARRCRGTEAFSAAAGGAGERKRIGEAMDRSSPSTSWGFSAGRERGPDRRRQAAGGAPLRRRIHRHVQWSKLSDGESDTDSEESDLSGSDGEDTSWISWFCSLGAYEFYCDGXDSIKCKTSFNLCGXLSGQVPYYEYALGSVYWMSESSHGDMFTEEQNELIESAAEMLYGLIHVRYILTSKGLAAMLDKYKNYDFGRCPRVHCSGQPCLPVGQSDIPRSSNVKIYCPKCEDLYYPRSKYQSNIDGAYFGTTFPHLFLMTYPHLKPQKPSQQYVPKVFGFKLHKP

SEQ ID NO: 6459 - protein, 367 aa, Triticum aestivum
  misc_feature (26)..(26): Xaa can be any naturally occurring amino acid
MAPTAAEQHTRKAVGLAARDASGHLXSPLAITRRSTGDDDVVIKILYCGICHSDLHSIKNEWKNARYPMIPGHEIAGEVTEVGKNVTKFKAGDRVGVGCMVNSCQSCESCNKGFENHCPGIIPTYNTVDRDGTITYGGYSSMVVVHERFVVRFPDAMPLDKGAPLLCAGITVYSPMKYHGLNAPGMHLGVLGLGGLGHVAVKFGKAFGMKVTVISSSPGKKQEALERLGADAFVVSKNADEMKAAMSTMDGIINTVSANIPMAPLLGLLKPNGKMIMVGLPEKPMEISPFALVAMNKTLAGSCIGGMKDTQEMLDLAAKHDVTADIEVIGAEYVNTAMERLAKADVRYRFVIDIGNTLDKAAATASE

SEQ ID NO: 6460 - protein, 551 aa, Triticum aestivum
MAMPLALVLAALLLSAAAPALAQTPSSPDGWQLRPDRLQCFMHISSSLSWDGSEALCHNFSGHLAALSSVQELNFARSLCGAASSGCWVGGRRHNTTGSVGGWKWSDNSSSWNETAFPGEPLHPNCTGFPGGPLRPNCTGALVGLATGEHMCTKCAESHGLICMMNHEDRCYHDHCHKEYFIVLIVVSGLILSTTLAVVVWLLVYKRSKKRKRSREASGASATALVPPLWKVFNSEELRSITKNFSEGNRLPGNAKTGGTYSGTLPDGSKLAIKRLKRSSLQRKKDFYSEISRVAKLYHPNLVAVKGCCYDHGDRFIVYEFVANGPLDVWLHQIPRGGRSLDWATRMRVATTLAQGIAFLHDKVKPQVVHRDIRASNVLLDEEFGSHLMGVGLSKFVPWEVMHERTVKAATYGYLAPEFIYRNELTTKSDVYSFGVLLLEIISGRRPAQSVESAGWQTIFEWATPLVQSHRHLELLDPLINDMPEIGVIQKVVDLVYACTQHVPSVRPRMSHVVHQLQQLELKSAASEQLRSGTSTSATSPMLPLEVRTPR

SEQ ID NO: 6461 - protein, 147 aa, Triticum aestivum
MAETVFAPCLEGMKHVRSDSGVMLAKPFLDVCKQILPVLDKFGAAMAIVKSDIGGNITRLENKYSSDPSKYEHLYTMVQEEVEKKTAKGSSSCTNGLLWLTIALFRNLEHPDHEHDHPDWTMSQACTDSYTKTLKKWQVKARQCNDS

SEQ ID NO: 6462 - protein, 181 aa, Triticum aestivum
  misc_feature (28)..(28): Xaa can be any naturally occurring amino acid
  misc_feature (68)..(68): Xaa can be any naturally occurring amino acid
  misc_feature (106)..(106): Xaa can be any naturally occurring amino acid
  misc_feature (171)..(171): Xaa can be any naturally occurring amino acid
YSPWAPTVMASSATSVAPFQGLKSTAGXPVSRRSNGASLGSVSNGGRIRCMQVWPIEGIKKFETLSYXCPPLSTEALLKQVDYLIRSKWVPCLEFSKVGFIFREHXRHPPGYYDGRYWTMWKLPMFGCTDATQVINEVEEVKKEYPDAYVRIIGFDNMRQVQCVSFIAFKXPPGCEESGKA

SEQ ID NO: 6463 - protein, 115 aa, Triticum aestivum
QGLKSTACLPVSRRSNGASLGSVSNGGRIRCMHVWPIEGIKKYETLSYLPPVSTEALLKAVDYLIRSKWEHSLEISRVGFILREHNASSGYYDGRYWTMWKLTMLGCTDATQVIN

SEQ ID NO: 6464 - protein, 146 aa, Triticum aestivum
  misc_feature (69)..(69): Xaa can be any naturally occurring amino acid
  misc_feature (94)..(94): Xaa can be any naturally occurring amino acid
  misc_feature (137)..(137): Xaa can be any naturally occurring amino acid
MAPTVMASSATSVAPFQGLKSTAGLPVSRRSNGASLGSVSNGGRIRCMQVWPIEGIKKFETLSYLPPLXTEALLKQVDYLIRSKWVPCLEFSKXGFIFREHNASPGYYHGRYWTMWKLPMFRCTHPTQVINEVEEVXKEYPDPYCH

SEQ ID NO: 6465 - protein, 182 aa, Triticum aestivum
MYLHSTAMAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRNWTMWKLPMFGCTDATQVINEVEEVKKEYPDAYVRIIGFDNMRQVQCVSFIAFKPPGCEEFGKA

SEQ ID NO: 6466 - protein, 214 aa, Triticum aestivum
  misc_feature (8)..(10): Xaa can be any naturally occurring amino acid
  misc_feature (14)..(14): Xaa can be any naturally occurring amino acid
  misc_feature (21)..(21): Xaa can be any naturally occurring amino acid
  misc_feature (24)..(24): Xaa can be any naturally occurring amino acid
  misc_feature (36)..(37): Xaa can be any naturally occurring amino acid
  misc_feature (39)..(39): Xaa can be any naturally occurring amino acid
  misc_feature (42)..(42): Xaa can be any naturally occurring amino acid
  misc_feature (52)..(53): Xaa can be any naturally occurring amino acid
  misc_feature (66)..(66): Xaa can be any naturally occurring amino acid
  misc_feature (68)..(68): Xaa can be any naturally occurring amino acid
  misc_feature (77)..(77): Xaa can be any naturally occurring amino acid
  misc_feature (82)..(83): Xaa can be any naturally occurring amino acid
  misc_feature (91)..(91): Xaa can be any naturally occurring amino acid
  misc_feature (122)..(122): Xaa can be any naturally occurring amino acid
  misc_feature (135)..(136): Xaa can be any naturally occurring amino acid
  misc_feature (140)..(140): Xaa can be any naturally occurring amino acid
  misc_feature (157)..(158): Xaa can be any naturally occurring amino acid
  misc_feature (163)..(163): Xaa can be any naturally occurring amino acid
  misc_feature (167)..(167): Xaa can be any naturally occurring amino acid
MAPTVMAXXXTSVXPFQGLKXTAXLPVSRRSNGASXXSXSNXGRIRCMQVWXXEGIKKFETLSYLXPXNTEALLKQXDYLIXXKWVPCLEXSKVGFIFREHNASPGYYYGRYWTMWKLPMFXCTDATQVINEVEXXKKEXPDAYVRIIGFDNMRQVXXVSLIXFKPXGCEERGLKQNSPGQHIKVFAGFFDFWGCFLSHLFLVPKKNIGKGPFG

SEQ ID NO: 6467 - protein, 364 aa, Triticum aestivum
  misc_feature (120)..(120): Xaa can be any naturally occurring amino acid
  misc_feature (260)..(260): Xaa can be any naturally occurring amino acid
MGPATQQRHRTRAGRPAARRPRAAADDDGGVRCEACGSGRHADELLLCDGCDRGLHIFCLRPILPRVPAGDWFCPSCAAATTTTAHSAKSAAVVQTKMPKQFPLIQTKIVDFFKIQRRPXSRPPSRRRGGRGSGRPASALVVSKKKSRKLLPFTPSEDPVRRLTQMASLATALTATGAVFSNDLTYVPGMAPRSANQSALEAGGMQVLPREDAETLSLCKRMMEQGEWPPLLVVFDPVEGFTVEADRHIKDLTIITEYVXGDVDYLRNREHDDGDSIMTLLSAAPPSKSLVICPDKRSNIARYINGINNHTPEGRKKQNLKCVRFAIDGECHCLLVANRDISKGERLYYDYNGDEHEYPTHHFV

SEQ ID NO: 6468 - protein, 228 aa, Triticum aestivum
MSLTTDPDPSDGCPAFIPLEANPELMTTLIHKLGVSDALEIHDVYSLTEPEMLAFIPRPALALLLVFPISAVYESQRMAEDSLVDEYKGKGDTEPVLWWPQTIRNACGLMGLLHAVTNGNARNFIEEGSTLDKVIKKSMPLDARGRAKVLESTPELATAHKEAATQGDTPAPAAEDNVELHYVCFAKGTDNGLWELDGRRKGPIRRGDLDDNEDVLSSKGLALGALKF

SEQ ID NO: 6469 - protein, 310 aa, Triticum aestivum
  misc_feature (303)..(303): Xaa can be any naturally occurring amino acid
VFANCLAGAGGDLRVSMDVSSAMYNVDPATGQRAYLSVGSSALPSIYFLFCVVYAALAAGWVSILLRKRTAVFRIHYFMLAVLVLKGFNLLAEAEDKSYIERTGTAHGWDVLFYIFSFLKGISLFTLIVLIGTGWSFLKPYLADREKKVLMVVIPLQVVANIAQVVIDESGPYARDWVTWRQIFLLVDVVCCCAILFPIVWSIKNLREAARSDGKAAVNLMKLTLFRQYYVVVICYIYFTRVVVYALVTITSYRYLWTSVVAGEIATLAFYVFTGYRFRPEVHNPYFAIDDDEEEAAAEALKXLDDEFEL

SEQ ID NO: 6470 - protein, 431 aa, Triticum aestivum
  misc_feature (188)..(188): Xaa can be any naturally occurring amino acid
  misc_feature (370)..(370): Xaa can be any naturally occurring amino acid
  misc_feature (390)..(390): Xaa can be any naturally occurring amino acid
MKLTIKRVPTVVSNYQEDAGERPRGGCGRNCLGHCCLPVSELPVYAFKANPTKLPLQEDAVPTDFFINLLLGQWEDRMTQGLFRYDVTACETKVIPGNLGFVAQLNEGRHLKKRPTEFRVDRVLQPFDSAKFNFTKVGQEEVLFQFENSGSDDSYFLRSAAVTVADRAPNVVAINVSPIEYGHVLLIXPRVLDHLPQRIDQESFLLALHMAAEAASPYFRLGYNSLGAFATINHLHFQAYYLTVPFPVEKAATQRIPLAEGGIKSGVKVSKLMNYPVRGLVFEEGNTLNDLANLVSSACIWLQDNNVPYNVLISDSGRKIFLFPQCYAEKQALGEVSQELLDTQVNPAVWEISGHIVLKRRDDYEEASEXRAWRLLAEVSLSEARFEEVXAYIFDAACLVQSQVEEETDDAIYAPVLVGPSAVGEGCLVIP

SEQ ID NO: 6471 - protein, 283 aa, Triticum aestivum
MIRSATDGMASAPAAPGHRLRHHCRSAVLKQTPHLAVQPDRDWHINIAGRSVDGHCACCSPKGSPAIGDAATCLLADPTAIAAQVNHALGAEGIISMQCKEVVSQYGEIILELLIAQTHPQKVCSQIGLCLFDGTHSVSNGIESVVGKENVGSDVMCTACEMAVVWIENQLRENKTKELILQYANQLCERLPSPNGESTVSCHEMSKMPNLAFTIANKTFVLTPEQYVVKLEQSGQTVCISGFMAFDIPPPRGPLWILGDVFMGAYHTVFDFGKDRIGFAESA

SEQ ID NO: 6472 - protein, 216 aa, Triticum aestivum
  misc_feature (192)..(192): Xaa can be any naturally occurring amino acid
  misc_feature (209)..(209): Xaa can be any naturally occurring amino acid
MGQRLLLLVTTCLWALSCAVPHDASSPDGLLRINLNKKSLTYESLAAAKAARQQGALRLKSSDSDSDIVPLVDYLNTQYYGVIGLGTPPQNFTVIFDTGSSNLWVPSSKCYFSIACYLHPKYKSSKSSTYKADGEICKITYGSGAISGFFSNDNVLVGDLVVKNQKFIETTRETSVSFIVGKFDGILGLVPXISVGKASSWLTCKTKLXADDYPFG

SEQ ID NO: 6473 - protein, 499 aa, Triticum aestivum
  misc_feature (327)..(327): Xaa can be any naturally occurring amino acid
  misc_feature (482)..(482): Xaa can be any naturally occurring amino acid
MGQRLLLLVTTCLWALSCAVPHHASSRDGLLRINLNKKSLTHESLAAAKAARQHDALRLKSGNSDSDIVPLVDYLNTQYYGVIGLGTPPQNFTVIFDTGSSNLWVPSAKCYFSIACYLHPKYKSSKSSTYKADGETCKITYGSGAISGFFSNDNVLVGDLVVKNQKFIETTRETSFSFIVGKFDGILGLGYPDISVGKAPPVWLSMQDQKLLADDVFSFWLNRDSDALSGGELVFGGMDPDHYKGNHTYVPVSRKGYWQFNMGDLLIDGHSTGFCAKGCAAIVDSGTSLLAGPTAIVAQVNHAIGAEGIISTECKEVVSQYGEMILXLLIAQTQPQKVCSQIGLCLFDGTHSVSNGIESVVGKENVGSDVMCTACEMAVVWIENQLRENKTKELILQYANQLCERLPSPNGESTVSCHEMSKMPNLAFTIASKTFVLTPEQYVVKLEQSGQTVCISGFMAFDIPPPRGPLWILGDVFMGAYXHTVFDFGKDRIGFAESA

SEQ ID NO: 6474 - protein, 334 aa, Triticum aestivum
  misc_feature (301)..(301): Xaa can be any naturally occurring amino acid
MYKRLLSGMEFRRIRPEIIAGSLAYYARKYIPGLSRRNSMGTMPLAGTLSDVEQRNLLEEIDRLLPVQKGLVPTKLLLGLLKTSMILKASSTCIANLEKRVGMQLDQASLEDLLLPNYSYTMETLYNVECVHRILEHFLAMDQANGGCSPCIDDMMASPSMIPITAVAKLLDGYLAEVAPDVNLKPPKFQALASALPEYARPLDDGLYRAIDVYLKAHSWLSEAEREQLCRLMDCQKLSLEACTHAAQNERLPLRVVVQVLFFEQLQLRTSIAGCLLVSDNLEGSSRPLRSGCVAMSGEAXGWSAAVRENQVLKVGMDNMRMRLAELEKECSDM

SEQ ID NO: 6475 - protein, 175 aa, Triticum aestivum
MAPAVMASSATTVAPFQGLKSTAGLPVSRRSGSASLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 6476 - protein, 176 aa, Triticum aestivum
  misc_feature (100)..(100): Xaa can be any naturally occurring amino acid
MAPAVMASSATTVAPFQGLKSTAGLPISRRSGSAGLSSVSNGGRIRCMQVWPIEGIKKFETLSYLPPLSTEALLKQVDYLIRSKWVPCLEFSKVGFVFRXEHNSSPGYYDGRYWTMWKLPMFGCTDATQVLNEVEEVKKEYPDAYVRVIGFDNMRQVQCVSFIAFRPPGCEESGKA

SEQ ID NO: 6477 - protein, 249 aa, Triticum aestivum
  misc_feature (90)..(90): Xaa can be any naturally occurring amino acid
  misc_feature (218)..(218): Xaa can be any naturally occurring amino acid
LHEMADSAESAQLVSARKSNPVDHASKPGIGGLNAILRLLSPNLIRSTLLLWTVFLGLAFLYYGLVLLTSELSHGNRICGSEGAVTVVYXHSTDVNLYRNVFITSFGEVPGLILSAAIVDKFGRKLSMSSMLYVSCLCIAPLMFAQTESLTTVFLFGARICISASFIVLHIYAPEIYPTAVRATGVGFASSIARFGGILCPLVAVGLVHACHQTAAIXVFITVMLVSAVAVSYFPLETSGRKLSDHIAA

SEQ ID NO: 6478 - protein, 160 aa, Triticum aestivum
MEHQGQHGHVTSRVDEYGNPVGTGAGHGQMGTAGMGTHGTAGTGGGQFQPMREEHKTGGVLQRSGSSSSSSSEDDGMGGRRKKGIKEKIKEKLPGGNKGEQQHAMGGTGTGTGTGGAYGQQGHGTGMTTGTTGAHGTTTTDTGEKKGIMDKIKEKLPGQH

SEQ ID NO: 6479 - protein, 155 aa, Triticum aestivum
SDEGTLSDLGGGKGTAGSDENSEDDDEWAPPPEYFTGGETSGMVVRDRSKRKNNTDEVFKQAKRKGAKQGPFEARRRSSSRNFTGTGRLLTGETVERDAPQPPEEIVHNIYFWRNGFTVNDGPLRSFDDPANASFLKSIKDSVCPTELDPADGKS

SEQ ID NO: 6480 - protein, 175 aa, Triticum aestivum
  misc_feature (42)..(42): Xaa can be any naturally occurring amino acid
MAPAVMASSATTVAPFQGLKSTASLPVSRRSSGSLGRVSNGXGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 6481 - protein, 54 aa, Triticum aestivum
KVGEGVVAQCISGFPAMDIPPPRGPLWILGEVFMGPPPPVFDYGKLGVGFPKAA

SEQ ID NO: 6482 - protein, 198 aa, Triticum aestivum
  misc_feature (189)..(189): Xaa can be any naturally occurring amino acid
RAEFGTRLAFKVVVQIALDLARGLSYLHSKKIVHRDVKTENMLLDKTRTVKIADFGVARHEAANPSDMTGETGTLGYMAPEGVLNGNAYNRKCDVYSYGICLWEVYCCDMPYADLSFSEVTSAVVRQNLRPEIPRCCPSAFANVMKRCWDANPDKRPEMAEVVTMLEAIDTSKGGGMIPVDQARGIGCXSCLRPRRGP

SEQ ID NO: 6483 - protein, 120 aa, Triticum aestivum
DPRVRPRVRPRVRRRSAREAKKIKSVDGPTPAMSPVSLLHWAGGGGVERELESLPAQPLAQATNVHFGHRPDLKRMLLGIHDENVGVMASGPSGMLEEVATICSSGLASNLHFQSISFTW

SEQ ID NO: 6484 - protein, 328 aa, Triticum aestivum
  misc_feature (240)..(240): Xaa can be any naturally occurring amino acid
  misc_feature (258)..(258): Xaa can be any naturally occurring amino acid
MKGTAPWRRFSEAEAAVNRSVAASTVGKYFKLEARKSSFTKELRAGAATFLTMAYIISVNAAILTDSGGPCTVLDCTPVGNSTAVPGPECMLGTSNPGYEQCLARTKSDLIVATAVAAMVGSFFMGTLANLPLALAPGMGANAYFTYNMVGFHGSGSIPYRTALAGVMLEGIVFLLLSAVGLRSRLARMIPRNIRLASAVGIGLFLAFTGLQANQGLGMVGASPSTLVTLTACSPTDPVXGACLGGTLHSPTFWLGVXGFSSHVPPRDVRAHDIRIVSSRRVWIEAQRHVFPDSGRCGSLLRRCGLNDQTRRDSLRGSACRVGCMSAV

SEQ ID NO: 6485 - protein, 57 aa, Triticum aestivum
IPGVAPFALCLFFSKLVAYTFLYWLPFYISHTRIGGQDLSDAMAGSLSTIFDVGGVL

SEQ ID NO: 6486 - protein, 117 aa, Triticum aestivum
LTRTFLSKYLVFAPSIDRTSGEYLVKNGVRTFTCNETVKSGHVTFFWNGNCSGYFDETREESVDIPSDCGVTFNEQALMNALETADSTLNAMLSEKLDHVPINLTNGDIGGHTGAIE

SEQ ID NO: 6487 - protein, 176 aa, Triticum aestivum
  misc_feature (131)..(131): Xaa can be any naturally occurring amino acid
RHEALFYNPAATKMAPNDVFGVAFSGGFNQPIMCGGEPRQMTLQVRGKADPPIYTIRIRVPQHAVSLIFSFTNGAEWDGPYTLKFRVPKPWQNKPLSFFNEGLADELNREGACDRAIYPDENIAITSCAMXATSQEGGDRCKLDIVSGCMDPGSDMFDPLATVDDGSCPLESDSEE

SEQ ID NO: 6488 - protein, 302 aa, Triticum aestivum
  misc_feature (165)..(165): Xaa can be any naturally occurring amino acid
  misc_feature (186)..(186): Xaa can be any naturally occurring amino acid
  misc_feature (234)..(234): Xaa can be any naturally occurring amino acid
MYGHRGAMMGSGGVSDGYEGSKRPRMMESNPYFAVNAGSPLDVSKRARMMEPGPPYFAGMGSSAGGSGSGFYPTYGGNMAGAAGVNSGIQNFPAVRLRGLPFDCEDVDISKFFAGLDIVDCLLVHKNGRFSGEAFVVFPSSMQAEFALHRNRQNMGRRYVEVFKXKKQDYYSAIAAEVNQGGPLLXAKSTGTRRLLCGPGGCLKTKSNMEYTEVLKLRGLPYSATIEDIIKFFXEYELTEENVHIAYRGDGRATGEAFVEFPTAEVAKTAMCKDKMTIGTRYVELFPSTPEEASRAKPRGRQ

SEQ ID NO: 6489 - protein, 473 aa, Triticum aestivum
FKGLSSLLAVGEKASSDELRGKLCQHRTETSRDQDGVLDKCIKHTRQNLEKRAAPERDPTPVVTFPKTALVLSAARGAAPDVARGNVPVGLALGPVRDDSVAGQRRVLKPYPPARAAPAFLAANIPRYLDAEAVKVVLGAAEVGQELMEHRWDKVLFTGGARVGRIIMTKAAKYLTPVALELGSKCPCIVDWLDSKRDSQVAVNRIIGAKWSTCAGQACIAIDYILVEEQFAPILIELLKSTLERLITKPEDMARILNERQFNRLSGLLEDHKVSRSIVHGGDVDPKILSIEPTILLNPPLDSDVMTKEIFGPLLPIITVKKIEESIEFVSSRPKPLAIYAFTTSEAIKQSIVRETSRPKAPANDAITTSEALKQRIVRETSSGSVTFNDAIVQYGLESIPFGGVGQSGFGQYHGKYSFEMFSHKKAVFRRSFLLEFMFRYPPWNDDSKLALLRHVFRYDYVSLFLALLGLRR

SEQ ID NO: 6490 - protein, 175 aa, Triticum aestivum
MAPTVMASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 6491 - protein, 119 aa, Triticum aestivum
  misc_feature (100)..(100): Xaa can be any naturally occurring amino acid
MGVLRKKHNKKSRRPSFKSVLTSILATQAAIFLLLLAGVSLAGTAVAFIASMPLFVVFSPILVPAGVATGLLATGLAAAGSSGAMAVSLILWVIKRVTGXKEPPKIMSKVLRKVFPGGG

SEQ ID NO: 6492 - protein, 530 aa, Triticum aestivum
MQGGNHMLLEEPVRLASVLAPAKPKVFPSLTKIVGTLGPNSHSVEVIEECLTAGMSVARFDFSWKDATYHQETLDNLRKAAQNVKKLCPIMLDTVGPEIQVHNSTGGAIELIGGNHVTITPDLSKAPSADILPIKFGDLAKVVKKGDTLFIGQYLFTGSETTSLWLEVTETSGAEVICYVKNTATLSGPIFTLHVSQVHISMPTLSEYDKQVISTWGLQNSVDIISLSHTRSSEDVRELRAFLKSHDLQDTQIYAKVENAEGLEHFDEILQEADGIIISRGDLGIDLPPERVFMSQKTGTHKCNMAGKPVIITRVVDSMIDNLRPTRAEATDVANAVLDGTDGILLGAETLRGQYPVDAVRTVGRICAEAETVYNQSLHFKKVVRHVGEPMAHEESVASSAVRSAMKVKAAAIVVFTFSGRAARLIAKYRAPMPVLAVVFPREGSDPSKWRSYGTTQARQCFSVRGVYPLMGSTDEAETGGLTKEEYGIKLALNYGRSVGIIRPYDRVIIFEKIGDSSVVKIIECDDSER

SEQ ID NO: 6493 - protein, 315 aa, Triticum aestivum
  misc_feature (14)..(14): Xaa can be any naturally occurring amino acid
WKLWEDAIQKDTAXNGPKKVNNVHDFEFIREHFKGIGKDSRILSWLHSFFKQFYGSVSKTDYTTMRLGFIMTHCRGNLKFDFHKYMLRVLESDFKKVVGISWYLWVFVVIFLLLNVNGWHTYFWIAFIPLILLLAVGTKLEHVIAQLAQDVAEKHSAVEGDLIVKPSDDHFWFGRPRIVLFLIHFILFQNAFEIAFFFWILTTYGFNSCIMGQVGFIVPRLVIGLIIQLLCSYSTLPLYAIVTQMGSFYKKEIFNEHVQQGVLGWAQKAKMKKGFKKSNGAAESTSPVGSAGPSAKVEMVRRPAGQGNDAGESIE

SEQ ID NO: 6494 - protein, 429 aa, Triticum aestivum
ESIHRSVCVCSPAAMGNCFGSRIGSDSPYKSGGGSGSPSSSSGWTWRRKGKGGASVSSSRVSSSPSTTVLPTPRSEGEILQSANVKSFAFNELKTATRNFRPDSVLGEGGFGSVFKGWVDETTFAPARPGTGMVIAVKKLNQEGFQGHREWLAEVNYLGQLSHPNLVRLVGYCLEDEQRLLVYEFMPRGSLENHLFRRGSHFQPLSWNLRMKVALGAARGLAFLHSDMAKVIYRDFKTSNVLLDSSYNAKLSDFGLAKDGPTGDKSHVSTRVMGTHGYAAPEYLATGHLTAKSDVYSFGVVLLEMLSGRRALDKNRPSGEHNLVEWARPYLTSKRRVFHILDARLGGQYSLSGAQKTAALAMRCLSGDARARPGMAEVVTALEQLQDAKETAGGAGQGKASGGFVRMRGGGGGSGAGRQQQRRPEPMAV

SEQ ID NO: 6495 - protein, 221 aa, Triticum aestivum
GRGPPPGTGRCFNCGIDGHWARDCKAGDWKNKCYRCGERGHIERNCQNSPRSVRREIFYSRSPSPRRGRGRSPSYSRSRSRSRSRSYSRSRSLSGSPRGGRRDRDDRRSRSLSYSRSPMRSASPPPKEKERSPTPDGSRSPRSRSPQDQVMSPPPKDNGEGNGSDRGESPRGRETSRSRSRSRSPSGDNRSPAANGRSPSPRGDRSPSPRADRSPSPKADR

SEQ ID NO: 6496 - protein, 393 aa, Triticum aestivum
MPVISPLPFSLLPAPAAPAASRARWNSFPHHRLLRAGMCSNGFDSTNCLRMEEVEPNLSPFLHKLFKEWDDCKARGLFHHNITTCETKVLPGEHNFVATLIEGRDQKKRPTEFGMNQVLQPFHSDKFNFTKVKPEEVIFRFQETENDSAQYFDGAPPTVSASPSSILINVSPIGYCHVLLIPQIQECLPQRVDRESFLLAMYVAREAKNPFFRVGYNSLGAFATINHLHFQAYYLKVQYPVEKAPTEKLTVVGNGVSISQLVRYPVSGFAFEGGASLEDLSQVVSDACIFLQENNRPFNVLISESGKRLFLLLQCYAEKQASGKASQEFLDMRINPAVWELSGHLVLKRRKDYDEASAATLCGFLVEASLSEAEFQELKKCVLEFLASASPEK

SEQ ID NO: 6497 - protein, 121 aa, Triticum aestivum
MNARGFRSTRTALFDGIEEGGIRASAYSSHEIDEHENERAVDGLQDRVSILKRISGDINEEVEAHNRMLDRMGNDMDSLRGFLSGTVDKFKTVFETKSSRRMGTLVASFVALFMLVYYLTR

SEQ ID NO: 6498 - protein, 175 aa, Triticum aestivum
  misc_feature (72)..(72): Xaa can be any naturally occurring amino acid
MAPTVMASSATSVAPFQGLKSTAGLPVSRRSSSAGLSSVSNGGRIRCMQVWPIEGIKKFETLSYLPPLSTEXLLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 6499 - protein, 390 aa, Triticum aestivum
  misc_feature (8)..(8): Xaa can be any naturally occurring amino acid
NFTIKRGXSTEDTVSVNYDDFISDVEAGDILLVDGGMMSLAVKSKTADTVKCVVVDGGELKSRRHLNVRGKSATLPSITEKDWEDIKFGVENGVDFYAVSFVKDAKVIHELKAYLKSANADIHVIPKIESADSIPNLQSIIAASDGAMVARGDLGAELPIEEVPLLQEEIIRTCRSMQKPVIVATNMLGGLWWCATRAEVSDIAIAVREAADAIMLSGETAHGKYPLKAVKVMHTVALRTESSLYDPTKAPSLVARPKALLNDDFCKSQLSKMFGSHATMMANTLRTPIIVFTRVGSMAVLLSHYRPSSTIYAFTNEVRVKQRLALYQGVVPILMEFSDDAEETFSRAITSLLDAKYMNEGDYVTLVQSGSQSIWREESTHHIQVRKVQC

SEQ ID NO: 6500 - protein, 229 aa, Triticum aestivum
  misc_feature (76)..(76): Xaa can be any naturally occurring amino acid
  misc_feature (109)..(109): Xaa can be any naturally occurring amino acid
  misc_feature (175)..(175): Xaa can be any naturally occurring amino acid
KRTPPLPHLWWFLWLPPWLLRRWVTNLHHCTSWPICTSINEVAAEAVRRRARLNLEDTKGRIPIDLLSCPVSQANXNGYSPNSVATEVFSWGSGSNYQLGTGNAHILDXLHDCLSLNIRMSKTTNIVMALQSGQTTAVITPRLVTVGLGRKKVNVVAAAKHHTVIATSAGELFTXGSNREGQLGYPSVDTQPTPRRVSSLKQRIIAVAAANKHSAAVADTGEVFTWGSN

SEQ ID NO: 6501 - protein, 204 aa, Triticum aestivum
  misc_feature (150)..(150): Xaa can be any naturally occurring amino acid
WCIPHLGDTKGRTPIDLLSGPVSQANGDSPNSVATEVFSWGSGTNYQLGTGNAHIQKLPCKVDALHGSYIKTVAASKFHSVAVSSDGELYTWGFGRGGRLGHPDIQSGQTTAVITPRLVTVGLGRKKVNVVAAAKHHTVIATSAGELFTXGSNREGQLGYPSVDTQPTPRRVSSLKQRIIAVAAANKHSAAVADTGEVFTWGSN

SEQ ID NO: 6502 - protein, 440 aa, Triticum aestivum
MTMMAMPEAPCLCARPSLAARARRPGSGPAPRLRRWRPNATAGKGVGEVCAAVVEAATKVEDEGEEDEPVAEDRYALGGACRVLAGMPAPLGATALAGGVNFAVYSGGATAAALCLFTPEDLKADRVTEEVPLDPLMNRTGNVWHVFIEGELHNMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAP

SEQ ID NO: 6503 - protein, 790 aa, Triticum aestivum
MTMMAMAKAPCLCARPSLAARTRRPGPGPAPRLRRWRPNATAGKGVGEVCAAVVEVATKAEDEGEEDEPVAEDRYALGGACRVLAGMPTPLGATALAGGVNFAVYSGGATAAALCLFTPEDLKADRVTEEVPLDPLMNRTGNVWHVFIEGELQDMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLVAEAWDAGGLYQVGQFPHWNVWSEWNGKYRDIVRQFIKGTDGFAGGFAECLCGSPHLYQAGGRKPWHSINFVCAHDGFTLADLVTYNNKYNLPNGENNRDGENHNLSWNCGEEGEFARLSVKRLRKRQMRNFFVCLMVSQGVPMFYMGDEYGHTKGGNNNTYCHDSYVNYFRWDKKEQYSDLHRFCCLMTKFRKECEGLGLEDFPTAERLQWHGHQPGKPDWSENSRFVAFSMKDERQGEIYVAFNTSHLPAVVELPERTGRRWEPVVDTGKPAPYDFLTDDLPDRALTIHQFSHFLNSNLYPMLSYSSVILVLRPDV

SEQ ID NO: 6504 - protein, 228 aa, Triticum aestivum
  misc_feature (151)..(151): Xaa can be any naturally occurring amino acid
  misc_feature (179)..(179): Xaa can be any naturally occurring amino acid
  misc_feature (184)..(184): Xaa can be any naturally occurring amino acid
  misc_feature (194)..(194): Xaa can be any naturally occurring amino acid
  misc_feature (210)..(210): Xaa can be any naturally occurring amino acid
MAQVVAAAGAAGAARPLGGASGADSLRPVARLPFGPRDARERWSGSVASSGRREHPVASVISADAEVMPVSADDDAVVKEEENFQHLKAVQQLATAANGVWSKPNVRRKTKIVCTIGPSTNTREMIWNLAEAGMNVARLNMSHGDHASHQXKVRDLVKEYNAQTKDNVIALMDDTKGPXEVRSXGDLPQPIFLXETGQGISPFTIKRRGXGTETCGLVLPMDELLLMM

SEQ ID NO: 6505 - protein, 352 aa, Triticum aestivum
  misc_feature (192)..(192): Xaa can be any naturally occurring amino acid
  misc_feature (306)..(306): Xaa can be any naturally occurring amino acid
MAASKQWTRVRTLGRGASGAEVFLAADDASGELFAVKSATAACASALKREEGLMACLHSPCVVSCLGGRSARDGSYHLFLEFAPGGSLADRVASNGGLDERAVRGYAADVAAGLAYLHGAGMVHGDVKARNVVIGADGRAKLADFGCSRKAGADVPIIGGTPAFMAPEVARGEEQGPAADVWALGCTVVEMXTGRAPWSGMDGHALAALHRIGYTEAVPELPQWLSAEARDFLGGCLVRQASDRCTAAQLLEHPFLASAGGHAKPKATESSWCRPRHPEGGFWESESKPGRGSTKPGPKRNKALAXPASGLPEVDPKGGWMGLLSGPTGAPKQGPVRPRSHRIYAGEVFKGK

SEQ ID NO: 6506 - protein, 201 aa, Triticum aestivum
MLPAAMAAGLAWSRPRSATPLPPPELVRVFSFFGGEISRGGTMLVYQDKLSGDELLSDSFPYRELENGVLWEVDGHWVVQGAVDVDIGANPSAEGGGDDEGVDDQAVKVVDIVDTFRLQFISHMKRYIKNLSAKLEGDDLDAFKKNVESATKYLLSKLKDLQFFVGESMHDDGGVVFAYYKEGAADPTFLYFAHGLKEVKC

SEQ ID NO: 6507 - protein, 200 aa, Triticum aestivum
  misc_feature (106)..(106): Xaa can be any naturally occurring amino acid
MVSEAANAGIDRVLWTEAEIATRVAEVASELAADISRLAEPAVVVGVATGAFLFLADLVRRVDAPLTVDLVRVESYGDGTESSGRPRVTADLKVDPSPPPPETKPXVVVEDIVDTGNTVSCLIAHLQKKGALSISVCTFLDKPARRTVDFQLVGGGKFYRGFECPDSFVVGYGMDYAELYRNLPYVGVLKPEMYSKKTDN

SEQ ID NO: 6508 - protein, 386 aa, Triticum aestivum
  misc_feature (368)..(368): Xaa can be any naturally occurring amino acid
MAKPISIEVWNPSGKYRVVSTKSMPGTRWIKLLTDNDCRLEICTEKKTILSVDDILALIGDHCHGVIGQLTEDWGEVLFSALKRAGGTAFSNMAVGYNNVDVDAANRNGIAIGNTPGVLTETTAELAASLSVAAARRIVEADQFMRAGLYDGWLPHLFVGNLLKGQTVGVIGAGRIGSAYARMMIEGFKMNLIYFDLYQSTRLEKFVTAYGQFLKANGEQPVTWKRASSMEEVLREADVISLHPVLDKTTYHLINPERLAMMKKEAVLVNASRGPVIDEVALVEHLRANPMFRVGLDVFEDEPYMKPGLAEMKNAVVVPHIASASKWTREGMATLAALNVLGKIKGYPVWGNPNAVEPFLDEKAAPPXACPSIVNAKQLGLPSSKL

SEQ ID NO: 6509 - protein, 187 aa, Triticum aestivum
MGSCVSRSPASSAVAGSGRSVATKTAKVVDVDGSMAQFAAPVTAREALDSVQERRPGASVFLCSSDELRFDVPARALAADEALQPGWLYFVLPMSTLRRSLSGPEMAALAARASSALAVASGVASPPRRKNGAGVPGANGKRRKAAARVSPLVVADEIAGSDGGSDHHHVYGKYGGDEPAAKAWKRE

SEQ ID NO: 6510 - protein, 233 aa, Triticum aestivum
MGSCISRSPASSAAAGSGRAVATKTAKVVDVDGSMAQFAAPVTAREALDSVQERRPGASVFLCSSDELRFDVPARALAGDEALQPGWLYFVLPMSTLRRSLSGPEMAALAARASSALAVASGVASPPRRKNGVGAPGANSKRRKAAARVAPLVVADEIAGPDGGSDHHHMYGKYAGDEPAAKAWKRSSWGWKPQQHSPSSPCIWHPNAELLFGGAMTSEHPRIDFSGSILRSG

SEQ ID NO: 6511 - protein, 131 aa, Triticum aestivum
  misc_feature (4)..(4): Xaa can be any naturally occurring amino acid
GRGXGYPLTDWCLVPYTHQNLTWTQHAFNEKVADLRGVAVDAFSRLKSRWACLQKRTEVKLQDLPVVLGACCVLHNICEARGEAMPPELRVEVEDDLAVLDNPVRSDAAAKARDKIAHNLLHRGLAGTAFF

SEQ ID NO: 6512 - protein, 128 aa, Triticum aestivum
MQYYETREKEYYDVAQGQSRQSYGQNHQGYGQSQSRPVYGNSPTLNYRSHGGFLDGLFKGKNGQKGQNGLGSFLGQHKNQDTNQGHGHGKLLGQHQKKTHETNKGVNGLGMFINNGEKKHKKQNEHKK

SEQ ID NO: 6513 - protein, 243 aa, Triticum aestivum
MLVLFETPAGFALFKVLDEGKLSSVEDLWKDFASSDKARKVVELKAFNKFENTSDALSAATLLIDSKPSKGLRKFLQKHCDGETLAVADSKLGNAIKEKLQIDCLHNSAVMELMRGLRNQLTELMSGLAEHDLGPMSLGLSHSLSRYKLKFSPEKVDTMIIQAIGLLDDLDKELNTYAMRVREWYGWHFPELTKIVADNIHYAKAVKMMGNRVNAVNLDFSEILPEDVEAELKEAAVISMGTE

SEQ ID NO: 6514 - protein, 172 aa, Triticum aestivum
GYVERLGHGGFESSWRKDAMDWICKVHSYYNFGPLTLCLSVNYMDRFLSSFDLPHDKSWMQQLMSVACLSLAVKMEETVAPLPVDLQVCDEYYAFEPRNIKRMELIVMETLKWRMHSVTPFSFLCYFLDKFNEGKPPSYMLVSRCAELIVATVKDYRFLSFRPSEIAAAVVL

SEQ ID NO: 6515 - protein, 339 aa, Triticum aestivum
MECEPEELQFLGPVGIYRESVAILRAHRPLYARIAAAFVLPLSALFLAHIAISHALFSTIDSDDSALESSAPGTASQQRILQRLGADWAALVLFKAAYLLALLLFSLLSTAAAVFSVASVYSAKHDALTFPRVLSVVPRVWRRLAATFLSAFALLFAYHFVFAVVFIALLVAVDNGSTLAGLLAFVVIVAYLVGLVYLSVVWHLASVVSVLEDYKGFQAMRKSKALIQGKLWTVVIIFVTLNIVFVVVEFAFRAWIVQGARHGLGAGGRLLLGLVILAALCSVVMVALVVQTVVYLVCKSYHHESIDKSNISDHLEVYLGDYVPLKASDVQMQHFGDEV

SEQ ID NO: 6516 - protein, 107 aa, Triticum aestivum
MAGGEARGGECGYYTTDDALSQVGFGRFQALVLAYAGVGWTAEAMEIMMLSFVGPSVKDEWGISGQQEGLITSVVFAGMIIGGCLGGVISDSYGRRSGALWLLSLDK

SEQ ID NO: 6517 - protein, 262 aa, Triticum aestivum
  misc_feature (226)..(226): Xaa can be any naturally occurring amino acid
SVVAVITIPRMFPELKWYYAVVAYLLAPALGFSNAYGSGLTDINMAFNYGKVALLILAAAAGKEHGVVAGMVGCGMVKCMTSISADLMQDFKTGHLTLTSPRSMLIAQIIGTAIGCVISPLTFYVFYNAFDIGNQDSPWKAPYALIYRNIAILGVEGFSALPMHCLQLCCGFFAFALVANLMRDFLPQKYGKWVPLPMAMGFPFLVGASFAIDMCAGSLIVYIWAXIDRSKAAHMVQQLPPVKCGDGLGSPTSCLRWQVPTM

SEQ ID NO: 6518 - protein, 269 aa, Triticum aestivum
MYDNYRNPHPPGMQMPPPNPQPGPYDNPLYGASSGLIKTGLGVYGEKFFGSSSEFMQSNISRYFSNPQYYFHVNDQYVRNKLKVILFPFLHRGHWTRISEPVGGRLSYKPPMYDINAPDLYIPFMAFGTFIILAGFTLGFMGKFTPEAINLQFTRGLIGWGLQIVFLKGLLYSMGGGEVPLLDLVAYSGYLFAGLSLAIVARLLWAYSYYVMMPWMSLCMGIFLVRTMKRVIFTEMRGSERHSTRQHYFLLFMAIVQFPLFFWLGSIGA

SEQ ID NO: 6519 - protein, 337 aa, Triticum aestivum
MAPLGDAVAPAAATAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAATRAAKSAGILCSYDPNVRLPLWPSAQAARDGIMSIWKEADFIKVSDEEVAFLTQGDATDEKNVLSLWFEGLKLLIVTDGEKGCRYFTKDFKGSVPGYSVNTVDTTGAGDAFVGSLLVRVSKDDSIFYNEAKLREVLQFSNACGAICTTKKGAIPALPTTATALELISKGSN

SEQ ID NO: 6520 - protein, 336 aa, Triticum aestivum
MAPLGDAVAPASAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAAMRAAKSAGILCSYDPNVRLPLWPSAQAARDGIMSIWKEADFIKVSDDEVAFLTQGDATDEKNVLSLWFEGLKLLIVTDGEKGCRYFTKDFKGSVPGYSVNTVDTTGAGDAFVGSLLVSVSKDDSIFYNEAKLREVLQFSNACGAICTTKKGAIPALPTTATALELISKGSN

SEQ ID NO: 6521 - protein, 221 aa, Triticum aestivum
SIFWGVFASFNAVFAFPQERPVLARERASGMYSLSSYFMARMAGDLPMELALPAAFTVIVYLMAGLNPAPAAFALTLVVILSYVLVAEGLGLAIGALMMDAKRASTLATVIMLAYLLTGGFYVHNVPIFMIWAKYSSFTYYCYRLLIAVQYSGHLAQLLPLESTHGEAGTWTCVAASSPCSSPTAARVLRPAPGQGRDHTHTHLSLSRGASVINNSGKARY

SEQ ID NO: 6522 - protein, 337 aa, Triticum aestivum
  misc_feature (282)..(282): Xaa can be any naturally occurring amino acid
  misc_feature (299)..(299): Xaa can be any naturally occurring amino acid
MANIDMAAVLADLERDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLAVLSCDPAAGTVRCRCENTAMLGERKNCNLPGIVVDLPTLTEKDKEDILEWGVPNDIDMIALSFVRKGSDLVTVRQLLGQHAKRIKLMSKVENQEGIVNFDDILRETDAFMVARGDLGMEIPVEKIFXAPKMMINKCTLPGKPVXTATKMLDSMIKSPRPPGAEATDVQNAGVEWTQWVMPQG

SEQ ID NO: 6523 - protein, 89 aa, Triticum aestivum
  misc_feature (23)..(23): Xaa can be any naturally occurring amino acid
GNSHRTLMPALIMRLWYAPHIAXPGRVLLKGATLVAIRPSDDVLREGGGVEAAGPAGASWISDAFEEPYRTAAKVLFKRRTYSLEMNSF

SEQ ID NO: 6524 - protein, 382 aa, Triticum aestivum
MAGEDGETATVAAAAIPLLTPYRTGGGELDLAHRVVLAPLTRQRSPGNLPQPHAAVYYAQRATAGGMLITEATGVSAAAQGHRPTPGVWAGEQVDAWRPVVDAVHAKGAVVFCQLWHVGRVVGKLRPDGARAETPQPVSSTGRPIATPRMNDGVEEEFATPRRLDVAGIAGVVDDFRRAARNAVDAGFDGVEIHGAHGYLVEQFLKDSANDRDDEYGGSLENRCRFALEVVTAVAEEIGGRRLGVRLSPFADYMDCHDSDPHALALHMATKLKGIPEGILYLHMMEPRMARADGRRVVPKRLRPYRDAFGGAFIAAGGYDREEGNKVVREGYTDLVAFGRLFLANPDLPKRFELDAELNGYDRATFYTSDPVVGYTDYPFLG

SEQ ID NO: 6525 - protein, 70 aa, Triticum aestivum
  misc_feature (54)..(54): Xaa can be any naturally occurring amino acid
  misc_feature (57)..(57): Xaa can be any naturally occurring amino acid
MALTVMASRATSVSPLQGLKSTVGLPVRRRSNGSSLCSVSNCGRIRCMRAWPTXGHXKLETLSYLSPIRT

SEQ ID NO: 6526 - protein, 153 aa, Triticum aestivum
  misc_feature (114)..(114): Xaa can be any naturally occurring amino acid
  misc_feature (135)..(135): Xaa can be any naturally occurring amino acid
MTSPIIPRTDDGGQGAATRVGRLNAAVERSWVGRRFRLAARGTTFTTELRAGTTTFLTMAYILAVNASILSDSGATCSVDDCANPSPACKFPPVDPGYAACLSRARRDLIVATXASSVIGSFIMGAFANLPIALXPGMGTNAYFAYTVVGFHG

SEQ ID NO: 6527 - protein, 145 aa, Triticum aestivum
  misc_feature (76)..(76): Xaa can be any naturally occurring amino acid
LVSRTLSPRPPYLQAGRARSRSVRPRVLRRRRRPPAPEEMPRYDDRYGNARLYVGRLSSRTRSRDLEYLFSKYGRXSVFNTIRKVCGGRVPLVELVAIVPKFVEDFGEGCPWCLVIREVELKRDYAFIEYSDPRDADEARYNLDG

SEQ ID NO: 6528 - protein, 373 aa, Triticum aestivum
  misc_feature (75)..(75): Xaa can be any naturally occurring amino acid
  misc_feature (123)..(123): Xaa can be any naturally occurring amino acid
WFPELSSRPPYLQAGRDRSRSVHSVRPRVLRRRPPAPEDMPRYDDRYGNARLYVGRLSSRTRSRDLEYLFSKYGXRIREVELKRDYAFIEYSDPRDADEARYNLDGRDVDGSRIIVEFAKGVXPRGSGGSREREYVGRGPPPGTGRCFNCGIDGHWARDCKAGDWKNKCYRCGERGHIERNCQNSPRSLRRERSYSRSPSPRRGRARSRSYSRSRSYSRSRSRSYSESPRGRRTERDERRSRSISYSRSPRRSLSPEAKEMDRSPTPDRSRSPRRSISPVAKDNGDSPRGRDKSRSPSDGYRSPVANGRSPSPANNGNPSPTRDNRGSPSPRGNNGSPSPKGNGDGGSPSPRGNGDDDGRRGSGSPRGRSVTP

SEQ ID NO: 6529 - protein, 373 aa, Triticum aestivum
LLVSRTLSPRPPYLQAGRARSRSVRPRVLRRRRRPPAPEEMPRYDDRYGNARLYVGRLSSRTRSRDLEYLFSKYGRIREVELKRDYAFIEYSDPRDADEARYNLDGRDVDGSRIIVEFAKGVPRGSGGSREREYVGRGPPPGTGRCFNCGIDGHWARDCKAGDWKNKCYRCGERGHIERNCQNSPRSLRRERSYSRSPSPRRGRARSRSYSRSRSYSRSRSRSYSESPRGRRTERDERRSRSISYSRSPRRSLSPGGKEMDRSPTPDRSRSPRRSISPVAKDNGDSPRGRETSRSPSDGYRSPVANGRSPRSPVNNGSPSPTRDNRASPSPRGNNGSPSPKGNGNGGSPSPRGNGDDDGRRGSGSPRGRSVSP

SEQ ID NO: 6530 - protein, 526 aa, Triticum aestivum
MRCLFRFSSSSICPPRPLLPSWPALGSAPAMASISTPRSPLPPRPNPPRRRRRLLSVRHLPATTPPAATQQLRQRQPGPPPFYIAPAWGARGGRPTARRPQRPHFASRLPQSATPHLRLPSWPARRLMASMTTPRLPFLPARTRSAVAATSSSSPSSPLPRRSIKCSSSTNANSAPLPSTSRQPRAPVADGVGSADLNGLRAPPIPVADSPLPAYRDPHGLPRPLTSADLMESSGEGLKVAYQGFPGAYSEAAAKKAYPNCQTVPCEHFDTAFQAVQNWIVDRAVLPLENTLGGSIHRNYDLLLRHELHIVGEVRLAVRHCLLANRGVKIGNLRNVISHPQALAQCEHTLTELGIEHRQAVDDTAGAAKLVAEQMLQDTGAVASSLAAELYGLDILAENIQDEKVNVTRFMMLAWEPIIPRVDKPFKTSIVFSLEEGPGQLFKALAVFALREINLTKIESRPHKKRPFRVADDAFSTRVKYFDYLFYVDLEASMADPKTQNALRNLEEFATFLRVLGSYPTDVSEA

SEQ ID NO: 6531 - protein, 109 aa, Triticum aestivum
  misc_feature (63)..(63): Xaa can be any naturally occurring amino acid
MPDSPIGLVHQLRSCLPCPMGESAVDCGSLASMPDIAFTIGGKKFKLKPEQYILKVGEGQAAXQCISGFTAMDIPPPRGPLWILGDVFMGVYHTVFDYGKLRVGFAESA

SEQ ID NO: 6532 - protein, 161 aa, Triticum aestivum
MYLVKDIGGAIGLMAAALVLLGTWPVVLAVLERRGRLPQHTYLDYSITNFLAAVLIALTFGQIGGDTPETPNFLAQLTRPQDYWPSIMFALAGGVVITLGTVATQYGWAYVGLSVTEVMASSLKVVIGTTLNYFLDGRINRSEVLFPGVGCFLIAACLGSL

SEQ ID NO: 6533 - protein, 101 aa, Triticum aestivum
  misc_feature (29)..(29): Xaa can be any naturally occurring amino acid
  misc_feature (39)..(39): Xaa can be any naturally occurring amino acid
MALVHGRGRGLHHGPPPPGLLGTWPVVLXVLERRGRLPXQHTYLDYSITNFLAAVLIALTFGQIGADTPETPNFLTQLAQPQDYWPSIMFALAGGVVITLG

SEQ ID NO: 6534 - protein, 126 aa, Triticum aestivum
  misc_feature (120)..(120): Xaa can be any naturally occurring amino acid
MYLVKDIGGAIGLMAAALVLLGTWPVVLAVLERRGRLPQHTYLDYSITNFLAAVLIALTFGQIGGDTPETPNFLAQLTRPQDYWPSIMFALAGGVVITLGTVATQYGWAYVGLSVTEVMXSSLKVV

SEQ ID NO: 6535 - protein, 155 aa, Triticum aestivum
  misc_feature (25)..(25): Xaa can be any naturally occurring amino acid
  misc_feature (54)..(54): Xaa can be any naturally occurring amino acid
HCFLLQSNGSFGIRTVVDDETGRSXDVMCHACEMAVVWMTNQLAKNQTQDLILXYINQLCDRIPSPMGESSVDCSRLASMPDVAFSIGGKQFVLTPEQYILKMGEGDATQCISGLTAMDIPPPGGPLWILGDIFMGAYHTVFDYGNMKVGFAKAA

SEQ ID NO: 6536 - protein, 268 aa, Triticum aestivum
  misc_feature (199)..(199): Xaa can be any naturally occurring amino acid
RRPTRPLNKRANATEEGLQRVIGAKIEQSTARTSRESTWVCDESKALQRKKVCVIGAGMAGLASARELRREGHDVTVLEQNADVGGQWLYDPRGGGADDPLGAAEPVKVHSSLYASLRVISARENMGFTDFHFAPKAGRDGRRFPGHGEVQLYLKDFCDAFGLMEAVRLNTRVLRVAMAVAPTRQWAVRSVHEGTEEEXEEVFDAVVVANGHYSQPRLPSIQGMEAWRGRQMHSHPYRLPEPFRGDMVVVVVGCGASDKDIAMEVRGS

SEQ ID NO: 6537 - protein, 356 aa, Triticum aestivum
MAAESQTESGNCSAWAAKDPSGVLSPHSFNRRTVRHDDVSLRITHCGVCYADVIWTKNRHNDSVYPLVPGHEIAGVVTEVGSDVKGFKLGDHVAVGTYVNSCRDCDNCNSFLENHCSKFVFTFNGVDTDGTVTKGGYSSHIVVHERYCYKIPDGYPLEKAAPLVCAGITVYTPMMRHNMNQPGKSLGVVGLGGLGHMAVKFGKAFGLKVTVLSTSESKRDEAISLLGADNFVVSSDKRQMEFLKNSLDFIVDTASGDHPFDPYLALLKVRGIMALVGFPGEIRVHPATLNLGARTLSGSVTGGTKDTQEMINFCAANKIYPDIELIKIDYINEALERLVNRDVRYRFVIDIESSLK

SEQ ID NO: 6538 - protein, 222 aa, Triticum aestivum
  misc_feature (113)..(113): Xaa can be any naturally occurring amino acid
  misc_feature (124)..(124): Xaa can be any naturally occurring amino acid
GTRISPQNLPDSETPRRHSSAPCSPTSPRPPPAPHRRHPGHGGRPTAAGGGRGVGGEEFAVGGVISAKPTLGEEFEGQIVPFDRRSNLLVIQEDGGGAERGERRNVRGLRANXTPGLTRLGEFXKPAATRVRVDSTLRQAELEGGRPGVGVRLKLRRIVVGCPHRILVHYLMHCRILLKDHWENTHNLPKKVSGGTSAANERVKKVLDFERKRQHVRVPGQF

SEQ ID NO: 6539 - protein, 316 aa, Triticum aestivum
  misc_feature (142)..(142): Xaa can be any naturally occurring amino acid
  misc_feature (154)..(154): Xaa can be any naturally occurring amino acid
HREGVIVSAGCAGGAERVGWRSPPPGGFLGVNCFWQERSGAAAQVVPAGRAKTAGASRNRQAVRAGIRGTPGAPVCARAPTRSVGPGDPGTGCHAAVGGPGPGGGTPCRGPPHMMTSNPLPQDGARKPGSVGRAAGSLEVAXLDEAGKQVPAGXAGEVCIRGPNVTAGYKTADPGANEAAFLHGWFHTGDIGVMDGEGYLSLVGRIKELINRGGEKISPIEVDSVLLGHPDVAQAVSFGVPDEKYGEEIHCAVIPRESVALGEEEVVAFCRKNLAAFKVPKKVYIAADLPKTATGKIQRRIVAQHFFVVPAAAAKA

SEQ ID NO: 6540 - protein, 221 aa, Triticum aestivum
  misc_feature (67)..(67): Xaa can be any naturally occurring amino acid
  misc_feature (76)..(76): Xaa can be any naturally occurring amino acid
  misc_feature (86)..(86): Xaa can be any naturally occurring amino acid
  misc_feature (139)..(139): Xaa can be any naturally occurring amino acid
NRACRGRFVGGQGERGSGGRSDGREVAAAREGGVYGAAMRRLVVLDRSELKELKLLTSTIFGNCLEXLVPEVRELXVNDLYASRYXGSCLGYLEKLKSNLLLDMHLHGHIETLYKDIRHKAIMQCTFPFISVDLNLMGXAFQTSVSLLEKELAALITDNKIQARIGSHNKILYASHADQRNGTFQRALQTGNEFERDVKSMLLRANLLKHEYSQKAAERKV

SEQ ID NO: 6541 - protein, 409 aa, Triticum aestivum
  misc_feature (116)..(116): Xaa can be any naturally occurring amino acid
  misc_feature (338)..(338): Xaa can be any naturally occurring amino acid
  misc_feature (373)..(373): Xaa can be any naturally occurring amino acid
THSSLRSSGKGGRSIGPPIDPSAGKMNSLTATGSSSGAGSSGGVRGGEMRAADGEGYLRADGFDLVNLDMQLEKTRSRVWLDQQRGASPAQPGELLEWEIDLAKLDIQHQVASGTXFGVADRRTYDGYDVAVKVLERGGEGFGGSSKRRAGMKKAVGAWQPLVDSICANVVGASMGTSRLDVRAAKQRGGGLEPGQRCVVVVEYQHGGTLKTLLFQHRDKKLPYKKVVQLALDMARGLSYLHAQKIVHRDVKAENMLLDRKKSVKIADFGVARVEAQDDDNMTGQTGTLGYMAPEVLEGRRCDHKCDVYSSGVLLWETYCCALAYPNYSIADISYHVXKLGIRPDIPRCCPKPLSEIMTRCWDGNPDHRPEMXEVVAMLERIDTTKGKSMTPAVPDHTSQGCSCFGFSK

SEQ ID NO: 6542 - protein, 172 aa, Triticum aestivum
  misc_feature (159)..(159): Xaa can be any naturally occurring amino acid
MLPYATASDAEAALRRAMTRAEAAWFGYTAAKADYYLYYHTVAVLLAVYTLLPLMLALLELGAPALAMRYKLQPRGKRLSPAGFLRCYTDTPRFLLPLAAPVQLLSYPAVKMLGIRMGLPLPSAGEMAAQLLMYLLVEDYLSYWVHRLMHTKWCYDNIXRQHEYTAPNGSSR

SEQ ID NO: 6543 - protein, 121 aa, Triticum aestivum
  misc_feature (54)..(54): Xaa can be any naturally occurring amino acid
MGASLARPLLSSLHPRTRRLPEDKSSMEYTEVLKLRGLPHSATIEDIIKFFCGXYELTEENVHIAYRGDGRATGEAFVEFPTAEVAKTAMCKDKMTIGTRYVELFPSTPEEASRAKPRGRQ

SEQ ID NO: 6544 - protein, 385 aa, Triticum aestivum
  misc_feature (38)..(38): Xaa can be any naturally occurring amino acid
  misc_feature (55)..(55): Xaa can be any naturally occurring amino acid
  misc_feature (82)..(82): Xaa can be any naturally occurring amino acid
  misc_feature (353)..(353): Xaa can be any naturally occurring amino acid
AETCYLNRWNKEYVTFLIVLCDLILSTTLAVVISMVVXNRRTKRIRSREASGASXPALVPPLWKVFNSEELRSIESRVSEGXTPRANARTGGTYSGTLPDGLKLAIKRLKRSSLQRKKDFDSEISRVAKLYHPNLVAVKGCCYDHGDRFIVYEFVANGPLDVWLHQIPRGGRSLDWATRMRVATTLAQGIAFLHDKVKPQVVHRDIRASNVLLDEEFGSHLMGVGLSKFVPWEVMHERTVKAATYGYLAPEFIYRNELTTKSDVYSFGVLLLEIISGRRPAQSVESAGWQTIFEWATPLVQSHRHLELLDPLINDLPEIGVIQKVVDLVYACTQHVPSVRPRMSHVVHQLQQXWELKSAASEQLRSGTSTSATSPMLPLEVRTPR

SEQ ID NO: 6545 - protein, 248 aa, Triticum aestivum
  misc_feature (121)..(121): Xaa can be any naturally occurring amino acid
  misc_feature (210)..(210): Xaa can be any naturally occurring amino acid
  misc_feature (222)..(222): Xaa can be any naturally occurring amino acid
  misc_feature (227)..(227): Xaa can be any naturally occurring amino acid
MDVEDELRTAPAPADGGESSHALVSGDQLDVEAYAAQYSGRTRVGRLLFIAEKCGSEQMRLDALRLAYDWALKGEDTALHRDVSAKIAGRLGPRYAADQPWSDAVERRALLRKDKLDSELXTKESIRMGYNDLGDFHYAQGHLSDAFKSYIRTRDYCTTSKHVVQMCLNVILVSIELGQFMHVSNYVIKAEQTPDDMDPITAAKLRAAAXGLTYMETNKFKXAAPNXRQTKDNYLEILHKCMVMPLAL

SEQ ID NO: 6546 - protein, 199 aa, Triticum aestivum
MAPSRKFFGGGNWKMNGRNQSLGELIGTLNAAKVPADTEVVCAPPTAYIDFARQKLDPKIAVAAQNCYKVTNGAFTGEISPGMIKDCGATWVVLGHSERRHVFGESDELIGQKVAHALAEGLGVIACIGEKLDEREAGITEKVVFEQTKVIADNVKDWSKVVLAYEPVWAIGTGKTATPQQAQEVHEKLRGWLKSNVSD

SEQ ID NO: 6547 - protein, 299 aa, Triticum aestivum
MELRTLGGTGLRVSPVGFGASPLGNVFGDVPRDVARATVRRALDLGINFFDTSPYYGGTVSESVLGDCLRFAGVPRDSFVVATKCGRYKEGFDFSAARVTRSIDESLARLGLDYVDILHCHDIEFTNLDQIVNETIPAPQKIVASGMARFAAITGVPLSIFTYVLDRVPPRSVDLVLSYCHYGINDTALVDLLPYLKGIGGRLKWHPAPEELKLACRTAADHCRKKGKHITKLAMKYSLMNNEISTVLVGMNSPEQVEENVAAAVELSTSGIDEELLHEVEAILEPVKNLTWPSGIQQA

SEQ ID NO: 6548 - protein, 394 aa, Triticum aestivum
  misc_feature (83)..(83): Xaa can be any naturally occurring amino acid
  misc_feature (97)..(97): Xaa can be any naturally occurring amino acid
MAKLLAVLALVAAAAPFLGVAGQEGEGGSELLPFAVGAAPEGCDVGQGEWVYDEAAAPAYEEAACPYIPAELTCQAHGRPDKXMRNRQTFPLRMVVXSFNATVMLEMLRGKRMLFVGDSLNRAQYVSLLCLLHRAMPEGSSSFETVDALSIFRAKAYDATIEFYWAPLLAESNADDGVEHQLNDRVIRGAPMDRHSRFWKGADVLVFNSYLWWMTGDKIQILRGADNDMSKDIVEMGAEEAYRLVLHQVVRWLDGNVDPKKSRVFFVTASPTHASGQLWGDEAEGSNCHGQTKPIADASYWGSTSRAMLRVTGEVLAASARVPVGVVNVTQMSEYRRDAHTQVYREQWAPPTKEQLADPKSYADCTHWCLPGVPDAWNELLYWKLFFPANDQAL

SEQ ID NO: 6549 - protein, 324 aa, Zea mays
  misc_feature (166)..(166): Xaa can be any naturally occurring amino acid
CEKESDLCLQLRILVWATSKHDIYLVSHYSIRHWSALSGVDTELINVQGHVAPREKHAGSLSEGFYQTQVSTLTVKDNLLVAGGFQGELICKHLDQEGISFCCRTTYDDNAITNAVEIFNTSSGAVHFMASNNDSGVRYYDMERFQLFKHFQFEWPVNHASLSPDXKVVVIVGDDPDGLLIDANSGKTVHSIKGHRDYSFASAWSPDGRTFATGNQDKTCRIWDVRNLSKSVHVLRGNLGAIRSIRFTSDGQFMSMAEPADFVHIYDVKSDYNKRQELDFFGEISGTSFSPDTDTLFVGVWDRMYGSLLQFGRLYNYSYLDSLF

SEQ ID NO: 6550 - protein, 148 aa, Zea mays
  misc_feature (61)..(61): Xaa can be any naturally occurring amino acid
ADLMQDFKTGYLTLASPRSMFISQVIGTAMGCVIAPCVFWLFYKSFDVGATNGAYPAPYTXMYRNMAIMGVDGLSLPKHCLTLSYIFFAAAFAVNMVKDLVPKKVAKFIPIPMAVAIPFYVGAYFTIDMFLGCTILFIWEMRNKAEAD

SEQ ID NO: 6551 - protein, 719 aa, Zea mays
ASLRAGKSFPVGRVSCRVRSVQARRVRFGGKLGRCWCSLGAAFGLIGAAVWRCAVCRLAVCASLVADVFRKQGQEWYCTSGLPSDISVVVGEQSFHLHKFPLLSKSGLLEKRIREKIDNRDDSCAIDLSDIPGGAKAFELAAKFCYGVKFEMTASNVVHLRCAADYLEMTEEISEGNLIAETESFLTQTVLRSWKDSVKALQTCDNVLDVAERLQIVKRCVDSIATKSCSDPDLFGWPVARYGGPMQSPGGSLLWNGISTGARPRNSSPDWWYDDVSCLSLPLYKKLISAMEYRGISQGVIVGSLNHYAKRRLPGLNRRKSIGDASNCLSMTSLTSIPSEDDQKYLLEEIDRLLPFQRGVTSCKLLFGLLRTAIFLKASPSCVSNLERRIGMQLDKASLEDLLIPNVSDSVETLYDVECVQRIVDHFLSMDQETGGASPGIGEDGQMLASPSLMPITMVAKLIDGYLAEVAPDMNLKLPKFRSLAAAIPDYARPIDDGLYRAIDIYLKAHPYLPESDKEELCRVMDCQKLSLEACTHAAQNERLPLRVILQVLFFEQLQLRSSIAECLMISEPLDGGGGFSRQLGGLPVSGEHLRGAGWPLAARENQTLREGMDSMKQRVSELEKECFAMKEDIERLGRSRSAGKSRFPFALAAKPHVCGTKDKEAAPESSKSETSKSKAAAATRSDDKLAVVKGGAAAAGDGGPQLKHRKHKTSLSAC

SEQ ID NO: 6552 - protein, 665 aa, Zea mays
MHLSLWKPLSHCAAVLLAKNHRRRGGGGGSNGRRDDSSAFLRQLRDALDAASEDGSLCPPPDAGGADADAAVSRSRSLARLRAQRDFLRATALATAAGPFRSLSDLPLLPHAIATFLAMYPDYASTADVDRLRVDHYSHLDAPGAGRVCLDYCGFGLFDSGWDSSSSSFTLHELNANLSNHALYGGAEPGTVENDIKERILEYLNVPASEYALVFTVSRGSAFRLLAECYPFETNRRLLTMFDHESQSVNWMAQSARAKGAKTRTAWFRWPTLKLCSTELRKEIVGKKKGRRRDAAVGLFVFPAQSRVTGAKYSYQWMALAQQNGWHVMLDAGALGPKDMDSLGLSLFRPDFIITSFYRVFGADPTGFGCLLIKKSVIGTLQGRNGCNASGMVRIVPVFPQYLSDSVDGFDAFDGFEDDPGVDKDEKPSSNAQNGSQLPAFSGVYTSAQVRETFESDPGRDSSSDRDGASTIFEETESVSMGEIMRSPAFSEDCSSENSFWVDVGHSPLGSEKSGQFKKGKLGSPLPSSWFNGRKCNKRMSPNLSSRISRSPLYDGHVISFDAAVLSVSQDADCLKEDPEEENFENGRRAHFRQVSEIQEEPEAEKVACQRAMNGGADHKESAIRRETEGEFRLLEVGMATTDLWGGLAHVMYMMDSTNYSRLRT

SEQ ID NO: 6553 - protein, 395 aa, Zea mays
  misc_feature (323)..(323): Xaa can be any naturally occurring amino acid
AGHSMELEAIGKRLRISSGSSSLAGDRLTSLPDCLIHHIMSFLKARQVVQTCVLSTRWRHLWRSVPCLDIDQDEFKAAGSNRITEKEQEDFEDFTDHLLIPNNISIALLDTLRLHVSDDEYYHRGASVRWIRHGIKYSAQNPGIMHKESNLAFWRLKKLHLSGVYLDGSFMKHVSSGCPYLEVLELKDCPCTFEEVTSHTLKNLILENCGCNELSGITSPTLKSLTIIASGYYHIIRLVLKAPAVAYLLLDVNAYFVKRDVSFDEMSSLAKASIYLRDSVGSGLSKDQFKLLCSVSNVTTLGLSGFQTMVITAVFIDVFLLLXNYIAVPFLLLNELYNTFQMLANFLQHSPDLEKLTLGRCKFSKDPKKKKKKKKKKKKKKKKKKKKKKKKKKKK

SEQ ID NO: 6554 - protein, 288 aa, Zea mays
LQPRHVVWAYVVAPVFAFCNAYGTGLTDWSLSSSYGKLAIFIFGANVGAADGGVVAGLAACGLMMGIVSTASDLIQDFKTGYLTLTSPRSMFVSQVMGTGLGCVISPVVFLGFQEMAGGADHLGEAGSLYAAPMAMAYRGIADLSVEGIKTLPRHSVMLCVPCFLVALCVDALAAVAAANGWRIKGYVPNIMAMAIPFFVGPTFAIDMCLGSLLVILWRRRNKQAANLLSVVVASGLICGDGLWALPSSLLAIFKVEPPMCMKFLSNYQTEQMRKHLILAAAARRRTS

SEQ ID NO: 6555 - protein, 313 aa, Zea mays
  misc_feature (55)..(55): Xaa can be any naturally occurring amino acid
  misc_feature (92)..(92): Xaa can be any naturally occurring amino acid
  misc_feature (156)..(156): Xaa can be any naturally occurring amino acid
  misc_feature (239)..(239): Xaa can be any naturally occurring amino acid
DPRGRPGRGFVRRIGDHEFCRMLADILRDNGLHYGGDNFDSRARTEIAYPTLHAXRGSAEFMFYRNPIADVLLTADELTAELIKKAARFHYXSTSLIAETCRTAHLRAMKIAKEAGALISYDPNLREALWTSREEVRTQILSIWDQADIVEDREVXLEVLTSIDSEEDDVVMQLRRTTMRLLLMTLGDQGCEYYARDFHGGAASIKVQQADTPGAGDAFVGALLQRIVNDPSSLQDEKXLVESPKFPNASGTVTSSKKGAIPSLPTKREVLQLIKEAWIIIVLSAMVFTSLYFFGLVRILTPPRTIHRSAASY

SEQ ID NO: 6556 - protein, 911 aa, Zea mays
MPPICLFLPKSTHASGQFAISTYDDPDIIRRLFERGLAYVGTDYRSNILWDEYIKYEESLEAWSHLAVIYTRVLENPIQQLDRYFNCLKELASKHSFSEILTAEEASVYVVTSETSAQAPDGDTHPDDVDKPGQPELSSLADAENLAKYVSMREEMYKKAKEYESEIIGFELAIRRPYFHVKPLDNPELENWHSYLDFIEKEEDINKVIKLYERCVIACASYSEFWIRYVQCMEDKGSLDLANNALARATHVFVKKQPEIHLFSARFKELNGDISGARAEYQHLYSDLCPGFLEAIVKHSNMEHRLGDKELSCSVYEKAIAAEKGKEQSQLLPTLLIQYSRFLFLAIRDLEKAREILTVLHEQLNVTKTVLEAVIHLESIFPCEKRIDFLDSLVEKFVTPESSQGELASLVDKEEISSIFLEFLDLFGDAKSIKKASTRHTTLFSCKRSILPSKKRKADDAVVSDRDKFAKTGSVQSATGTDPNASNPPVWPATSETSGHQWGASYAQQAAYPAYGTYDYSHQMPQPAPQTAAYGAYPPTYSVQAYTGRKVAIVGSGPSGLAAADQLNKMGHFVTVFERADRIGGLMMYGVPNMKTDKIGVVQRRVNLMAEEGVTFVVNANVGSDPLYSIERLRSENDAVIGAGGAAFPRDLTIPGRELSGVHFAMEFLHANTKSLLDSNLEDGKYISARGKKVVVIGGGDTGTDCIGTSIRHGCTSLVNLELLSKPPSTRAADNPWPQWPRIFRVDYGHQEAATKFGKDPRTYGVLTKRFIGDGNGKVKALEVVRVKWEKVDGRFQLKEMEGSEEIIEADLVLLAMGFLGPEATIAEKLGLEKDNRSNFKAQFGDFATSVDGVFAAGDCRRGQSLVVWAITEGRQAAAAVDKYLSRYDQNAAATGDSTPSGTGLVQPVAA

SEQ ID NO: 6557 - protein, 406 aa, Zea mays
  misc_feature (246)..(246): Xaa can be any naturally occurring amino acid
MEAAPRRQQQEEEGCPCGGPEAADHFERLHDAVLLDVLNRIGDVKALGRCALVSRRFHALVPLVDSVFVRVDCVIPDDPPSSSSAGAAPGSPPHQAPAPTACGRGALARVARALLGGVARPIHALGQILSSAAATVSRRSEPLPASPPPAPVADVSHHSPSEVLRSFRELRRLHIELPTGELGIDDGVLLKWKADFGSTLGSCVILGASSVSSKPPAGSAQAETAAADSTPAAPDTGRETEEPGSXPDSLYTNGGLKLRVVWTISSLIAASARHYLLHPIICNHGTLESLDLTDADGQGVLTMDKRQLQELRVRPVSPSGSSHRTLMPALSMRLHYAPLIELPGGTLLKGATLVAIRPSEDALREGQGVAGPAGTCWISEAFEEPYRTAAKVLLKRRAYCLEMNSF

SEQ ID NO: 6558 - protein, 103 aa, Zea mays
LFYYCALLQMSGATLFNLSLLTSDMWAVAIRVLFYQQEINRLYYLAFTVVAIGLIIYSLNDRSSDDETAGSTEAPAQYQQLPIEDNSTRIGSSSGKCLIGSRS

SEQ ID NO: 6559 - protein, 145 aa, Zea mays
MALVGQVATVAQLVGVDAFSLITMIAEAAQTARRNRAVCRQLARRVEMIGGLLRWLRDDDARLLQHAETRGPVEALEETLRCAYLLVRSCQRRGYAFRCLMGARHADELREMQGEIGFYLGLFPLISYVDWARRRGNGNGKARLW

SEQ ID NO: 6560 - protein, 292 aa, Zea mays
MEQVPGTWRWMLGVAAVPAIIQFVLMLFLPESPRWLYWKDEKAKAIAVLERIYESDRLEEEVELLATSSMHEFQSNNTGSYLDVFKSKELRLAFFAGAGLQAFQQFTGINTVMYYSPTIVQMAGFSSNRLALLLSLIVAAMNAAGTIVGIYLIDRCGRRRLALTSLAGVVVSLAILATAFILQSSSGLCMSAASGTCQGALGWFAVAGLALYIAFFSPGMGPVPWAVNSEIYPEAYRGTCGGMSATVNWVSNLVVAQTFLSIVGLVGTGPTFLIVAGIAVLAFVFVATYFSQ

SEQ ID NO: 6561 - protein, 233 aa, Zea mays
MVVAAAAALYLAVKPLPLVLVLVHHSRPAPSSAPRLPRRTARARPLRFLSCSTSAPPLFAAVASMDSPPQGYRTNVGICLADPSLTKIFSASRIDIPSAWQMPQGGIDAGEEPRAAAFRELREETGVTSAEIVAEAPVWLTYDFPPDVRTKLNARWGTDWKGQAQKWFLFRLTGNDDEINLNGDGSEKPEFGEWTWMTPKEVIEKAPGFKKPVYEEALKHFAPYLQSDPAASS

SEQ ID NO: 6562 - protein, 136 aa, Zea mays
MVEILFEDIFTVTQLDPDGKKFDKVSRIEAVSQQFDMQMQLDVNTEIYPLSVGKKFTMVLAPTLNLDGTPDTGYFIQGGRKSLADKFEYVMHGKLFKISEESASGPNVKVEMYASLGGLLMMLRGDPSNAANFELD

SEQ ID NO: 6563 - protein, 130 aa, Zea mays
MLVYQDLISNDELLSDSFPYTEIENGMLWEVEGKWVVQGALNVDIGANPSAEGGEDDEGVDDQAVKVVDIVDTFRLQEQPAFDKKQFMAYMKRYVKHLTPKLDAEQQVLFKKHIEGAIKFLLSKLSDLQF

SEQ ID NO: 6564 - protein, 133 aa, Zea mays
  misc_feature (65)..(65): Xaa can be any naturally occurring amino acid
SLLLSLLAVAAYGRLISNGGGFDQLLSVILLSRSFPAAEAGNKALEKCEHSYGLLPCTYQRANKXTLALTYGYLMYNADTYLSSVSELLLEIILPRLVGSLLLHILHALPDALLVLTYGLFGSKDEAHSHVLI

SEQ ID NO: 6565 - protein, 424 aa, Zea mays
ASERGAKRIRVHVLTDGRDVADGSSVRFVEMLEEDLARLREKGVDARIASGGGRMYVTMDRYEHLPVVVVVFVFVFLQNDWQVVKRGWDAHVLGEAPHRFRSALEALRKLREEDPKKASDQYLPPFVVVDGSGEPVGPVRDGDAVVTFNFRADRMVMLAKALEYEGFDRFDRVRFPRTRYAGMLQYDGELKLPRHYLVAPPEIQRTSGEYLARNGVRIYACSETVKFGHVTFFWNGNRSGYFDQNLEKYEEIPSDAGIPFNVQPKMKALEIAQKARDAILSQKFDQVRVNIANGDMVGHTGDMEATIVGCKAADEAVKIILDAVEQVGGVFVVTADHGNAEDMAKRDKSGEPLRDKDGKVQTLTSHTLNPVPIAIGGPGLAPGVRFRTDLASAGLANVAATVMNLHGFQAPDHYEPTLIQVVDE

SEQ ID NO: 6566 - protein, 98 aa, Zea mays
GIPGRMEPFPFNGEKKQVFAGIPIFFSVFGVPWGFLTRGGKHQFPPDFMGKGYKARSKRLFFGQSFALKKKKLDCPFWAPTLKTCHRSNPGLICPPRV

SEQ ID NO: 6567 - protein, 580 aa, Zea mays
MEQRNVLALGEHVLKATVWKRKHKTAMEHPEGNDVMVFSQHDQRKHPVIFDDRAKCKKSKLISCGSGVILESYWNFKTSGLPVRVLFYQHGDWSDFPEDVVNLAQQDFQLKKPITTAVFQNKHILLDFIHMICIDYEMTIDKPLAWVDDNGKRFFPDLSAGLYTSKPSQHENGEADECDGTPTSVAESSSSVSVGEVVSHGKRINDIAEDNMRAHNILYEAVGENISGPSFHLNEYSSGTIQATGKPNDCRRIDSAVRNLLLKGLGQPFSEEDIIGIYRTPLLDQRGQVRCGLFQKEIEETRSRRGNANVRYAWLPCSRYTMEQMAMRGALEIAKPHKGSICGVGTCLAPANCTNSCARYSDFHEDGIIRMMLCRVIMGNVEVVLPGSKQFQPSNGSFDNGVDDLQNPQNYIVWDANVHKHIYAEYAVIVQAPLVTNECSGLKDSVPNISEIISSGSRDNLTKEDRFAPCGVEQEAPRLGRAPRAPSSPWMPFSMLFAAISTKVPRSDMELVIRYYEEFKRKRMSRSDLVVRMRQIVGDKILVSTIMRLHHQKKPPSMAAAAAGLARALARGEEGGGVAE

SEQ ID NO: 6568 - protein, 556 aa, Zea mays
  misc_feature (107)..(107): Xaa can be any naturally occurring amino acid
  misc_feature (112)..(120): Xaa can be any naturally occurring amino acid
  misc_feature (128)..(128): Xaa can be any naturally occurring amino acid
MAAQVVVAGGGGSWPQQWRLTLVLAALVPLLSLCLLLARTTRRAGSWSSSSKGGRLDVHRLPPGPPRLPLLGNLHQLGSLPHRSLRELARRHGPVMLLRLGSVPTLXGVSSXXXXXXXXXARDADCCXRPDTPGARRLSYGHKDVAFAPYTDYWRQMRKLFVVELLSARRVRAADHAREAEVDKLIARLSSAGGKPVQLEDHMFALMDGVIGTVAFGNIYGAEQFAHRNHFHDVLDEALSAKAGFSAEDYYPNAAGRLVDRLTGAAARRERVFRDLDAFFDTIIDQHLVVVDPSSSPPSSATTTPDLIDVFVDLMEESRHQPQVHGSLRFTRDHIKGLLSNVFTAGVDTSSVTMVWAMAELTRRPAMLRKAQEEVRSVVGGDRERVHPDDMPKLRYLKAVVKETLRLHPAAPLLLPRETMRHVSVCGYDVPAKTRVLVNAWAIGRDPRSWGPRAEEFDPGRFEDGGDVGFNGTHFELIPFGAGRRMCPGIAMGVATMEFTLANLLYCFDWELPEGVGVEDVSMEEAGSLTVHKKTPLLLVPTRYKANCQSRHSFQF

SEQ ID NO: 6569 - protein, 145 aa, Zea mays
MATRPAAEGKPWELAAHPRLPKGRTVAVVVLDGWGEAAPDPFNCIHVADTPTLDALKKAAPERWRLIKAHGTAVGLPTDDDMGNSEVGHNALGAGQIYAQGAKLVDLALGSGKIYEGEGFKYIQQSFQDGTLHLIGLLSDGGVHS

SEQ ID NO: 6570 - protein, 131 aa, Zea mays
  misc_feature (68)..(68): Xaa can be any naturally occurring amino acid
  misc_feature (84)..(84): Xaa can be any naturally occurring amino acid
MSGSREGGGGGRRFGGGTSGRGDKGGRGGMTPKGGRGDRGRLGHSGGMKGRSKDGRVSTSHRGCYFLXKEDALCSTNIDPVESXYREKPDSAQNEDGTNVPYRVWNPLRSKLGAAELGGADNIWIAPGSRE

SEQ ID NO: 6571 - protein, 406 aa, Zea mays
  misc_feature (92)..(92): Xaa can be any naturally occurring amino acid
MEAARQQQEECPCGGAEAADQFERLHDAVLLDVLNRIGDVKALGRCALVSRRFHALVPLVDSVFVRVDCVIPDDPPPSSSCSYFSSSAAPGXPPRQAPAPTARGRGALAHIARVLLGGIARPIHALGQILSPAAAAVSRRSEALPASPRAPVADVSHHSPSEVLRSFKELRRLHIELPTGELGIDDGVLLKWKADFGSTLVSCVILGASSISSKPPTGYTQAESETATAATPDTSRETEEPGSLPDSLYTNGGLKLRVVWTISSLIAASARHYLLQPIIWNHELLESLDLTDADGQGVLTMDKRQLQELRVRPVFPSGSSPRPLMPALSMRLHYAPLIELPGGTLLKGATLVAIRPSEDALREGQGVGAAGPAGTCWISEAFEEPYRTAAKVLLKRRAYCLEMNSF

SEQ ID NO: 6572 - protein, 345 aa, Zea mays
PAGVSSSSPASERQRLHPISFSPPHLRRTPITLFPPPAVQLTPTAPPLPLKSRDIADPPALRSARLRTRPIGSRSVDGTLNCGYSSFRGRRASMEDFYDIKASKIDDKQINLFGIFDGHGGSRAAEYLKEHLFENLMKHPEFMTNTKLALSETYRKTDSEFLDAERNTHRDDGSTASTAVMVADHLYVANVGDSRAVISKAGKAIALSEDHKPNRSDERNRIESAGGIVMWAGTWRVGGVLAMSRAFGNRLLKQFVIADPEIQEQEINEELEFLIIASDGLWDVVSNEDAVTLVKMEEEPEAAARKLTETAFSRGSGDNITCIVVKFQHDKPRSGGGDSPSSPRL

SEQ ID NO: 6573 - protein, 502 aa, Zea mays
APPPPPGPPRGSKARLAQLSPVESSRSEGSSASEQTSESSEAEVNAPRTKLRPFYWDKVLANPDQSMAWHDIKFGSFHVNEDMIEELFGYSGGSRNNLKDKELPSADPASQHISLLNVKKSCNLAVVLKAMNIRVQDIHDALIEGNELPRVLLETILRMKPTDEEEQNLRLYNGDFSQLGLAEQVMKALIDTPFAFKRVDMLLFMSSLQEDASSLRDSFHQLEAACGELKHRLFLKLLEAVLKTGNRLNDGTFRGGANAFKLDTLLKLSDVKGADGKTTLLHFVVQEIVRSEGVREARLAMENGRSPAHSASDDTSNGSLEEDGDHYSNRGLSIVSGLSSEMDNVKRVAALDAEPLFATVVTLRQELLKSREFLNEIATVEETSGFRRSLESFVEHADNETGFLLKEEKRLRSLVKKTIRYFHGNDSKDDGFRLFVVVRDFLVMLDKACKEVGASQKGTNKSRSSGSGSGNGNGNPTFPSILQEQQFPAVIDGHSDSSHTSN

SEQ ID NO: 6574 - protein, 517 aa, Zea mays
MEPATWAAFLGIALCAAAALFLSRGRRPVYNPPPGPKPWPIIGNLNLMGELPHRSMNELSKRYGPLMQLRFGSLPVVVGASVEMAKLFLKTNDAAFSDRPRFAVGKYTAYDFSDLLWAPSGPYLRQARRICATELFSATRLESFEHIRDEEVRVMLRQLRQAAGRTVRLRDYLQMLALGVISRIVLGKKYVKEEAADGEGDSAPAITPAEFREMVDEFFALHGAFNIGDYIPWLDWLDLQGYVARMKRMKARFGRFLERVLDVHNERRLREGGNFVAKDMLDVLLQLADDTSLEVQLSRDNVKAITQDLIIAGTDSNANTLEWAVSELLKNPKILAKAMEELNHVIGPDRLVTESDLPRLPYIEAVLKETMRVHPAAPMLAPHVAREDTSVDGYDVLAGTVLFINVWAIGRDPGLWDAPEEFRPERFVESKIDVRGHDFQLLPFGSGRRMCPGINLALKVMALSLANLLHGFEWRLPDGVTAEELSMEEAFQLTVPRKFPLEAVVEPRLPDRLYTGA

SEQ ID NO: 6575 - protein, 445 aa, Zea mays
  misc_feature (119)..(119): Xaa can be any naturally occurring amino acid
  misc_feature (225)..(225): Xaa can be any naturally occurring amino acid
  misc_feature (314)..(314): Xaa can be any naturally occurring amino acid
MATALSSEELMRMEQDCSAHNYHPIPMVFSKGEGSHIVDPEGNKYIDFLSAYSAVNQGHCHPKVLRALIEQAERLTLSSRAFYNDKFPIFAEYLTSMFGYDMMLPMNTGAEGVETAIKXLARKWGYEKKHIPKNEALLVSCCGCFHGRTLGVISMSCDNDATRGFGPLVPGHLKVDFGDIDGLKKIFEELGDRICGFLFEPIQGEAGVVIPPDGYLKGARDLCSXHNVLMIADEIPTGIARTGKMLACDWENIRPDMVILGKALGAGVFPVSAVLADKGVMLCIRPGEHGSTFGGNPLASAVAVASLKVVRDEXLVERAAKLGQEFRDQLQKVQQKFPQILREVRGRGLLNAVDLNNDALSPASAYDICIKLKERGILPKPTHDTIIRLAPPLTISPEELAEASKALSDVLEHDLPQLQLQKQIKKPESEAEKPVCDRCGRDLYG

SEQ ID NO: 6576 - protein, 417 aa, Zea mays
MTDGDDEYKREESVALLVIVFLAALSLLSVIAAFAYYCYITRKVSRRLQAFHIPKRSSSHHTLPPRALPPQQQGTDNPSSNSTRDGVGAAAMSVVAAGERGVQVFSYRQLHAATGGFDRAHMVGQGSFGTVYRGVLPDGRKVAVKLMDRPGKQGEDEFEMEVELLSRLRSPYLLGLIGHCSEGEHCLLVYEFMANGGLQEHLYPNRGSCGGISKLDWDTRMRIALEAAKGLEYLHEHVNPPVIHRDFKSSNILLDKDFHARISDFGLAKLGSDRAGGHVSTRVLGTQGYVAPEYALAGHLTTKSDVYSYGVVLLELLTGRVPVDMKRSPGEGVLVNWALPMLTDRDKVVRILDPASEGQYSLKDAVQVAAIAAMCVQPEADYRPLMADVVQSLVPLVKNRYNQKSCNPNVQPSKPLD

SEQ ID NO: 6577 - protein, 357 aa, Zea mays
MEGGAGASEKGTVLVTGASGFVGSWLVMKLLQAGYTVRATVRDPANVGKTKPLMDLPGATERLSIWKADLAEEGSFHDAIRGCTGVFHVATPMDFLSKDPENEVIKPTVEGMISIMRACKEAGTVRRIVFTSSAGTVNLEERQRPVYDEESWTDVDFCRRVKMTGWMYFVSKTLAEKAALAYAAEHGLDLVTIIPTLVVGPFISASMPASLITVLALITGNAPHYSILKQVQLIHLDDLCDAEIFLFENPAAAGRYVCSSHDVTIHGLAAMLRDRYPEYDVPQRFPGIQDDLQPVRFSSKKLQDLGFTFRYKTLEDMFDAAIRTCQEKGLIPLATAAGGDGFASVRAPGETEATIGA

SEQ ID NO: 6578 - protein, 63 aa, Zea mays
MAGGRVGHPPPKGPSVVKEIFFGLPLGLIGGGMWKMPPWTDQRKTGPFYNMLAKGQIRVVVKE

SEQ ID NO: 6579 - protein, 210 aa, Zea mays
  misc_feature (91)..(91): Xaa can be any naturally occurring amino acid
  misc_feature (154)..(154): Xaa can be any naturally occurring amino acid
RSVRPASAHACVETSRKLLVNSWHQFHTITTSELFTYDTLILYTVLTSVISVDRVSLKQKVVHAPEILAEIGNIPHLMRFLNAFYNWQDKXFFIAFSGSTEPIKIQRYLHADYCYYMREVRTVAYSQLVESYKSATMEVMADVFGVTVDFIDHXLTHFIAAGKLPRRIDNGAGVLQTTPPDARNALYQAAIMQGDFLLSRCLNLSKVIHL

SEQ ID NO: 6580 - protein, 190 aa, Zea mays
  misc_feature (43)..(43): Xaa can be any naturally occurring amino acid
MRGPNAATATSKGGAMAGFKQDLLRNLLLGIRACRPWAPLSRXDRKRAVKRSADVAMAAARAAAGGGRARWPKAILAAAAASGHSPGGIRKARKSACKRVVRRPRRATASCDVVARRLVRSRTMALRKVIPGADATAAMDDEAVLLRETIDYAVHLRAQVDVLRRVSAAVQRSTFLRDGPAQTWEEDRSG

SEQ ID NO: 6581 - protein, 383 aa, Zea mays
  misc_feature (108)..(108): Xaa can be any naturally occurring amino acid
  misc_feature (306)..(306): Xaa can be any naturally occurring amino acid
MGQQEKEVIPLMTPYKMGQLELSHRVVLAPMTRCRAIGDVPQPHAAVYYSQRASRGGVLITEGTGVSATAQGFPGSPGIWTQEQVAAWKPIVDAVHRKGGHAGCGPTXLFFCQIAHVGRASTNDFQPDGQAPVSSTDAQLPPDAESGTVFSRPRRLRADEIPGIVDDFRRAARNAIEAGFDGVEIHGAHGFLLEQFMKDGANDRADEYGGSVENRCRFVVEVVDALVREVGASRVGIRLSPFADYLDCADSNPLALGHYMVEQLNRHEGFLYCHMVEPRMAIVDDRRQIPHRLLPFKAAFNGTFIXAGGYDREEGNKVVAEGYADLVAYGRLFLANPDLPKRFEVDEILNKYDRSTFYTQDPVVGYTDYPFLREDSEDLAAQA

SEQ ID NO: 6582 - protein, 171 aa, Zea mays
MLRRSRHGGVRLGRKLLGLWQRALRGGRRRRGGYRPLKQHQQQPCAGTPERAARKLAPALLRWGRSLARRLRLGWRAGGGRRMLAGGEAEVATTPKGQVAVYVGGGEAAQSLRYVVPVVYLNHPTFGELLREAEEEFGFQHPGVITIPCPAARFEQAAALAGAGKKGFARW

SEQ ID NO: 6583 - protein, 257 aa, Zea mays
  misc_feature (132)..(132): Xaa can be any naturally occurring amino acid
  misc_feature (167)..(167): Xaa can be any naturally occurring amino acid
  misc_feature (185)..(185): Xaa can be any naturally occurring amino acid
  misc_feature (192)..(192): Xaa can be any naturally occurring amino acid
  misc_feature (230)..(230): Xaa can be any naturally occurring amino acid
  misc_feature (239)..(239): Xaa can be any naturally occurring amino acid
MGRKFFVGGNWKCNGTTDQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETXLRRREAGSTHGMLLLHKQKAIAEKIKDWSNVVLAXYEPVWAIGTGKVATPAQXAQEVHAXSLRDWVKINVSPEVSESTRIIYEGSVTAANCKELAAQXPDVDGFLVXGGASLKPEFIDIINAATV

SEQ ID NO: 6584 - protein, 124 aa, Zea mays
  misc_feature (19)..(19): Xaa can be any naturally occurring amino acid
SRPAGKRVFLFPQCYAEKXALGEVSQELLDTQVNPAVWEISGHMVLKRRMDYEEASETSAWKLLAEVSLSEERFEEVKAYIFSAAGLVQYDEEEEEASDGEGPTAYVPVKVTPLPVAEGCLVLP

SEQ ID NO: 6585 - protein, 447 aa, Zea mays
  misc_feature (150)..(150): Xaa can be any naturally occurring amino acid
  misc_feature (165)..(165): Xaa can be any naturally occurring amino acid
  misc_feature (183)..(183): Xaa can be any naturally occurring amino acid
  misc_feature (193)..(193): Xaa can be any naturally occurring amino acid
  misc_feature (220)..(220): Xaa can be any naturally occurring amino acid
  misc_feature (238)..(238): Xaa can be any naturally occurring amino acid
MSNYYDDYDDIDGMEDDYDMDDPIDDMVDEQQGIRDSDVEDNDYGQPNDKIPDTSSADARKGRDIQGIPWEQINITRKKYRQSRLEQYKNYENVPNSGEEAMKDCKPTEKGGIYYEFRRNTRSVKSTILHFQLRNLVWATSKHDIYLVSXYSIRHWSALRGVDTXVAPSEKHSGSLSEGSIYXYKISTLAVKXDLLTAWAGLHGAVMCKNLAGECYFILXEINFCCRSTYDYNAITNXVGVFNSSRGAVHFMASINYSGVRYYDMERFQLFKHFQFEWPVNHASLSPDRKVVVIVGDDPDGLLIDANSGKTVHSIKGHRDYSFASAWSPDGRTFATGNQDKTCRIWDVRNLSKSVHVLRGNLGAIRSIRFTSDGQFMSMAEPADFVHIYDVKSDYNKRQELDFFGEISGTSFSPDTDTLFVGVWDRMYGSLLQFGRLYNYSYLDSLF

SEQ ID NO: 6586 - protein, 260 aa, Zea mays
  misc_feature (66)..(66): Xaa can be any naturally occurring amino acid
MATVSLTPQAVFSTESGGALASATILRFPPNFVRQLSTKARRNCSNIGVAQIVAAAWSDCPAAASXAADVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVPAGGHIVTTTDCYRKTRIYMENELPKRGISMTVHILLNGSQLVFGTGYLLSLLTVFLSLCYSSAFTVNFLSS

SEQ ID NO: 6587 - protein, 64 aa, Zea mays
  misc_feature (20)..(20): Xaa can be any naturally occurring amino acid
  misc_feature (44)..(44): Xaa can be any naturally occurring amino acid
VFVWVNLLGLLVQRVFFYAXKAFHNQQIDRIGLYEPLGGSLGEXVPLKSNIQMENLLDWSIGQG

SEQ ID NO: 6588 - protein, 157 aa, Zea mays
LTLKALTRDFSPLPTRVNLSNPYNPPLPIFEVTYPLGGPGKKVGSGPIRAPGWFPPKGSPPLEIPPKVPYDFLVSLVREVARDWDIDSELQVGLPVALPIVGNFPIPLSPFGGFKPPPPKAFFFFSRSSLPFFFVGGGPTPPPPQFFQKKNPAPFFF

SEQ ID NO: 6589 - protein, 126 aa, Zea mays
MRPPARGGRGGRGGRFDGGRGFGGGRGGRGDRGGRGGRTPRGGRGGGGRGGRGGGMKGGSKAVVVAHKHAGVFISKSKEDALCTKNMVPGESVYGEKRVSVQNEDGTKVEYRVWNPFRSKLAAAVL

SEQ ID NO: 6590 - protein, 78 aa, Zea mays
  misc_feature (12)..(12): Xaa can be any naturally occurring amino acid
RKNHKLSVLNKXKKEWGEYKEKTRGLEKELHSYKKSLNQYLDKQSFLQGTDYPKFERERNARLSMMTKRRTNMREASV

SEQ ID NO: 6591 - protein, 74 aa, Zea mays
  misc_feature (28)..(28): Xaa can be any naturally occurring amino acid
MIEVVLNDRLGKKVRVKCNEDDTIGDLXKKLVAAQTGTRPEKIRIQKWYNIYKDHITLKDYEIHDGMGLELYYN

SEQ ID NO: 6592 - protein, 278 aa, Zea mays
MSHASPQVVYNNSEKKRSCCWDGCIYAGTPLPAATTGWVVVKPGRCGWLVQRRQAAVRAMSAAAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAASIISAEQGEELRKQIGAVAYIECSSKTQRNVKAVFDTAIKVVLQPPRRREVTTKKMKTSSNQSLRRYLCGSGCFTS

SEQ ID NO: 6593 - protein, 117 aa, Zea mays
  misc_feature (50)..(50): Xaa can be any naturally occurring amino acid
  misc_feature (79)..(79): Xaa can be any naturally occurring amino acid
VRKVLVLQLRFIGFLRSYREASAGIADPDDDIAWKEPLFLIRLNLDQRIXLNLQCDQELQRRLHAYDQHLKIILKDVQXSYTTVEIDEEKYEHLVRPKQRTIPLLFDRRDGVILHSP

SEQ ID NO: 6594 - protein, 93 aa, Zea mays
MPGSHGRPLAIDGLGRPPPVDPFQGLKCTASLPDSARSFISLGNVSNGGRILCMQVWPDYGTKKFQTLSYLPQLTTEDLLKQMDSLLCNRWIP

SEQ ID NO: 6595 - protein, 80 aa, Zea mays
  misc_feature (11)..(11): Xaa can be any naturally occurring amino acid
TRLKKEQDDIXVDINKYHKKLLPYPEIVVYPVDTIMLKLGGLYVLALELSENETSASYALRALLDGLLAPGSLTAQKKKI

SEQ ID NO: 6596 - protein, 159 aa, Zea mays
  misc_feature (46)..(46): Xaa can be any naturally occurring amino acid
  misc_feature (53)..(53): Xaa can be any naturally occurring amino acid
  misc_feature (83)..(83): Xaa can be any naturally occurring amino acid
GSSLVEHDKLELATSVLIKGQENGVCLMLPFDLDDADKLGPDASSXTFQVGPXLKLSDACMGLDLRPYPMSGLSCGLQSTQTXSWNGPMAALEFDRLADATSAMAKKLSQLSGTAFTTIVGGGDSIGAADIVGVCHSMTHISTGGCASLELLDGNELPR

SEQ ID NO: 6597 - protein, 536 aa, Zea mays
  misc_feature (14)..(14): Xaa can be any naturally occurring amino acid
  misc_feature (90)..(90): Xaa can be any naturally occurring amino acid
  misc_feature (125)..(125): Xaa can be any naturally occurring amino acid
  misc_feature (201)..(201): Xaa can be any naturally occurring amino acid
  misc_feature (243)..(243): Xaa can be any naturally occurring amino acid
  misc_feature (431)..(431): Xaa can be any naturally occurring amino acid
MHSTNLLLEEPIRXMASILEPSKPSYFPAMTKIVGTLGPKSRSVDTISACLKAGMSVARFDFSWGDAAYHQETLENLKLSIKSTKKLCAXVMLDTVGPELQVVNKSETPISLEENGTVVLTPHRXQDASSSLLPINFSGLAKNCSLQAVTPGATIFVGQYLFTGSETTSVWLEVSEVKGDDVVCIIKNTATLAGSLFTLHXSQIHIDLPTLSDEDKDVIRKWGTPNKIDFLSLSYTRHAEDVXRQAREFLSKLGDLSQTLIFAKIENVEGLNQFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKQTVKYVGEPMTHLESIASSAVRAAIKVKASVIICFTSSGRGXQGLIAKYRPTMPVLSVVIPRLKTNQLRWSFTGAFEARQSLIVRGLFPMLADPRHPAESTSNTNESVLKVALDHGKACGVIKSHDRVVVCQKVGDSSVVKIIELDD

SEQ ID NO: 6598 - protein, 106 aa, Zea mays
MHQLYSVHIDAKGEDLRQRVEEVLGGGRQVYVAGVGVNRALLESLKEKCIVHYLDEFEDLWGTDSKWFLEMKRLNGGVPVEFDGYMRDVVDREVFLKGKKKVEVLR

SEQ ID NO: 6599 - protein, 285 aa, Zea mays
  misc_feature (86)..(86): Xaa can be any naturally occurring amino acid
  misc_feature (136)..(136): Xaa can be any naturally occurring amino acid
  misc_feature (244)..(244): Xaa can be any naturally occurring amino acid
ILDLFRFSLVGRISFWFVFISASNNGCDERKGIGVNGGRNMNSLKRKRENPAAYDADIFHNSELHQHPVNDSAVRFHVDKDRKAKXIVCHFNKQVLQSYKNFMSSAPPKRILLRIGAVWKDFPEKIVKLAQADFRXKKTITETGYQNQLFLLDFAHMTFIDTKTGLQRPIAWIDENGNRYFPESFVQDQKIFMKKDFGNGYHDYISVESNGTREMNDQLGTSESSAESSNFGSSTEDVSSPKRXARAENNSIIKKYCDLGEAIGENEACTLLPTACNLLPRQANL

SEQ ID NO: 6600 - protein, 409 aa, Zea mays
MSTEDEKLLKEAKKLPWDERLQHKNWKVRNDANIDLAALCDSITDPKDARLREFGPLFRKTVADSNAPVQEKALDALLAFQRAADADASRYAREVCDSIVAKCLTGRPKTVEKAQAAFLLWVELEASEVFLEAMEKAVKNKVAKAVVPAIDVMFQALSEFGTKVVPPKKILKMLPELFDHPDQNVRASSKGLTLELCRWIGKDPVKSILFEKMRDTMKKELEAELANVSGLAKPTRKIRSEQEKELEEESVPETSGANTSEEAATDAPVEIDEYDLVDPVDILTPLEKSGFWDGVKATKWSERRDAVAELTKLGSAKKIAPGDFHEICRTLKKLITDVNLAVSVEATQAIGNLARGLRAQFSGNARMLLPVLLEKLKEKKPTMTEALSQTLQAMHKSGCFTLIDVIEGL

SEQ ID NO: 6601 - protein, 176 aa, Zea mays
VRPLEAGRVQIGLVDSGPAGKRRRRESSIARSPPSPSHSPSRGSRAPLPQTKSRRLKLAPYAQANLTWAQHAFNEKVAEVWRVAVDAFERLKGRWACLQKRTEVKLQDLPVVLGACCVLHNICESRGEGMDPALRCDIDDDETVPENPVRSDGATKARDDIAHNLLHSGRAGTKFF

SEQ ID NO: 6602 - protein, 136 aa, Zea mays
FSLFFLFFTIFFVWFKITPTINPPPSIKKNTPNNTPALTINTTIDNTNQPNENYHKPCLINNTNKLPNLNVKCNQPHLNYYLTPFLLFLYISDCIEYLDKNYLIPIKNNNNPAMMDIIIDVELATRLLHKEFIWPV

SEQ ID NO: 6603 - protein, 114 aa, Zea mays
  misc_feature (28)..(28): Xaa can be any naturally occurring amino acid
  misc_feature (94)..(94): Xaa can be any naturally occurring amino acid
  misc_feature (106)..(106): Xaa can be any naturally occurring amino acid
LGSYTIRPPADIVVFIFCKESKALGEGXKNSNKKLTAWFKKYPPNSAPVLFINATIEKTKRRFENYSKFCLLCGADSLPYHIGSFDHVNWGEFXTPGLLLLYIVRXIGWVGRSY

SEQ ID NO: 6604 - protein, 110 aa, Zea mays
SSDGYWFVAYVPSPVRHSGSPVPVLNESGAKSTSRQAPAEQVQPVAAAPQAGEDDDDDDDDDDDDDVDLDLGDDDDDDDDDDDGTAADDDDDDDDDEDYFERFFDDILGA

SEQ ID NO: 6605 - protein, 119 aa, Zea mays
TFYLFCLQEPQPIDWEYYRKGIGSKVVDMYKEAFESIEIPKYVDTVTPQYKPKFDAVIAELKEAEKEHQKESERIEKELAEMEEMRKKISTMTADDYFEKYPELRKKFDDEIRNDNWGY

SEQ ID NO: 6606 - protein, 264 aa, Zea mays
MASTSSAGDVGDSGSKGAVADKTLTASANTSSSHQESHDVDAKSRVEDIWKKMNSGFPNKMPKPAMTKLSTTEKQKKNKPTNNWMTVLGLSPSKAHSVDQGSKNGLQQTQHEMSEDAKKLAAKALAAAKNAAAVASGRGKVEITEVRDFAGKDIEIKKLVDANSKEAIEKARAGGAAPSAVDNILEQIRKKQKLSVLDKTKKDWGEYKEENRGLGEELDAYKKSSNQYLDKQSFLQRTDYREFERERDARLSMMAKRRTDTRED

SEQ ID NO: 6607 - protein, 91 aa, Zea mays
MAVSFLLVPAVSIEMCVGSLILFMWNRADKKDAQVFARVLASGLICGDGLFSIPYALLARYNVTPPICVRFIGRVQNKMLDDYMEKVAASQ

SEQ ID NO: 6608 - protein, 292 aa, Zea mays
GYRPGGLGSLLWSYFHWFYTGGPGWGFTAFPTFGLTAYKHGFYINMNGTYVGVGMISPYLINISMLVGSIISWGIMWPYLLTKKGIWYDANLQETSLKGLNGYKVFSAIGMILGDGILQLVVISLKTVHTMRHHQLAAETIRSFSNVDSMPRPVLSFDDRRRTHVFLREHIPSTFAISGYVVLAALSSAAIPLIYKQVRFYHVAAAYAFAPLLAFCNAYGTGVAETNFSAQYNKLVILLFASWIGARNGGIVGSLVICGVVSAVVSTASDFMSDFKTGYLTLTSPRATLLSQ

SEQ ID NO: 6609 - protein, 546 aa, Zea mays
  misc_feature (138)..(138): Xaa can be any naturally occurring amino acid
  misc_feature (300)..(300): Xaa can be any naturally occurring amino acid
MACNLAQCATAAAATVAPRTPRPAASASVSFSARKPAGGSLRLQRQACCEPSVAPSRAVFACRAAASGSAADLASGGRRSSGVPVFVMMPLDTVKECGTALHRRKAVQASLSALKSAGVEGVMVDVWWGIAERDGPGXRYNFAGYAELMEMARKAGLKVQAVMSFHQCGGNVGDSVSIPLPRWAAEEMERDQDLCYTDQWGRRNYEYVSLGCDAMPVLKGRTPVECYTDFMRAFRDHFADYLGNTIVEIQVGMGPAGELRYPSYPESNGTWKFPGIGAFQCNDRYMRSRLKAAAEAAGKXPEWGHGGPTDAGGYNNWPEDTVFFRGDNGGWSTEYGDFFLSWYSQMLLEHGDRILSGATSVFGAAPVEVSVKVAGIHWHYGSRSHAPELTAGYYNTRRHDGYLTIARLLARHGAVLNFTCVEMRDHEQPQEARCMPEALVRQVGAAARAAGVGLAGENALPRYDGTAHDQVVTTAAERAAEDRMVAFTYLRMGPDLFHPDNWRRFAAFVRRMNGAGSCREAAEREAHGVAQATGSLVHEAAVALRS

SEQ ID NO: 6610 - protein, 229 aa, Zea mays
SLGRLGSSRPAGIIYSFTDRFAGGWSASHYPPPRRSGLISPRPASAILCLDRSVVRQVSKLYIYIYIYIYRRFFERASSEMGSAVLFYCICIAAVVALSSSMVAVGSAAPGETPKFISASALECSANVTEIAKARKLIDVHGHGLCPVRFDHTRGISAVASSCKDRPLPSPERCCGALKAYACPYSELINDNANNGCASEMFYVIMTRGRLRPGLFSQLCVEGPLGLQC

SEQ ID NO: 6611 - protein, 219 aa, Zea mays
MRAAWAGKDSGVVAGLVGCGLVKSLVSISADLMHDFKTGHLTLTSPRSMIIAQAIGTAMGCVIGPLTFLLFYKAFDIGNPDGYWKAPYALIYRNMAILGVQGFSALPLHCLQLCYGFFGFAVAANLMRDLLPPKYGKWVPLPMAMGVPFLVGASFAIDMCVGSLMVFIWHIIDRSKASLMVPAVASGLICGDGLWIFPESLLALAKISPPLCMAFRSSH

SEQ ID NO: 6612 - protein, 526 aa, Zea mays
  misc_feature (258)..(258): Xaa can be any naturally occurring amino acid
MESFPRSNRLVTTHESRKQTMPPYLLAAGALIVFLYIIKNRRSRKLPPSPPSLPLIGHLHLIGRVAHRSLLELQVRYGGGGGLLFLQLGRRPTLVVSTAAAAADLFKNHDLAFASRPRSVGGDKLMYECSNVSFAPYGENWRRGKKIAVVHLLSPRRVESFAPVRAAEVAALVARTRRTAEAGEAVELRELLNGYANAVATRAATGAAGATAEKLKELMGNSEPEALMAGFQPEDVLPDAPARFVRWVTGLNKKLEDXWSRGDKFLSDIVAAHKEKGGGDAEEDEDFLDVLLRLREEGADGLELTDDRIKATVKDMIAAATETSSQTLEWTMAELIANPRVMSKLQGEIARVVSADQTTIAEPDLNKMEYLRAVFKEVLRLHPPAPLLVPHESTTPAVVQGYEIPAKTALFVNVWAIGRDPAVWDAPDEFRPERFVGGSPSVDFRGTDYQLIPFGAGRRICPGINFALPVLELALVSLLHHFEWELPAGVGKADLDVGEAPGMTTPRRIPLVLVPKCRTLVQPALQ

SEQ ID NO: 6613 - protein, 61 aa, Zea mays
  misc_feature (23)..(23): Xaa can be any naturally occurring amino acid
FGSRDDPRVVFVTELREETGVTXLEVEVAATVWMTYDFPPDARANRKAQGGTDRTGQAEQW

SEQ ID NO: 6614 - protein, 139 aa, Zea mays
  misc_feature (29)..(29): Xaa can be any naturally occurring amino acid
  misc_feature (63)..(63): Xaa can be any naturally occurring amino acid
FCVRTVVEVGRRLDGTSVYRMKEDALSTXKNMGEVEYLYGEKRDFVQNEDGTKVKYKEWNPVXDASMAAAGLGCVDNIWIDTGTLEMYIGDVLCTTVCDVFRIVWSVSLVYASRLSNMSGRDLVLIAKMMSYVIAIIDD

SEQ ID NO: 6615 - protein, 525 aa, Zea mays
EARTNGAAAGLLPGALPLLPLLVVFYYFHMRSKRKNPFVPLDWPLVGMLPALLGNLHHLHDWITSLLVASQLSFLFTGPPRSGMQFFVTADPANVRHVFTSNFANYPKGPEFEEIFDVLGGGIFNADGESWRRQRAKAQLLMSSAPFRALVSRYSRAKVDTALLPLLSHMAATGEAFDLQDVFLRLTFDTTTTLVFGVDPGCLSVGLPEVPFARAMDDAMGVLLLRHVVPMTWWKLARRLRIGHERKMAEAWRTIDQFVADTIAKRRAEKARHGNEQVSADLLSSYINDDEGEDEEGGVDAFLRDTTINLMLAGRDTTGSALSWFFYLLTRNPRVVGKIRQELECVKSKSSGSGGGMASFDPDELSRLTYLHAALCESLRLYPPVPQELKEAAAADVLPCGHEVRAGDKILVSLYAMGRMEEVWGSDCREFRPERWIPELEDGRRVVQQVRYVPSYKFMSFNSGPRTCLGKDMAFVQLKAAAAAVVSNFDVEAVPGHVVEPMLSIILHMKNGFMATVKRRRQTFA

SEQ ID NO: 6616 - protein, 602 aa, Zea mays
MHALRLCPLLSTIRSTPPRATAAARQGALFVARCSSAGTPSAAQALKISSIPTKPVEGQKTGTSGLRKKVKVFQQENYLANWIQALFNSLPPEDYVGATLVLGGDGRYFNKEAAQIIIKIAAGNGVQKIIVGRNGLLSTPAVSAVIRKRKANGGFIMSASHNPGGPDNDWGIKFNYSSGQPAPETITDQIYGNTLSISEIKTADIPDTDLSSVGVVSYGDFAIEVIDPVSDYLELMENVFDFQLIKDLLSRPDFRFIFDAMHAITGAYAGPIFVEKLGADPDCILNGVPLEDFGNGHPDPNLTYAKELVFTMFGTHAPDFGAASDGDGDRNMILGKRFFITPSDSVAIIAANAQTAIPYFQFGTKGLARSMPTSGALDRVAEKLNVPFFEVPTGWKFFGNLMDAGKLSICGEESFGTGSDHIREKDGIWAVLAWLSILAHRNKDKKVGERLVSVEDIAMEHWKTYGRNFFSRYDYEACESHSANQMMDHLRDVMANSKPGEKYGNYTLQFADDFSYTDPVDGSTVSKQGLRFVFTDGSRIIFRLSGTGSAGATIRLYIEQFESDISKHSLDAQTALKPLIDLALSVSKLKDFTGREKPTVIT

SEQ ID NO: 6617 - protein, 340 aa, Zea mays
MTVGDDAAAPGRGQTVCVTGAGGYVGSWIVKLLLERGYAVRGTVRNPDDAKNAHLLALPGAAERLALCKADLLDYGALRAAVAGCHGVFHAASPVTDDPEEMVEPAVRGTRYVIDAAAEAGTVRRVVLTSSIGAVAMDPRREPDAVVDESCWSDLDFCKKTKNWYCYGKAVAERAAWEAAAARGVDLVVVVPVLVQGPALQPSVNASLMHVLKYLNGSAKTYANAVQAYVHVRDAADAHVRVFEAPRAAGRYICADAVLHREDVVRTLRKSFPGYPVPERCSDEVNPRKQPYKISNQRLRELGLEFTPAAQALYDTVVCFQEKGILPLPVPAPTPASPDA

SEQ ID NO: 6618 - protein, 152 aa, Zea mays
  misc_feature (54)..(54): Xaa can be any naturally occurring amino acid
  misc_feature (81)..(81): Xaa can be any naturally occurring amino acid
  misc_feature (92)..(92): Xaa can be any naturally occurring amino acid
CVFIASTDEVMVLLKKDGALVQQKKKDKVVRSRRHVNWNEKDRLKDRIMCCRAXHSVYMHNMCIRPTDHELENFGTPDVTXYNVGQILCNRXYIHYMTSTTSIDLNLPRREMVIMGTQDAREMKKGLFSVMHYLMPKRGILSLHSGCNMGKD

SEQ ID NO: 6619 - protein, 70 aa, Zea mays
  misc_feature (39)..(39): Xaa can be any naturally occurring amino acid
MIGERLTSRLPHWYLKISEVGAYIGAAMDLFMIHTGFYXKDTVLEAEKRVCENKPEGQAMREDLNQCRKH

SEQ ID NO: 6620 - protein, 130 aa, Zea mays
MEVPMNSTQSGPHFPVQHRSLSLDIKGNKTDIVISKYEDTFLVIVTQIGCMGTILAAKKDESVFSDPTYNVSVLFGRRNEPLLQACAHQLIEHISGSGSARSLVISLGLKDHSQVTLKDIIVAVIENRLW

SEQ ID NO: 6621 - protein, 499 aa, Zea mays
NSHHAPHLPAFSGAYSSAQVREVIESEMDQDSSDRDGASTIYEESESVSVGEVMKSPVFSEDESSENSFWVDLGQSPLGSDHSEQSSKGKLGSPLPASWFSGRKSAKKASPKVPSKLSRSPIHDNHVMSFDAAVRSVSQEPGPEKGDPDEDNSHINIKNTPISEIEEDNKDAKVNKRFVKFSCADDTAEGEGNATSVFGSCTARENGSTSEICSESQGETKDSAIRRENEGDFRLLGRREAYNGRFNGGRFFGVEESERVPSMGHNVSFTLDDSKLCRNADAGETSGYGMADDDDDDAYSDYDEALDGRKEPEIICKHLDHVNMLGLSKTTLRLRYLINWLVTSLLQLRLPDSGDGEGVPLVYIYGPKIKYDRGAAVAFNIKDCNTGTSLINPETVQKLAEKEGLSLGVGFLSHIRLIDNQKHGAVDVGLSSSLPAANGRREKKNSKNAIIGTEVVTASLGFLTNFEDVYRLWAFAAKFLDSSFLEQERLSSIPEDTER

SEQ ID NO: 6622 - protein, 444 aa, Zea mays
PHIVSSMSQYGKLHGHEGCVNTVSFNPAGDLLVSGSDDTNIILWDWLSKTKKLVYPSGHQDNVFHARVMPFTDDSTIVTVAADGQVRVGRLKEGGEVTTKLVGEHDSRVHKMAIEPGNPYIFYSCGEDGLVQHFDLRSDSATKLFTCCSFLNDRRRVKLNSIVIDPQNPYYFSIGGSDEYARLYDMRKFQLDGSRNTNQPVDTFCPKHLIKGASARVHITSIAYSYAREILVSYNDELIYLFQHNIGLGPNPVSAEPEFFNMLDQPQAYRGHRNFRTVKGVSFFGQHDEYVVSGSDCGNVFIWRKKGGELIRMMNGDKSVVNCIEPHPHFPFMATSGIDNTVKLWTPAAKKLIMPLPKNAKQIIAANELERTVHISQATATLSSDVMMHVLRLLRRRDSEMNIENEPASADLASDDDEAFYFGFEDDAERNERENSDPRECNMT

SEQ ID NO: 6623 - protein, 331 aa, Zea mays
MATSTSQHALSSIKLLSTGCLHPDKRNCRVLSVSVGRRCPSARNLGLLCASNSQSSVIEPVQLPRSPKSGVAPKKSGESALILIRHGESLWNEKNLFTGCVDVPLTPKGVDEAIEAGKRICNIPVDVIYTSSLIRAQMTAMLAMMQHRRKKVPIILHNESEQAHMWSQIYSEETKKQSIPVITAWQLNERMYGELQGLNKQETADRFGKEQVHEWRRSYDIPPPNGESLEMCAERAVAYFKDQIIPKLVDGKHVMIAAHGNSLRSIIMHLDKLTSQEVISLELSTGIPMLYIFKEGKFIRRGSPAGPSEAGVYAYTKNLAQYRQKLDGIVQ

SEQ ID NO: 6624 - protein, 518 aa, Zea mays
  misc_feature (303)..(303): Xaa can be any naturally occurring amino acid
  misc_feature (371)..(371): Xaa can be any naturally occurring amino acid
  misc_feature (384)..(384): Xaa can be any naturally occurring amino acid
  misc_feature (418)..(418): Xaa can be any naturally occurring amino acid
  misc_feature (425)..(425): Xaa can be any naturally occurring amino acid
MAAANGDACRSVGGVPRPTNPMVTPLLTDLYQFTMAYAYWKAGKHLDRAVFDLYFRKNPFGGEFTIFGGLEECIRFIANFKFTEEEIKFLRSVMPACEDDFFEYLRSIYCSDVEVYAIPEGYAVFPKVPLMRIEGPVAVVQLLETPFLSLVNYASLVTTNAARHRLVAGKSKNLLEFGLRRAQGPDGGISASRYCYMGGFDATSNVAAGRLFGIPIRGTHSHAFVSSFMGLDEITDKTLTSSDGSNTCEDFISLVQNWLIRIQDSSSLHGTFGETSQSELAAFTSYALAFPNSFLALVDTYDXYKAVGIRLDSGDLAYLSVEARKFFHAVEKEFVVVGFGKTSITASNDLNEETIDALNKQVTYIVSIQNXDVVACRFLLQNRXEIMYIVISNILKFVLMICVIQCLDIMTGEDEPGXKIGERLXCRHPFNESKRAYVVPQHVEELLKCYWPGNSSNSREELPSIHEIRTRCIHHLDRMRPDHMRRLNPTPYKVSVSAKLYDFIHFLWLNEAPVGELQ

SEQ ID NO: 6625 - protein, 231 aa, Zea mays
  misc_feature (69)..(69): Xaa can be any naturally occurring amino acid
  misc_feature (98)..(98): Xaa can be any naturally occurring amino acid
  misc_feature (152)..(152): Xaa can be any naturally occurring amino acid
  misc_feature (181)..(181): Xaa can be any naturally occurring amino acid
MAALAAASTAAFAAKPRARLSVACSAATGDSSSVSLASSVKTFSAALALSSVLLSSAATSPPPAAAEAXDIAGLTPCKESKAFAKREKNSIKKLTASXLKKYAPDSAPALAINATIEKTKRRFENYGKFGLLCGADGLPHLIVSGDQRHWGXEFVTPGLLFLYIAGWIGWVGRSYLIAISXGEKKPAMREIIIDVELATRLLPRGFIWPVAAYRELINGDLVVDDKDIGYY

SEQ ID NO: 6626 - protein, 423 aa, Zea mays
  misc_feature (313)..(313): Xaa can be any naturally occurring amino acid
MATNGYSNGGSTKGKPIKCKAAVAWGPGEPLVMQEVEVAPPARMEVRVKVLYTSICHTDLSFWRGENERQRRFPRILGHEAAGVVESVGEGVEDLAPGDHVVPIFNGECGTCAYCHSSATNLCGTYRVDAFKSTMVSDDGTRFSVVNTSGDTVPVYHFLNTSTFAEYTVLDAACAVKINPAAPLQKMCLLSCGASSGVGAVWNTANVSAGSTVAIFGLGAVGLAVAEGARLRGAARIIGVDINPEKFTKGREMGVTDFVDSRASDKPVHEVIREMTHGGVDYSFECTGINGVLREAFVSTHDVLRSICLLASXLASPLNFSNVLRCATHMQGWGLTVVLGIHATPKMLPLHPMELFDGRRITACVFGDVKGKSQLPAIVDKCVNGDLDINLDGFITHRMPFSDINKAIQLLEEGKSLRCVLNL

SEQ ID NO: 6627 - protein, 324 aa, Zea mays
  misc_feature (201)..(201): Xaa can be any naturally occurring amino acid
  misc_feature (239)..(239): Xaa can be any naturally occurring amino acid
MRAVVITRGGGGPEVLEAQEVEDPAPLGDGEVLLQVVAAGVNRADTLQRHGRHPPPAGAPPPPPPPYPGLECSGTILALGPNAPPRWAVGDKVCALLSGGGYAEKVVVPAGQLLPVPEGVSLADAAGLPEVAAVVSAAAGLRGRSAASKAQIVSEVEKNVWPAVAAGKVNPVIYKTFPLSGAADAHRLIESSTHIGKILLXPLTPCPVSAVICQTLGESQLKRATNSCGGAGGTAAAGXEGVSLADAAGLPEVAAVVSAAAGLRGRSAASKAQIVSEVEKNVWPAVAAGKVNPVIYKTFPLSGAADAHRLIESSTHIGKILLLP

SEQ ID NO: 6628 - protein, 319 aa, Zea mays
MEPVRKSVCVTGAGGFVASELVKLLLSRGQYAVRGTVRDPGASKNAHLKVLEGAEERLQLLKADLMDYNSIASAVAGCEGVFHVASPVLSHRPSNPEVEVIAPAVIGTTNVLKACYEAKVRRVVVVSSCGAVYANPIYPKGKVFDEDCWSDEDYCRKKEDWYLVSKTLSEREALAFAAKTGLDVVTVCPSLVFGPLMQPTVNLSSEMILKYFKDLETVENVLSNMVDIRDVADALLLTYEKPEASGRYICSSHAIKISDMINILKTMYPSYPYPKNFVEDDVNSVYSSEKLQKLGWTFKPIEESLRDTVESYKAFGILN

SEQ ID NO: 6629 - protein, 81 aa, Zea mays
MQLLQNTLLAFLTTVVNLTVGWRNGIRGSALGPQFVAKPLAPDNPPLKVRFIDNIDPGGIDHQIAQLGSQLATSYSCNCHF

SEQ ID NO: 6630 - protein, 377 aa, Zea mays
APQLHAGRSSSVSLASSVKTFSAALALSSVLLSSAATSPPPAAADIAGLTPCKESKAFAKREKNSIKKLTASLKKYAPDSAPALAINATIEKTKRRFENYGKFGLLCGADGLPHLIVSGDQRHWGEFVTPGLLFLYIAGWIGWVGRSYLIASSTAAFAAKPRLPRARLTVACSATGGDGNGSSSSVSLASSVKTFSAALALSSVLLSSAATSPPPAAADIAGLTPCKESKAFAKREKNSIKKLTASLKKYAPDSAPALAINATIEKTKRRFENYGKFGLLCGADGLPHLIVSGDQRHWGEFVTPGLLFLYIAGWIGWVGRSYLIAISGEKKPAMREIIIDVELATRLLPRGFIWPVAAYRELINGDLVVDDKDIGYY

SEQ ID NO: 6631 - protein, 179 aa, Zea mays
CVISPVVFWIFYKAYDIGMEEGYPAPYAKIYRGIALLGVNGWNQLPKYCLRFCLAFFLLAVAICALKEVAKARRWWVQDYIPSALGMAVPFFLGSFFTIDMCVGSIVLYLWSKSDRVRAHMFAPAVASGLICGDGIWSLPSSILSLINVNPPMCLRVFSADTNYQVEEFLWTLRNPAAT

SEQ ID NO: 6632 - protein, 94 aa, Zea mays
  misc_feature (31)..(31): Xaa can be any naturally occurring amino acid
PNLDRDTSPDSLLMALNDKVGAGRYLYIATXWDENSEWFTETKELSNGQPVEFDGYMRIAVDTEVFLRGKRHVETFNELTRDCKDGVNTCSASS

SEQ ID NO: 6633 - protein, 173 aa, Zea mays
  misc_feature (32)..(32): Xaa can be any naturally occurring amino acid
  misc_feature (34)..(34): Xaa can be any naturally occurring amino acid
  misc_feature (42)..(42): Xaa can be any naturally occurring amino acid
  misc_feature (48)..(48): Xaa can be any naturally occurring amino acid
  misc_feature (50)..(50): Xaa can be any naturally occurring amino acid
  misc_feature (52)..(52): Xaa can be any naturally occurring amino acid
  misc_feature (60)..(60): Xaa can be any naturally occurring amino acid
  misc_feature (63)..(63): Xaa can be any naturally occurring amino acid
  misc_feature (65)..(65): Xaa can be any naturally occurring amino acid
  misc_feature (70)..(70): Xaa can be any naturally occurring amino acid
GYWKETSTVIRIIPYSAVQLFSYEVYKKIFRXKXMESFLYLXRLAAGXLXRXMTSTLVTXPTXMXSPAQXMLREKGLASFYGGLGPSLVAIAPYIAVNFCVFDLMKKSVPEKYKNRPETSLATALLSATFATLMCYPLDTVRRQMQMKGTPYNTVFDAIPVVDYAFQRATQRQ

SEQ ID NO: 6634 - protein, 393 aa, Zea mays
MAPTACLRTPFFPARARSTNATPFSPHRRFSLKCSASNGDNSNPNSISISPTSPPRLTVSDGVESVDVNGLRRPPAPASVPAARDPHWLPRPLTSADVMEVDGKGLKVAYQGCAGAYSEAAAKKAYPNCETVPCEHFDTAFQAVQNWVADRAVLPLENSLGGSIHRNYDLLLRHSLHIVGEVRLAVRHCLLANPGVKIENLKSAMSHPQALAQCEHTLTSLGIEHREAVDDTAGAAKIVAEHMLQDTGAIASSLAAKLYGLDVLAENIQDDKDNVTRFMMLAREPIIPRTDKPFKTSIVFSLEEGPGQLFKALAVFALRDINLTKIESRPHKERPLRVSDDCSSLLKNFDYLFYVDLEASMADPKTQNALGNLKEFATFLRVLGSYPTDVNEP

SEQ ID NO: 6635 - protein, 143 aa, Zea mays
MEVFGKSVIAEPSNVIFLSAILNTEGSNPSHKCDKRCQSERILGNMYRCKLTETTHICDKNCNQRILYDNHNSLCRVSGQLFPLSPLEQQAVRGIRRKHEVDSSEGCSFKRRRGAQLHPSPFERSYSAVSPIPSQVGDGMDMS

SEQ ID NO: 6636 - protein, 79 aa, Zea mays
LGKKVRVKSNEDDPIGALKKLVAAQTGTPPQKIPLQKWFNISKGPFPLKGYGVPPGMGLKLYSNLTPPPFSLLSGWFEF

SEQ ID NO: 6637 - protein, 252 aa, Zea mays
MMEPGAPYFGAMGSSASGAGGGFYQPFNSNLAGAGSSTGIQSFPCVRLRGLPFDCNDIDVCKFFVGLDIVDCLLVNKNGRFTGEAFVVFPTAMQAEFALHRNRQNMGRRYVEVFRCKKQEYYSAIANEVSQGGYFESEYRRSSPPPRPPKKPAEDKGSMEYTEVLKLRGLPYSATTEDIIKFFLEYELTEENVHIAIRSDGKATGEAFVEFPTAEVAKTAMCKDKMTIGTRYVELFPSTPEEASRARTRGRH

SEQ ID NO: 6638 - protein, 505 aa, Zea mays
MVLLELLIVGSTLVLSLYVRFWRSRNGPLRPVDWPIVGVLPALISMLHNLHHEVTVILAASGCNFKAQGPVGSGMRFFFTADPANVRHIFTSNHANYPKGEELAEIFDIVSGSILTVDGEACRQQRGMFQTVLSNQRVLELMFRCCRHKVVHDLLPFLARMESSGTPFDMQDLMTRLIFDLTATPIFGVDPGCLSTMMPSMHVSAAMDTVMEVGLLRHTVPTSCWKVMRQLNIGPERKLAVAHTLLHEFITEMMVKSKARCSDPAGEIAAMDIISGDPAYSSDAAMLRKILINYMIAGRDTVGTTLPWVFYNLAKDPRVVSGIREELAHIASLKASGTKNMVFFEPEETKDLVYLQAALFETLRLYPPGPFERKMVLADDVLPSGHRLCSGETILISIYSMGRMEALWGKDCDEYRPERWFTEDGAKLRYVPSHKFMAFNSGPRMCLGKDIAITQMKTIVAAVVWNFHLEMLEGQSIHPKLSCILQMKNGLKMKVKKRQEKRDLQ

SEQ ID NO: 6639 - protein, 380 aa, Zea mays
  misc_feature (12)..(12): Xaa can be any naturally occurring amino acid
MATAGKVIKCRXAAVTWEAGKPLSIEEVEVAPPQAMEVRIKILYTALCHTDVYFWEAKGQTPVFPRILGHEAGGIVESVGEGVTDVAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 6640 - protein, 106 aa, Zea mays
  misc_feature (47)..(47): Xaa can be any naturally occurring amino acid
FHTTKLTSSLFHDFSRIKLVTCNPWPTQNPLPQQVDPIKRSQTSQLXLWTSPQFPLDGAIIIVSPPLINTQVVPPPKKLHRSQPPPPLTCNLAEKKKSSLHCTFST

SEQ ID NO: 6641 - protein, 500 aa, Zea mays
MASGPPSPSGKPYSRKSHASSKAPSVPSFDAHNGQLLPTVTFSLPSTTTARRELRRRLSSELSQVRAAVKRLNSLPAPAPSSALSATDPSTPHPPYPPASKHKSKKGGGVPQPHLSAEARRKLYAPVFKTCAALLSRLMKHKHSWVFNKPVDASALGLHDYHTIITKPMDLGTVKSKLGAGQYKSPREFAGDVRLTFQNAMTYNPKGQDVHFMAEQLLNMFEEKWPEIEAEIAQLSPQPPTPSSAAPKKPKPKEIDNSRPLERSDSTVHAAGIEATPKTHTGRPQVLKKPKAREPNKRDMTFWEKQRLSNNLQDLPPEKLDNVVQIIKKRNLSLIPHDDEIEVDIDSFDVETLWELDRFVTNYRKSITKNKRKAELSAVRPDEADPDQEPEKVEHVRQGKADQDQIPAVQEPIPEPETVDVDPPKESAADDNERCRMLVDQVVLEALAVTRVHPLVIRTQIVHQQMVLMLGNHPERSIYKPDVDGGTGNHNTLVQERILA

SEQ ID NO: 6642 - protein, 498 aa, Zea mays
MMKPPAPAVPSPEPPRLAGGGRGPRGLRSLPALSYNTHRALVLGLTFLAYALYHASRKPPSIVKRELARSWPPFADPALLGATDVAFLTSYSLGMFVAGHLGDCLDLRRFLAFGMVTSGAAVALFGAGYFLGQHSLAFYVVAQVIAGLLQSTGWPSVVAIVGNWFSGRRRGLIMGIWNAHTSVGNITGSLVAAAMLGYGWGWSFVVPGGLIALGGVLVLFFLAPYPQYVGFGPSPIEEPVTDESTDGEDISAADGAGKDRRDAVGIFKALAIPGVVIFALCLFFAKLVAYTFLYWLPFYLSQTAIGDEHMSAASAGYLSVLFDVGGIVGGVLAGFISDQLNARATTAAVFMYLAIPSLFLFHAYGSTSKATNIGLMMISGLFVNGPYALITTAVSADLGTHKSLKGDSRALATVTAIIDGTGSLGAALGPFITGFISRKGWDLVFTMLALCALVAAVLLSSHVKTEIPQIIQKWRDRSTNAQNGNADPGVQPLLVDES

SEQ ID NO: 6643 - protein, 418 aa, Zea mays
MAFISSAAMKAAVAALLVFAAVSPAARAVAAEAEAKAKAVGGAPSVPAGSLDIAQLGAKGDGKSDSTPMVLKAWKHACEATGQQKIVIPKGNYLTGALDLVGPCKSSIIIRLDGNLLGTGDLNAYKRNWIEIQNVDNLSINGHGTIDGQGALVWNKNECQRSYNCKILPNSLVLDFVTNAQIRGITLLNSKFFHMNIFGSKNVVIDKVTIKAPGNSPNTDGIHIGDSSNVTISGTTIAVGDDCVSIGPGSKTIRVKGVKCGPGHGISVGSLGRYKDEKDVEDVKVTGCTLAGTTNGLRIKSYEDSKSSLKATKFLYQDVTMDNVSYPIIIDQKYCPNNICVKSGASKVAVNDVVFKNIHGTSNTPEAITLNCANNLPCQGVQLINVDIKYNRSDNKTMSVCKNAIGKSIGMAKELACV

SEQ ID NO: 6644 - protein, 385 aa, Zea mays
  misc_feature (66)..(66): Xaa can be any naturally occurring amino acid
  misc_feature (142)..(142): Xaa can be any naturally occurring amino acid
  misc_feature (165)..(165): Xaa can be any naturally occurring amino acid
  misc_feature (216)..(216): Xaa can be any naturally occurring amino acid
  misc_feature (239)..(239): Xaa can be any naturally occurring amino acid
  misc_feature (269)..(269): Xaa can be any naturally occurring amino acid
  misc_feature (289)..(289): Xaa can be any naturally occurring amino acid
  misc_feature (338)..(338): Xaa can be any naturally occurring amino acid
NSDPSHGPTTSIPFPSLPSCPAGSPARRLCPDPGDMPRYDDRYGGTRLYVGRLAPRTRSRDLEYLXFGKYGRLTVCGKYGRIREVELKRDYAFIEFSEHRDADEARYQLDGRDVDGSRIVVEFAKGVPRGPGGSREYMGRGXPPPGTGRCFNCGMDGHWARDCKXAGDWKNKCYRCGERGHIERNCQNSPRSVRRERSYSRSPSPRRGKRSQSKLXGRSRSRSRSRSYSRSRSLSGSPXGEARRDRDDRRSRSLSYSREPPCGSPPAKXKERSPTPGGSRSPRSRSPQXDQVMSPPPKDNGDRNGSDRGDSPRGRENSRSRSRSRSPSGGNRSPAANXGVARAPRGDRTPSPMADRSPSPKGNGNNDGGDDDTGRGGSPTGSKSP

SEQ ID NO: 6645 - protein, 333 aa, Zea mays
MAALLAGGGGGEGEHKEVRGRLAAAYERHIAPAVKLDVCAREATPGGQQAASRRASKAASEWTTGWWTQFAVLVQRGLKERRHESFNKLRVFQVLSVAALAGLLWWRTPASHLQDRTALVFFFSVFWGFFPLYNAVFTFPLERPMLLKERASGMYRLSSYVASRAATDLPMELGLPTAFVLILYWMGGLDPRPGPFLLSLAVVLYSVLVAQSLGLAIGAVLMDVKQGTTLASVITMVFLIAGGYYVQHIPPFVAWLRWLNYSFYCYRLLLGIQFPDGGGYYDCGHGALCPVAEFPAIKAVGLNNHWVDACVMALMLVGYRVVAYIALDRLKPR

SEQ ID NO: 6646 - protein, 258 aa, Zea mays
  misc_feature (202)..(202): Xaa can be any naturally occurring amino acid
MAKEFPVPPVVFTPSTPTHRRHPPPGMGASPPPAFAPPRPSTSSAANPLPFMSFDVSAAAASSSSAPPLFAGPIGVAGSGASFEDEPPLLEELGINTRQIWRKTISILHPFRSTDPSLHADADLSGPFLFLLSFGLFQLLAGKFHFGIVLGWVTVASLFLYFVFSMLSGGRRGDLDLYRCVSLVGYCMLPMVIFSAVSLFLXRGGGLIFGVGMAFVIWSARVCTRLLAELASSGDEHRGLIAYACWLVYMLFSLLVIF

SEQ ID NO: 6647 - protein, 436 aa, Zea mays
  misc_feature (21)..(21): Xaa can be any naturally occurring amino acid
  misc_feature (133)..(133): Xaa can be any naturally occurring amino acid
MATAVSGRWTSVRTLGRGASXGAVVSLAADAASGALFAVKSAPAGAAEQLRREGSILSSLRSPHVVPCLGHRPAADGGWQLLLEFAPGGSLADVAARSGGGRIGDERAVAAYAADVARGLAYLHGRSVVHGDXKARNVVVGADGRAKLADFGCARAVGSGRPVGGTPAFMAPEVARGEEQGPAADVWALGCTVVEMATGRAPWSDVDSLPAAVHRIGYTDAVPDAPGWMSAEAKDFLARCFARNPRDRWTAAQLLEHPFLASAGRGVKAEEDAAASPTSTLDAAVWEPDSDDEGDASESPAQRIKALACPCSVLPDWDSDEGDWIEVLDEQCEATNLVPVPTKKAAGDDECQLPSVALETGVDFIDADAEGEDPGCCVAVGYDPGCCVAVGLTTALSVGLLEEQCMGDYSNPTVFLAYSIEISKTSLLRKKKKKST

SEQ ID NO: 6648 - protein, 462 aa, Zea mays
MTKDEEFKLVKIQNHALKVNIHCDGCKHKVKKLLQKIEGVYSVAIDVDNHKVSVTGDVDSETLIRKLTRGGKHAELWSQPKGGGNQGHKGNNGQQQKQQQPQNQNQNHQQKQKQGANLSKDGHNKNSNGGQKDQGKQGGGGGAGGLMQGLKAFKNQHGNKHQLPELSSDDDDLYDDDDEEEFDDDYEEELRFLGDKMSQLGFHGNNQNKNGNNAAVNSNHSNGNGKKGNGGGGANNHHQNNNHHHHQNQKNVNVINMAAANAKMGGGGGGGVQNHQKNAAAINMAAAAAANAKMANGAQRNAGAMGGMLGLSHGLGAAAGAAPPGFQGYAAGFNHPSSYAAAGYGGGLQQQHLQHQQQQQQSNNLMASMQGYHHHHPAATAAMMSNLRGLNGNVMMMHQQPQQHQQPQMMYHSSPQISPYTGYYNPYNYYYHPHPGSAGYPPSNGDVETMFSDENTKGCVVM

SEQ ID NO: 6649 - protein, 140 aa, Zea mays
MWIEGGINPQLVKIHLNPHGLSTKRKGLTGFIIFANLFCNMQMQSFIIFSYVLTCMLVLFHLQGALALSGMPDAQSKPVLLCSLNDNTVRLYDLPSFSDRGRLFSKKEIRAIQMGPGGLFFTGDGTGELKVWQWVDLAQT

SEQ ID NO: 6650 - protein, 155 aa, Zea mays
  misc_feature (4)..(4): Xaa can be any naturally occurring amino acid
  misc_feature (7)..(7): Xaa can be any naturally occurring amino acid
  misc_feature (14)..(14): Xaa can be any naturally occurring amino acid
  misc_feature (23)..(23): Xaa can be any naturally occurring amino acid
  misc_feature (27)..(27): Xaa can be any naturally occurring amino acid
  misc_feature (53)..(53): Xaa can be any naturally occurring amino acid
  misc_feature (62)..(62): Xaa can be any naturally occurring amino acid
  misc_feature (71)..(71): Xaa can be any naturally occurring amino acid
KAIXLLXLGTAMAXAFADPLVDXVHGXSDATSIPSFFISFIAMPLATNSSEAXSAIIFASRXKQRTLSLTXFEVYGAVTMNNTLCLAVFLGLVYVRGLTWDFSSEVLIIFSVCTIMGLFTSFRTDFPLWTCVVAYLLYPLSLVVVYVLDFKFGWS

SEQ ID NO: 6651 - protein, 279 aa, Zea mays
MPTASGRRELPWTRPLRLAVVTRVLRLARDQLLACSSCGGGTAARRRYRRLGPPASDSAGRVLSPVDRDDDCAADAEAAAPRDPAEDKNDVVGLMVRLLGDCQIGKTSFMVKYVGDDGEEQNGLQMTGLNLMDKTMPVRGARIAYSIWDVAGDHQSVDHVPIACKDAVAILYMFDLTSRCTLNNIVDWYGRARKWNKTAIPILIGTKFDDFAQLPLEMQWAIVNQARAYARAMKATLFFSSATHNINVNKIFKFITAKLFNLPWTVERNLTIGEPIIDF

SEQ ID NO: 6652 - protein, 181 aa, Zea mays
ANLSNHARILEYLNVPASEYALVFTVSRGSAFRLLAECYPFETNRRLLTMFDHESQSVNWMAQSARAKGAKTRTAWFRWPTLKLCSTELRKEIVGKKKGRRRDAAVGLFVFPAQSRVTGAKYSYQWMALAQQNGWHVMLDAGALGPKDMDSLGLSLFRPDFIITSFYRVFGADPTGFGCLL

SEQ ID NO: 6653 - protein, 257 aa, Zea mays
  misc_feature (33)..(33): Xaa can be any naturally occurring amino acid
  misc_feature (214)..(214): Xaa can be any naturally occurring amino acid
  misc_feature (226)..(226): Xaa can be any naturally occurring amino acid
  misc_feature (231)..(231): Xaa can be any naturally occurring amino acid
  misc_feature (249)..(249): Xaa can be any naturally occurring amino acid
RPRRPPRRRHLHVLLTLSPPRSSYKTPQPRPRXPWREQLTVRGVAVAAALGALLCVVIHRLNLTVGVIPALNVASGLLAFFLAAAWRAAAGWLGFGRGPPFTRQENTVIQTCAIACAGLAFSGCSASYIFAMDRKTYELVGPDYPGNRAEDVKDPSLGWMISFLFLIALVGPFSIVLLRKVMVIDYKLAFPGGTATALMINSLHGKTDGDLAGXGNRKKLHCLVKXMGISXVWSFFKWFFSGVGDSCGXDNFPTFGL

SEQ ID NO: 6654 - protein, 273 aa, Zea mays
MEAQYQVGEEVIQAWYMDDSEEDDGDWENDENLKIIREARGYAYLDVGGDRAQEHSRSRRKFEDEEQLHCGRTSGMEGQFQVGKEEVIQAWYMDDSEEDQRLPHHREPKEFIPLDKLSELGILSWRLNADDWENDENLKKIREARGYSYMDICDVCPEKLPNYEAKIKNFFEEHLHTDEEIRYCLEGSGYFDVRDQDDQWIRVAVKKGGMIVLPAGMYHRFTLDSDNYIKAMRLFVGEPVWTPYNRPHDHLPARKEYVEKIINRGGNQAVEAR

SEQ ID NO: 6655 - protein, 364 aa, Zea mays
  misc_feature (207)..(207): Xaa can be any naturally occurring amino acid
MRDAVAKREAMKGGASSKGPVVVTGASGFVGSWLVMKLLQAGYTVRATVRDPENVGKTKPLLDLPGATERLSIWKADMADEDSFDEAIRGCTGVFHVATPTDFESKDPENEVIKPTVEGMIRILRACKEAGTVRRIVFTSSAGTVCVEERRRPVYDHDNWSDVDFCRRVKMTGWMYFVSKSLAEKAAMAYAAEHGLDLVSVIPTLVXVGPFLSAAMPPSLVTALALVTGNEAHYSILKQVQFVHLDDLCDAEIFLFEHPAAAGRYVCSSHDATIHGLAAMLRDRYPEYDIPQKLRGIEDDLQPVHFSSKKLLDHGFTFRYTVEDMFDAGIRTCREKGLIPLATAGGVGSASLRTPGETDVTNGA

SEQ ID NO: 6656 - protein, 354 aa, Zea mays
MAPLGDGGAVAAAASNNLVVSFGEMLIDFVPDVAGLSLAESGGFVKAPGGAPANVACAIAKLGGSSAFVGKLGDDEFGHMLVNILKQNNVNSEGCLFDKHARTALAFVTLKHDGEREFMFYRNPSADMLLTEAELDLGLVRRAKVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAVPPRHCPPPPRPSSSTSSVSVH

SEQ ID NO: 6657 - protein, 430 aa, Zea mays
MVQIAAVKRMKGRAPLSVVVAIIGGLALAGVIFTDDLRSLTEIMEKKGKAKEHKRTTSLHAGTRTRTRKMPLTPPPPPQPAKAAFDPSRCSVTEGYWAYNRSKELLYTDQTCPFIDRQVSCQRNGRPDSDYLRWDWHLDDCSLPRFDPVALLETLRGKRMMFVGDSLQMGQWLSMVCLVNSAVPYTARSMERSTTLSVFTATEYNATIEFYWAPYLVEANSDRNIRLGADGRVLHVDAVELHARHWKGVDILVFDSYVWWMTGSRIKSVWGSFGDDGYEELDAWVAFRLGLKTWANWVDANIDPNATRVFFMSISTTHMRSEDWGREGGIRCHNETWPVTRKGYWGSGADRRMMEVMSDVVGRMRVPVTLLNVTQLTEHRVDAHVSVYTETGGELLTDAQRADPQTHTDCIHWCVPGVPDTWNQILYAHL

SEQ ID NO: 6658 - protein, 183 aa, Zea mays
  misc_feature (156)..(156): Xaa can be any naturally occurring amino acid
TRAEVADVSEAVRQRADALMLSGESAMGRYPDKALSVLRSVSLRIEKWWREEKRHEALELRSVSSSFSDKISEEICNSAAKMANGLGVDAVFVFTKTGHMASLLSRCRPDCPVFAFTTSTSVRRRLNLQWGLIPFRLAFSDDMESNLNRTFSLLKXARGMIQSGDLVIALSDMLQSIQVMNVP

SEQ ID NO: 6659 - protein, 496 aa, Zea mays
  misc_feature (462)..(462): Xaa can be any naturally occurring amino acid
MCAYHMRLTGGAAFVLLMVLLLLLYAVHRWRNPRCSGRLPPGSMGLPLVGETLQFFSPEASLDVPRFVRHRLQRYGPIFKTSLVGHPVVVSADEELNYMVFQQEGQLFQSWYPDSFVEILGRDNVGEQQGAMFKYLKNMVLRYFGPESLRESMLRDVEHAVSSSLCTWSTLPSVELKEAVSTMVFDLSANKLLSLEPSRSKILRRSFFDFVRGLISFPLYLPGTAYYSCMKGRQSAMEVLQEVLAERKRLVQVPGAGGGAMETIRRHGGDFLDLVIQEVTKEKPLVTDRMALDLMFVLLFASFHTTSLALTLAVKLLADHPRVLEELTVEHEAILNERNARHGSDGITWMEYKSMTFTSQVINETVRLANIAPGIFRKALKDIQFRGFTIPAGWGVMVCPPAVHLNPVIYPDPLIFNPTRFKDKPEINRGSRHFMAFGGGLRSCVGADFSKLQMSIFLHFLXVTRYRWRSLGGGKVVRNPGLEFPDGYHIQIRHWN

SEQ ID NO: 6660 - protein, 323 aa, Zea mays
MAAGRELVVSFGEMLIDFVPTVAGVSLAEAPAFLKAAGGAPANVAIAVSRLGGGAAFVGKLGDDEFGRMLAAILRDNGVDGGGVVFDAGARTALAFVTLRADGEREFMFYRNPSADMLLTADELNVGLIRRAAVFHYGSISLIAEPCRTAHLRAMEIAKEAGALLSYDPNLREALWPSREEARTQILSIWDQADIVKVSEVELEFLTGINSVEDDVVMKLWRPTMKLLLVTLGDQGCKYYTRDFHGAVPSFKVQQVDTTGAGDAFVGALLRRIVKDPSSLQDEKKLVESIKFANACGAITATKKGAIPSLPTETEVLQLIEKA

SEQ ID NO: 6661 - protein, 538 aa, Zea mays
IGPDYPGNRAVDVKTPSLGWMIGFMFVVSFLGLFSLVALRKVMVIDYKLTYPSGTATAMLINSFHTTTGAELADKQVRCLGKYLSISFIWNCFKWFFSGVGDSCGFDNFPSLGLAAFKNTFYFDFSPTYIGCGLICPHIVNCSTLLGAIISWGILWPYISTKAGDWYPADLGSNDFKGLYGYKVFISVSVILGDGLYNLIKIIYATIKEIMNARAKQGRLPLAQVQDGDEGSNLSAEEKHLNETFIKDSIPPWLAGSGYIGLAAISIATVPMIFPQIKWYLVLSAYVVAPLLAFCNSYGTGLTDWNLASTYGKIGLFIFASWVGQNGGVIAGLAACGVMMSIVSTAADLMQDFKTGYLTLSSPRSMFVSQLIGTALGCVIAPLTFWLYWSAFDIGNPDGAFKAPYAVIFREMSILGVEGFSALPQHCLAICSFFFIASLVINLLRDVTPKNVSRFIPIPMAMAIPFYIGAYFAIDMFVGTVILFVWERVNRKECDDFAGAVASGLICGDGIWTVPSAILSILRIDPPICMYFKPSLSS

SEQ ID NO: 6662 - protein, 267 aa, Zea mays
MYSNYGNPSGMQMPPQNSQPVQFDNPLYGASSGLIRSGIGVYGEKFLGSSSEFMQSNINRYFSNPQYYFHVNDQYVRNKLKVILFPFFHRGHWTRISEPVGGRLSYKPPIYDINAPDLYIPFMAFGSFIILSGFTLGFMGKFTPAAINLQFTRALIGWGFQLMVLKGLLYSMGGGEVPLLDLVAYGGYLFAGLSLAVVARLMWAYSYYVMMPWMSLCMGVFLVRTMKRVLFTEMRSSERHSSRQHYFLLFMAIAQFPLFFWLGSIGA

SEQ ID NO: 6663 - protein, 536 aa, Zea mays
RKELELPVCRSPCITPGRAAGTSSRCRRPPPAEGRVIPHSGPLSKKSGARKSARFAESVSAPLSAPPPRASANNNNNNDDDDYVEITLDVRDDSVAVHSVKPAHGGGAGAGAGAGGDDPDVTLLARTLESRRSSSYGHSVIRNASSRIKQVSQELRRIASINRRGAAGPRIDRSKSAAAHALKGLKFISKAEGAAGWEAVERRFDKLAENGLLHRSKFGQCIGEGMKEPEFAGELFDALSRRRNISGDSISKAELLEFWDQISDTSFDGRLQTFFDMVDKDADGRITEEEVKEIITLSASANKLSKITDQAEEYARLIMEELDPGNLGYIELYNLEMLLLQAPSQSVRIGTTNSRNLSQMLSQSLRPTAEPNPLRRWYRRAQYFLEDNWRRVWVMLLWLCICAGLFAWKFIQYRQRYVFQVMGYCVCVAKGGAETLKFNMALILLPVCRNTITWIRNRTAGVGRVVPFDDNLNFHKVVAVGIAVGAGLHIISHLTCDFPRLLHATDAEYAPLGQYFGVPRPPNYWWFVRGTEGWTG

SEQ ID NO: 6664 - protein, 544 aa, Zea mays
LLSLRSNNLSGPLPADLLRLPALAGLHLHRNAFSGALPPGLAGLAALQALDLSSNGFGGGIPGALTSLTRLVALDLSNNSLSGRVPDLGLPALQFLNLSNNRLDGPVPPSLLRFADAAFAGNDLTRPPAAAPPAAAAPAARTRRVRLSEAAILAVAVGGCVLAFAVAAVLLLAFCNREGRDDDDDDTGGAGGKGGEKKGRESPESKAVIGKAGEGNRMVFFEGPALAFDLEDLLRASAEVLGKGAFGTAYRAVLEDATTVVVKRLSKEVSAGRRDFEQQMELVGRIRHRNVVELRAYYYSKDEKLLVYDYYASGSVSNMLHGKRGEERTPLDWETRWKIALGAARGVAHVHAENNGRFVHGNIKASNVFVNRDGYGCISDLGLAQLANPIAARSRSLGYCAPEVADTRKASQASDVYSLGVLVLELLTGRSPVQVSGGRGSEVVHLVRWVQSVVREEWTAEVFDGALLRVPDIEEEMVEMLQIAMACVSRTPDRRPKVADVVRTVEEVRRSGTGTRPPSPPATAADADQSEMESSSSAAAAAAQ

SEQ ID NO: 6665 - protein, 323 aa, Zea mays
MAAGRELVVSFGEMLIDFVPTVAGVSLAEAPAFLKAPGGAPANVAIAVSRLGGGAAFVGKLGDDEFGRMLAAILRDNGVDDGGVVFDSGARTALAFVTLRADGEREFMFYRNPSADMLLTADELNVELIKRAAVFHYGSISLIAEPCRTAHLRAMEIAKEAGALLSYDPNLREALWPSREEARTQILSIWDQADIVKVSEVELEFLTGIDSVEDDVVMKLWRPTMKLLLVTLGDQGCKYYARDFHGAVPSFKVQQVDTTGAGDAFVGALLQRIVKDPSSLQDEKKLVESIKFANACGAITTTKKGAIPSLPTEAEVLQLIEKA

SEQ ID NO: 6666 - protein, 91 aa, Zea mays
NGGAELFPPVRRNSLEEAVQFFLSGGLPGIVFKAPGVFRPPPPVPKIKEAYLSLFTFGTFNPVPEAVFLPPPLGVNRVLLPLGPGIPQAVF

SEQ ID NO: 6667 - protein, 496 aa, Zea mays
MSEEATLEDTPTWIVASVCSVIVLISFVFERALHHLGKALERRRKTLYEALLKLKEELMLLGFVSLLLVVSQDLIQKICIDDSLMEHWMPCRGASATASAHYGVSSSSSSSAVGGGRRMLKGGGAAFGHCSSKGKVPLLSLHALEQVHIFIFVLAITQVVLSVATVLLGLLQMRIWMHWENTIQQEGSSAPKMIARVQKIRFIQDRCKGYEKAAWVIIWLRSFFKQFYGSVSNDDYIAMRLGFVMEHFRGHPKFNFYDYMIKALEKDFKRVVSIKWYYWIFVMIFLLLNVTGWHSYFWISLVPLALLLLIGTKLEHIINRLAYEVASKHAAGQGEGGIVVSPSDELFWFRSPRLVLVLIHFILFQNAFEFAYFFWTLAMFGANSCIMDSLGYSVSRIIICVVVQVLCSYSTLPLYAIVSHMGSSFKSAVFVDDVADNLRGWADGARRRVRRSATGVDASCLGTPAAAGRGWEGAAGWRLIAGRPSRPTQQPRSISF

SEQ ID NO: 6668 - protein, 308 aa, Zea mays
PRASWPEVTPMTSLAAADLALQAGIPAGALNVVMGNAPEIGDALLQSTQVRKITFTGSTAVGKKLMAESANTVKKVSLELGGNAPCIVFDDADIDVAVKGSLAAKFRNSGQTCVCANRILVQEGIYEKFASAFIKAVQSLKVGNGLEESTSQGPLINEAAVQKVEKFINDATSKGANVMLGGKRHSLGMSFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGVDEYLELKYICMGNLG

SEQ ID NO: 6669 - protein, 195 aa, Zea mays
  misc_feature (115)..(115): Xaa can be any naturally occurring amino acid
MSNSGRWRRRTRSVAPSPATSSPSSPGLREAQPSRLPQWKFSQVLGELPPAAEARRDGAPRPQDDDDADEISAIEFDGRGEYLAGGDNAGRVILFRRTDDDGDGDDARPRAELEXTDRAEAPPPRYSYATEFQSHERETSSRVNCIFDVLDSLDISERIKKVRWCARPNSSLLMLAANDRTVKLWKVSEHKAEAP

SEQ ID NO: 6670 - protein, 198 aa, Zea mays
  misc_feature (71)..(71): Xaa can be any naturally occurring amino acid
  misc_feature (97)..(97): Xaa can be any naturally occurring amino acid
LPQHNNAYLEPYQSYYHGTCIKQGHRLHFTTTGKSSCPCLEENWKRIWSMTLWLSICIGLSIWKLIQYRDXAVLHIMGYCVTTAKGAADTLKFNMAXLAFFPVCRNTITWIRSKTKIGAAVPFNDNIYFHKVISSGAVGGVVLHASAHLTCDFAMLLHAIDAVYEPMKPLLGDKTPPDYWRIVKGTERWTGRGHGLYL

SEQ ID NO: 6671 - protein, 314 aa, Zea mays
  misc_feature (294)..(294): Xaa can be any naturally occurring amino acid
  misc_feature (304)..(304): Xaa can be any naturally occurring amino acid
MALAILARRRAAAAVLRRPQTAAGAAVSAWRAYAAAGEESDVVVVGGGPGGYVAAIKAAQLGLKTTCIEKRGTLGGTCLNVGCIPSKALLHSSHMYHEAKSSFAHHGVKFSNLEVDLPAMMAQKDKAVAGLTKGIEGLFKKNKVTYVKGFGKLSSPSEVSVDLIDGGSTIVKGKNIIIATGSDVKSLPGITIDEKKVVSSTGALCLSEIPKKLVVIGAGYIGLEMGSVWNRLGSEVTVVEFAPDIVPSMDGEVRKQFQRMLEKQKFKFMLKTKVVGCDTSGDGVKLTLEPAAGXQQTILEADVXLVSAGRSPLL

SEQ ID NO: 6672 - protein, 198 aa, Zea mays
MEGQFQVGKEEVIQAWYMDDSEEDQRLPHHREPKEFIPLDKLSELGILSWRLNADDWENDENLKKIREARGYSYMDICDVCPEKLPNYEAKIKNFFEEHLHTDEEIRYCLEGSGYFDVRDQDDQWIRVAVKKGGMIVLPAGMYHRFTLDSDNYIKAMRLFVGEPVWTPYNRPHDHLPARKEYVEKIINRGGNQAVEAR

SEQ ID NO: 6673 - protein, 164 aa, Zea mays
  misc_feature (14)..(14): Xaa can be any naturally occurring amino acid
  misc_feature (27)..(27): Xaa can be any naturally occurring amino acid
  misc_feature (44)..(44): Xaa can be any naturally occurring amino acid
  misc_feature (51)..(51): Xaa can be any naturally occurring amino acid
  misc_feature (58)..(58): Xaa can be any naturally occurring amino acid
  misc_feature (76)..(76): Xaa can be any naturally occurring amino acid
VRVAARGGGGAFGXAHRAAAFPVGVAXFLKPAVAGFLLRMGLDXLVGAVAXPEPWGGXGGSLVSRSIGVLVSLLAXVDVLLLGGGLIYPFCWARGCSVGCSLVGEGRLGLAPSLLGVAWAVGVSLLLPAGFVVAGRFAADAGSAIGPGPAVPGGWVGLGVGPGA

SEQ ID NO: 6674 - protein, 146 aa, Zea mays
  misc_feature (19)..(19): Xaa can be any naturally occurring amino acid
  misc_feature (48)..(48): Xaa can be any naturally occurring amino acid
  misc_feature (73)..(73): Xaa can be any naturally occurring amino acid
GKWLTQRPVDVDIGANPSXQGGEDKSLDDTAKKVVDIEDTFRIQEQPXSDKKSFVNYIIKYIKNLTSCVWHPXKADDYKKGVKGAHQLLLINLNDLQFFAGESMKDDAAAVSDYYNDGATNTTFLYFSHGLKEINCYACRQITYPC

SEQ ID NO: 6675 - protein, 320 aa, Zea mays
  misc_feature (255)..(255): Xaa can be any naturally occurring amino acid
MAAATKSVCVTGAGGFIASWLVKLLLSRGQYVVRGTVRDPGASKNAHLKELEQAGERLQLLQADLLDYSSVASAIAGCEGVFHVACPVPSGRSSNPEVEVIGPAVVGTTNVLKACYEAKVKRVVVVSSVSAVFSNPNWPKDKVFDEDSWSDEDYCRKNEDWYYLSKTLSEREAFAFAAKSGLDVVTICPSLVFGPLMQSIVNTSSKVLLNYFKGDRETVENRLRNMVDVRDVADALVLAYENPEASGRYICSSHXIKNSDMINILKTMYPSYPYPKNFVENDVNSVYSFEKLQKLGWPFKPIKESPRDTVESYKAFGILN

SEQ ID NO: 6676 - protein, 441 aa, Zea mays
  misc_feature (402)..(402): Xaa can be any naturally occurring amino acid
PFFTSTPLLQLAEPTVGAPAPAPAVVNGTPTPPTTGGARRGSAARKTGRVLAITLPIVAAVLATVVLCSCLWRRKRKTQGKSSLPDTTNPEDIQSIDSLIIDVSTLRAATENFAEANKLGEGGFGSVYKGILPDDQEIAVKRLSQTSRQGMEELKNELVLVAKLQHKNLVRLVGVCLEDHEKLLVYEYMPNKSLDTILFNHERCGELDWGKRFKIVNGIARGLQYLHEDSQVKIIHRDLKASNVLLDNDFNPKISDFGLARLFGSEQSRDVTNRVVGTYGYMAPEYAMRGHYSVKSDVFSFGVLILEIVTGRRNGGSYSSEESADLLSLVWEHWTTGTLVEIMDPSLSSLAPRDLMLKCIHIGLLCVQDDHEDRPMMSTVNVMLSSSTVTLQAPSRPAFLLXKSGFNSEINSEVYPPGAYQSASRSPMSLNDVSITELEPR

SEQ ID NO: 6677 - protein, 311 aa, Zea mays
MGSGNLIVKKVVKHSSFDLDIQLDKSWMEDVTCPICLDYPHNAVLLRCTSYEKGCRPFVCDTDQTRSNCLERFKSAYELPSNAKVSSFAMPPLDSIIHIVPSNANNRPSCPLCRGDVIGWIVIGEARQHLNQKKRCCEEDCCSFVGNFNELQKHTQQKHPDSRPSEIDPARQVDWENFQQSSDIVDVLSTIHAQVPNGIVLGDYVIEYGDDDNGEDYEVFRGVRTHWWSCIFCKAFSRSSRSRRRARERRGSGRRIGNQANLENFNIEVPAQSVELREIRFDEIDDEYIVTGAIPSMATPGRMASFHYRYA

SEQ ID NO: 6678 - protein, 278 aa, Zea mays
  misc_feature (10)..(10): Xaa can be any naturally occurring amino acid
  misc_feature (216)..(216): Xaa can be any naturally occurring amino acid
  misc_feature (233)..(233): Xaa can be any naturally occurring amino acid
SPGYFSGSSXKASLEDNKFGTRAIQALRTLRGRTASEKVLADDVEDTIVSIKAAYAGQEAEGNVWEVFEGASLKAFTIGGGLVLFQQITGQPSVLYYAASILQTAGFSAASDAAKVAILIGLFKLLMTGVAVFKVDDVGRRPLLIGGVGGIALSLFLLAAYYKILNDFPFVAVGALLLYVGAYQVSFGPISWLMVSEIFPLRTRGRGISLAVLTNXFGSNALVTFAFSPLKEXLGPANIFVLFGVIAVLSLVFVILVVTETKGTAPGGASTSTENKVS

SEQ ID NO: 6679 - protein, 131 aa, Zea mays
CLELWTELLTPGTGKTTLTTDHNRLLIGDDERCWTDDGVSNIWGGCSAKCMDLAREKEPDIWLALKVGAVLDNVVFGEHTRDVDYACTSGTGSTRAAYPVECIRLAGIPCGGPHPRGALLLACDSFAVLPP

SEQ ID NO: 6680 - protein, 101 aa, Zea mays
  misc_feature (15)..(15): Xaa can be any naturally occurring amino acid
  misc_feature (68)..(68): Xaa can be any naturally occurring amino acid
IRMTPTNPRDIKDTXTMRTFGDGGAGNYRSRLCDGDTEGIINRLWHIPRCNLLRLMEIVSAIALRMNXDSISVHVVTGDIAHNTHLWSNLDRYALPDRFLM

SEQ ID NO: 6681 - protein, 62 aa, Zea mays
  misc_feature (23)..(23): Xaa can be any naturally occurring amino acid
MAGGRVAHTTLKGLSVVNEFFIXVTVGLFPVGMWKMHLWIEQRNCRSFFPMLFKGQISVVVH

SEQ ID NO: 6682 - protein, 295 aa, Zea mays
  misc_feature (60)..(60): Xaa can be any naturally occurring amino acid
RGRLSRGQYRNPKEFAEDVRLTFHNAMTYNPKGQDVHFMAEQLSGIFEAQWPEIEAEVNXPCIGPPLPKKFPPPPIDLHFLERSDSMRHHMALDTNSRPISHTPTYTRTPSMKKPRAKDPNKRDMTIDEKRKLSENLQNLPPEKLDAVVQVIKNKNLSVMQHDDEIEVEIDSMDAETLWELDRFVANYKKNLSKQKRKAERAMLARQDAELRAQRLIQQPQPTPVPQEPVGEKSLKQVAKGEQLPTSASEKNDENRQNVSGSSNSSSSSSDSGSSSSDSDSDSSSSDGSDAANSS

SEQ ID NO: 6683 - protein, 158 aa, Zea mays
  misc_feature (48)..(48): Xaa can be any naturally occurring amino acid
  misc_feature (57)..(57): Xaa can be any naturally occurring amino acid
  misc_feature (73)..(73): Xaa can be any naturally occurring amino acid
  misc_feature (95)..(95): Xaa can be any naturally occurring amino acid
HGDKQTVGTLEQAFLIGNKVIERADLNILSRPPEYTDNARIRPCFPTXTDVLNKGAXVILATHLGLCKRGHPXFSWKPVGPRLSELLRAELVMAXDCIGEEAEKLSASLTKGGTLLLENVRFYREEEQNEPEFAKKLASAADLYVNDAFGTAHRAHAS

SEQ ID NO: 6684 - protein, 454 aa, Zea mays
MCSSSASAPRRAAALSSEELMRMEQDCSAHNYHPIPMVFSKGEGSHIVDPEGNKYIDFLSAYSAVNQGHCHPKVLRALIEQAERLTLSSRAFYNDKFPIFAEYLTSMFGYDMMLPMNTGAEGVETAIKLARKWGYEKKHIPKNEALLVSCCGCFHGRTLGVISMSCDNDATRGFGPLVPGHLKVDFGDIDGLKKIFEELGDRICGFLFEPIQGEAGVVIPPDGYLKGVRDLCSKHNVLMIADEIQTGIARTGKMLACDWENIRPDMVILGKALGAGVVPVSAVLADRDVMLCIRPGEHGSTFGGNPLASAVAVASLKVVRDEGLVERAAKLGQEFRDQLQKVQQKFPQILREVRGRGLLNAVDLNNDALSPASAYDICIKLKERGILAKPTHDTIIRLAPPLTISPEELAEASKALSDVLEHDLPQLQLQKQIKKPESEAEKPVCDRCGRDLYG

SEQ ID NO: 6685 - protein, 323 aa, Zea mays
  misc_feature (306)..(306): Xaa can be any naturally occurring amino acid
MPPNAQDVHGSSGGLAMTAPAASKMDCFLTAVCTPLNLQFIDVSYRVKQTERSSKAAPGGRISHSGSGAAAPEERTILKGITGEARPGEVLAVLGPSGSGKSTLLSILGGRLAGHHGGTVLAGGRPPCRAVQRRTGFVAQDDVLHPHLTVRETLAFCAMLRLPRSAPAAAKAAAAEAVIGELGLGACADTIVGNAFVRGVSGGERKRVSIGHELLVNPSLLVLDEPTSGLDSTAAARLVATLSALARKGRSVVLSVHQPSSRVYRMFDSVLLLAEGSCLYFGAGRDAMDYFASVGFAPGFHVNPAXDFMLDLANGESSYYVRV

SEQ ID NO: 6686 - protein, 62 aa, Zea mays
  misc_feature (39)..(39): Xaa can be any naturally occurring amino acid
FKVIRAHQKRFFLDLGTNNWGHYFSLFQVAAPHPSSISXPLSGFNPFHEMVGPFVNIKKPRL

SEQ ID NO: 6687 - protein, 134 aa, Zea mays
RGRVGLRAAAAALGVRLRLGLHPAAGGVPCWSGGYERRRRREVVAAAVLAARTILVWDGMGSLLVPCEARREFGGLRRAFDDVHHQLLTKFSRLPWSVDCECYALGLASPAAGLFTEVVACLEIPGVVAPVPSL

SEQ ID NO: 6688 - protein, 675 aa, Zea mays
MLPPRAAAVPLLLLALAAGAAGGADDLASDAAALQAFLAPFGSATVSWNSSQPTCSWTGVVCTGGRVTEIHLPGEGLRGALPVGALGGLNKLAVLSLRYNALSGPLPRDLATCVELRVINLQSNLLSGELPAEVLALPALTQLNLAQNRLSGRISPAIAKNGRLQLLFLNGNRLTGELPNVSMPSLTTLNVSFNNLSGEIPKSFGGMPATSFLGMPLCGKPLPPCRAPGSEASPSQSPTLRPEAPAPTDNRGRGRHHLAGGAIAGIVVGCAFGFLLIAAVLVLVCGALRREPRPTYRSRDAVAAELALHSKEAMSPNGYTPRVSDARPPPPPSVPPPPAVSAAAAGRKKLFFFGRIPRPYDLEDLLRASAEVLGKGTHGTTYKAAIESGPVMAVKRLKETSLPEREFRDKVAAIGGIDHPNVVPLQAYYFSKDEKLMVYEFVAMGSLSSMLHGNRGSGRSPLSWESRRRIALASARGLEYIHATGSMVTHGNIKSSNILLSRTVDARVADHGLAHLVNPAGAATTTRVAGYRAPEVVADPRRASQKADAYSFGVLLLELLTGKAPAHAVLHDEGVDLPRWARSVVKEEWTSEVFDTELLRHPGAEDEMVEMLRLAMDCTEPAPDQRPAMPEIVARIEGLGGTASASTATARSGRSASVDEADDRPLRTTGSIRQS

SEQ ID NO: 6689 - protein, 340 aa, Zea mays
MMGGFLSRVLLLAFGYAYPAYECYKTVELNKPEIAQLIFWCQYWILVALLTVLERFGDFTISWLPFYSEAKLLFFVYLWYPKTKGTTYVYGTFFKPYISQHENEIDRNLLELRARATDMVVLYFHKAASVGQNTFFDVLKYVAAQSPSRKSRLHPHQEPQQQQPQVQVELQQQPQVQVELQQPQPQKQAAPVMRRGASIAARQAAMAQQSLETIPVPSSPKIKRQTSGRPGSVASTKPAAAASTPKPGGSPKKGEVKPAADPVQTPTPGADSPKPEPSAPSLPGAEGVDKMAIDEASGAALEGAEELDPALEEEPPMEEPIRVTRPKLRRRPAPEDPAGN

SEQ ID NO: 6690 - protein, 166 aa, Zea mays
  misc_feature (32)..(32): Xaa can be any naturally occurring amino acid
  misc_feature (110)..(110): Xaa can be any naturally occurring amino acid
SAYHDLLSGDELLSDSFTSKELDNGVLWEVEXKWVTQGPVDVYIGANSCAAGGEDERVYYTPVKVVDIGDTFRIQEQPSFDKRSLDSYIKTYIKNLTGGNQPKKADEFKXGVEGATNVLLTKLNDLQFFVGESMKDDASVVFDYYKDGATNPTLLYFSHGLKEIKC

SEQ ID NO: 6691 - protein, 210 aa, Zea mays
MTGFSMLRHVWTISACRAEVSDIAIAVREGADAIMLSGETAHGKYPLKAVKVMHTVALRTESSLYNPTTSPSLVASAQGLQNEDFSASQLSKMFGSHATMMANTLRTPIIVFTQTGSMAVLLSHYRPSSTLFAFTNEERVKQRLALYQGVIPIHMQFSDDAEKTFSRAISSLLKAQYVKKGDYVTLVQSGVTSIWREESPPPIQVRRAQV

SEQ ID NO: 6692 - protein, 316 aa, Zea mays
  misc_feature (23)..(23): Xaa can be any naturally occurring amino acid
MASAIKAASTSSRWSSSPAAVHXRAVAAVAPAAPAAPAKLTAGAGGRCLPVSQTMSRLRAQGKTAFIPYITAGDPDLATTAEALRLLDACGADVIELGVPFSDPYADGPVIQASAARALASGTTPDGVLAMLKEVTPELSCPVVLFSYFNPIVRWGLADFAAAVKEAGVHGLIVPDLPYGNSCALTLRTEAIKNNLELVLLTTPSTPADRMEEITRASRGFVYLASVNGVTGPRANVNTRVQSLIQEVKQVTDIPVAVGFGISKPEHVKQIAEWGADGVIIGSAMVRQLGEAASPKEGLKRLEKYARSMKNALPCQ

SEQ ID NO: 6693 - protein, 534 aa, Zea mays
MALEPVALLLTVLVAAPLTVLLLLLFLVAGNKRPARAASPTPRHRLRLPLPPSPRGLPLLGHLHLLGSLPHRALASLARAHGPVLLLRLGRVPTVVVSSAAAAEEVMRARDLAFANRPASAMAVRLLYGRDVAFAPYGEYWRQARRVCVVHLLSARHVGSFRRVREQEAAALVARVARDSAGGAAVGLSDLLTEYANAVVSRAAFGDESARGLLGEFDSGRRQRKVLTDFQKLVGTTPVGELLPWLGWVDAVTGLEGKIRRTFEALDGLLEKVIDDHRRRPRSGEEGGDRDFVDVLLDVHNKDQEHGIQLETNEIKAIILDMFAAGTDTIATAMEWAMAELVTHPRAMRRAQDEVRAAAAGSTGVNEDHVAQLDYLKAVLKETLRLHAPLPLLVPREPAADTEILGYHVPARTRVLVNAWAIGRDPATWERAEEFVPERFLGGAAAADVGFKGQHFELLPFGGGRRMCPGIAFAEGSAEMALASLLYHFDWEAASRGQNGKGTLSLDMTEMNGLAVHINSGLPLVAKPWIPFKN

SEQ ID NO: 6694 - protein, 91 aa, Zea mays
VPNPWQNKPLSFFNKGLADELNREGAWDLAIYPEENIAFPSWPMEGSLKEGGVRCKLDFVRGCPDPSSDMFDPLAPVDEGSCPLEFVSEEL

SEQ ID NO: 6695 - protein, 165 aa, Zea mays
  misc_feature (70)..(70): Xaa can be any naturally occurring amino acid
  misc_feature (116)..(116): Xaa can be any naturally occurring amino acid
  misc_feature (155)..(155): Xaa can be any naturally occurring amino acid
PHIVTSSPLATDNPPALRCRLIRYLLSGDGAPCLDSFTYNELENGVLWEGYGKWVTQGPGDADIGANPSXSGGEDESVDYTAEIVDDIGDTFPLQEQPTFDKKSFVSYIKKYIKNXTAVLEPEKRDELKKGVEGATNFLLNTLIDLQFFVGESMXDDASERFTYY

SEQ ID NO: 6696 - protein, 378 aa, Zea mays
MVDVDRRPSHPHGLPRPPSHAAGLRRLSTRASAPSSPAPPSPSASAPSPTALLAHLAAAGVAVLPGLSATEFALAEAALGGVQLPPDLRELLALGLPSGDGFPDYRTPAGLRLLRFAAQEVPAAVAATLPLAPGRRAGRAAPPPLVPLCGRHYVPATPCLAGNPVFYVSDSGVTFAGANAADFLLRAFAAEPPPGAPLRRQLSAPVPPPSGAPPSTARRSLDSVTGRAPRWIEFWTDAAAAGDRFLEVPTGATSAAASSAAPEWLRPSLEEAASMLRRGGWGLCEVEEMVTGEGPSGAGEVNVVALALTVDRCCRDLKSGGWGAEEVVEMLGALLGPRKPRRAVAALPPDVAARMGRLAEAVSRAVGSHAKAKPPRPS

SEQ ID NO: 6697 - protein, 303 aa, Zea mays
  misc_feature (270)..(270): Xaa can be any naturally occurring amino acid
MSGGTPAASSSLRTALSYCVRQVRAYDYHHYLCLLHLAPAVRKAAFTFRAFNIETARAMDVVSDPRTGLMRLLWWKEAVDKVFGNKLVEHPVAQALSSVIADHKVSKHWLKRSVEARINDANREEGTIPGTSAELERYAEDTQSTILYMTLQAGGIQSTVADHAASHIGKASGLLLLLKALPHHVNKQGTVHYIPASVAEECGLLITREGGRSEVRAGERLLDVVFKVASVAEAHLHKARELAPSVPKEAIPVLLPALPAQVLLDTLRRXFNVFDPWLSRGVHGVSPLWYQLKLNWNARRSRY

SEQ ID NO: 6698 - protein, 88 aa, Zea mays
  misc_feature (33)..(33): Xaa can be any naturally occurring amino acid
EEDEGKGAGNRDYSDQRDLILCLLSNKRMATLXQFKGRSLVSIREVSMNDGNEIPSCKGVTLTMDQRESFRSAAPAIKDGINKLKDSY

SEQ ID NO: 6699 - protein, 74 aa, Zea mays
  misc_feature (29)..(29): Xaa can be any naturally occurring amino acid
KKFGYQGDLILLRLSSKRRVILSEFKGRXLVFIPKFFLKDGKEIPSPQGICMPMEQWVAFFNAAPAIKEALQKL

SEQ ID NO: 6700 - protein, 556 aa, Zea mays
  misc_feature (156)..(156): Xaa can be any naturally occurring amino acid
  misc_feature (209)..(209): Xaa can be any naturally occurring amino acid
  misc_feature (229)..(229): Xaa can be any naturally occurring amino acid
WVPRGRPRPFTLKYQLPNEDLDSLISVSTDEDLDNLVDEYDRIAATSSGGGSSRTSRIRLFLFPAKPESSSSLGSLLDDSSKSENWFVDALNSAISGSLDGIPRGISTDSASVNCLLGLEDDSSVHSRSGVTNSAPTEDQRASQPKLPAGAAAAAXRHPHDVQSVPDSPMLDKNSSFGSTSSAPSLSNLPPIRVRPEDRPSDARIMQPXPCEDNFAQMGMIRAAAAHVXQTQQQVPIPAMTGMSPSEASSRLFSDDDKSDHGGGGGRKQQPPKQDVPPVVDPTNRAVYYNDRSPPAELKRDMPVGTEAASYRLPVSAPDAAAAAAATAATQAPPGYVLAQMHAPPPPQQPPPQQQPQQPAPQQIVAAGNQHFIHNPATGTFIPIQSYYHHPVHQQAPQTMQRQQQAPTFDPNTGMYYVPMQQNAHQAYGVPPGAQVTLPPPTLVDTTPKPTVPIPQMAVRPELQQPGVYRTTAAATPAPAPNAAPGYAGMAYHHVIQSHHHHHPAPQPVANMAGNYGYEFADPTRPQVYYSQAAAPPTLPQYPPIVSPDAGQAEKH

SEQ ID NO: 6701 - protein, 372 aa, Zea mays
  misc_feature (109)..(109): Xaa can be any naturally occurring amino acid
NPHPKTHGGDKHSKPPSSPFVSLMEPLPSATAAGVGAPGPGPGYPESTESSPRSRRGDSWDEPFPSSAAAAAGGGGRLRLMCSFGGRIVPRPTDKSLCYLGGATRISTXGRPFTLKYQLPNEDLDSLISVSTDEDLDNLVDEYDRIAATSSGGGSSRTSRIRLFLFPAKPESSSSLGSLLDDSSKSENWFVDALNSAISGSLDGIPRGISTDSASVNCLLGLEDDSSVHSRSGVTNSAPTEDQRASQPKLPAGAAAAAAGAGRHPHDVQSVPDSPMLDKNSSFGSTSSAPSLSNLPPIRVRPEDRPSDARIMQPTAVEDHFAQMGISEQQLPMYIQAQQQVPIPAMTGMSPSEASSRLFSDDDKSDHGGGRE

SEQ ID NO: 6702 - protein, 76 aa, Zea mays
KDNRSNFKAQFGDFATSVDGVFAAGDCKRGQSLVVWAITEGRQAAAAVDKYLSRYDQNAAGDITPSGAGLVQPVAA

SEQ ID NO: 6703 - protein, 262 aa, Zea mays
QKSKEDVVDSLLRASGCLDYSVHRILVQIPAQVKKGFPSYLQEGMLEAISIQALAQCVEIQLGLASECEKATLSVKRRLACEQVSYFSQAHYCLSGCDTSDSYGKKLLLFLKWKWMEAKAVAYYYHGLVLDKGGEPANHISAVCCLSAADDLLSDSKRACLSFCLANPVTRVPPPWGVMKNMHKKIPDVANKKFQAHGHLFEQNKNSALQSVPDLPEFALSLRPDGYELPITDSIWENVDGQPQIQSLKEHMIDDEDEVGTK

SEQ ID NO: 6704 - protein, 110 aa, Zea mays
MGALECSANITMTKPARKLGAVVEGVCPVRFDHTRGISAVAGSCRDRPRPSPERCCGALKTFACPYSDLINDNDHNGCASDMFYQIIVRGRLRPGLFSQMCVEGPLGLSC

SEQ ID NO: 6705 - protein, 134 aa, Zea mays
  misc_feature (16)..(16): Xaa can be any naturally occurring amino acid
  misc_feature (34)..(34): Xaa can be any naturally occurring amino acid
  misc_feature (39)..(39): Xaa can be any naturally occurring amino acid
  misc_feature (44)..(44): Xaa can be any naturally occurring amino acid
  misc_feature (76)..(76): Xaa can be any naturally occurring amino acid
  misc_feature (87)..(87): Xaa can be any naturally occurring amino acid
  misc_feature (91)..(91): Xaa can be any naturally occurring amino acid
TTNYVFWSIIKYHTTXLCLLLSDSDGQGTLDMGXNSLRXMRNNXLLALACTNRTYVPIINMKLNYAAYFILTGVLXMQGATLEIIKXAPDXSDVSHTNRKETDALLFGAFDGPFKAAVKALMKRRTYLLEMNGF

SEQ ID NO: 6706 - protein, 454 aa, Zea mays
  misc_feature (193)..(193): Xaa can be any naturally occurring amino acid
  misc_feature (226)..(226): Xaa can be any naturally occurring amino acid
  misc_feature (238)..(238): Xaa can be any naturally occurring amino acid
  misc_feature (270)..(270): Xaa can be any naturally occurring amino acid
  misc_feature (329)..(329): Xaa can be any naturally occurring amino acid
  misc_feature (392)..(392): Xaa can be any naturally occurring amino acid
  misc_feature (409)..(409): Xaa can be any naturally occurring amino acid
HWVPRGRPGRHVRRHPVASHPTTTHLVVRRFDPVLPTQGAVMATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGXTAHRAHASTEGVTKYLKPAVAGFLMQKELDYLXVGAVANPKKPFXAAIVGGSKVSSKIGVIESLAGRRSISSSLGGXGMIYTFLQGTRDILVGKSLVEEDKLELATSLIEKAKAKGVSLLLPTDIVVADKFAADGXSKIVPATAIPDDWMGLDVGPDATKTFNEACATPPRLLFGNGPHGEWFEFEKFAAGTEAIAKKXLAELTTHEGVSLPIIGXGGDSVAAVEKAGLADKMSHISTGGGASLELLEGKTLPGVLALDDA

SEQ ID NO: 6707 - protein, 386 aa, Zea mays
MSDTAGKTITCKAAVAWEAGKDLVVEDIEVLPPRAHEVRIQVYYTGVCHTDAYMLSGKDPEGAFPVIAGHEGAGIVESVGEGVTNVKVGDTVVALYTPECKECKFCKSGKTNLCGKIRATQGKGVMPDGTSRFKCKGKDLLHFMGCSTFSQYTVLADISVVAVTPDAPMDRTCLLGCGITTGYGAAVITAGRGGVEKGSNVAIFGAGCVGLSVIQGAVKQGASKIIVVDVNDAKKEWAKKFGATDFVNPAKDLKEGENIQSRLIDMTDGGCDYTFDCTGNVHVMRSALEACHKGWGESIIIGVAAAGQEISTRPFQLVTGRVWKGCAFGGVKGRSQMGQLVQDYMDNKLKVDEFITHRQPLGGINEAFHDMHAGDCIRCVVDMRKV

SEQ ID NO: 6708 - protein, 514 aa, Zea mays
MASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEASSTLLPINFDGLAKALTPGATIFVGQYLFTGSETTSVWLEVSEVKGDDVVCIIKNTATLAGSLFTLHCSQIHIDLPTLSDEDKDVIKKWGAPNKIDFLSLSYTRHAEDVRQAREFLSKLGDLSQTQIFAKIENVEGLNHFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYYKRTVKYVGEPMTHLESIASSAVRAALKVKASVIICFTSSGRAARLIAKYRPSMPVLSVVIPRLKTNQLRWSFTGVFEARQSLIVRGLFPMLADPRHPAESTSATNESVLKVALDHGKASGVIKSHDRVVVCQKVGDSSVVKIIELDD

SEQ ID NO: 6709 - protein, 126 aa, Zea mays
  misc_feature (68)..(68): Xaa can be any naturally occurring amino acid
  misc_feature (97)..(97): Xaa can be any naturally occurring amino acid
  misc_feature (109)..(109): Xaa can be any naturally occurring amino acid
HNLRRGIRKADYTRDYAFIECNDPGAADNPHGNLDGRGRIGSQIIEGFAKGAPGGSGGKRECPGTGPXPGTNRGFNCECEGHWARDCWANNCKNKCXRCRKRRHIQRNXQNITRNIRRERSSSRPP

SEQ ID NO: 6710 - protein, 88 aa, Zea mays
  misc_feature (65)..(65): Xaa can be any naturally occurring amino acid
MAPTVMASAGTSVAPFQGLKSTAGLPVSRRSNGASLCSVSNGGRIRCMQGWPFEGIKKCETLSYXPPVNTEALLEQEDYLVRCQGAPG

SEQ ID NO: 6711 - protein, 188 aa, Zea mays
MYQSRRSTDDEVNIQEDTMAATSSKATGPWSRLSEAEAAVNRAVAGSHVGRYFKLDARKSSFTKELRAGAATFLTMAYIISVNAAILTDSGGPCTARDCTPVATATNSTTADCAVVGAKANPGYQQCLARTKSDLIVATAVAAMAGSFAMGLFANLPLGLAPGMGAHAYFAYNMIGFPGSGTIGYRTA

SEQ ID NO: 6712 - protein, 533 aa, Zea mays
MTAAATMTWHEDLATLVGDTDVHLTGAGGHAPAPANVAAAGAGWYGEEEEVRAEEGWAQQAKGFAESTAEMLRELGRGLWDVAAQSLAGAEDSEVARRLRKRAAATGKRLSFMNEYLPEERDPVRCWLTVAAVAFVSLLVLGFGSGNETPVELPKKLIIGPPSADRIQLPDGRHLAYQEQGVSANRARFSLIAPHSFLSSRLAGIPGISASLLEEFGVRLVTYDLPGFGESDPHVGRNLNSSALDMLYLANALNIPEKFWVVGYSGGGMHAWSALRYIPDRIAGAAMFAPMANPYDSKMTKDERRKTWDSWSTKRKLMHILARRFPSLLPFFYRQTFLSGKQGQLESWLSLSLGKKDKTLLEGPVFNAFWERNVAEAVRQGDARPFVEEAVLQVSDWGFSLSDIQMQKKEAGGFFELIKSLFNQAEREWVGFLGPIHIWQGMDDRVVSPAVAEFVRRVVPGATVHKLLDEGHFSYFCFCDECHRQIFSTLFGIPQGPINPAPPQPGEVVSELTEETTVPDNATDEEQGKSGLP

SEQ ID NO: 6713 - protein, 93 aa, Zea mays
FYYISNNTSYVAHPTSTHGGHDLFRMGLPKETALALDSQPLNYPNHTDTQLNLLVTHAHYDNYHHAIAALIHASYAHPTNLEVLFALPVNHTN

SEQ ID NO: 6714 - protein, 340 aa, Zea mays
MASPPPPRVCVTGGGGYVASWLVKLLLSRGYAVHATVRDPSDPKNAHLQQLDGARERLRLFKADVLDRDALATAVVACEGVFHVASPVPADKVLDPESEVLSPAVKGTLNVLQACSANNVQKVVVVSSTAAVYFNPSWPQGRTKDESCWSDRDLCIKNENWYCAAKTIAEETAVEYGEKNGLIVVTVCPCIVLGPLLQPLINASSELLVYIIKGGPRVLKNLPWNIVDVRDVADALLLVYEKVESSGRYICAPNRISTNNMVNLFKKSYPNYNYVNCDNKDYESEISPVTSEKLKSLGWNPRTMEKTLLDNIEYFEKAGFLRDGEGYPCRLPHIFHFASD

SEQ ID NO: 6715 - protein, 119 aa, Zea mays
MAGGRVAHATLKGPSVVKEIFIGLTLGLIAGGMWKMHHWNEQRKTRSFYDMLDKGQIVVRRRGVVPTCHLRSFFFFQLFLKTHSGGHDKVNAVEIWLENKHNHLRTPASVELSFLVMTI

SEQ ID NO: 6716 - protein, 83 aa, Zea mays
  misc_feature (75)..(75): Xaa can be any naturally occurring amino acid
SVDTGMVLRYNSSEVISGQDLTVYGALSSLASFDRSYLKSTFTDNINFRNYLHLVPEVQQLVTDLYATRYRSCLXHLEKLKPN

SEQ ID NO: 6717 - protein, 62 aa, Zea mays
  misc_feature (23)..(24): Xaa can be any naturally occurring amino acid
MSSIQSEDTTLKGPNKVKKIFIXXLTLGMIAGSMLKMHHWNEQRKTRPFYDMLDDVKNRHVP

SEQ ID NO: 6718 - protein, 531 aa, Zea mays
  misc_feature (186)..(186): Xaa can be any naturally occurring amino acid
MALEAAYDYLHVAVVQCTPTQAAAVLGVLLLLAIRLAAAARSSSATSPKWKQHRLPPTPPGKLPIIGHLHLIGSHPHVSFRDLHAKYGHNGLMLVQVGAVPTIVVSTPQAAEAVLRTHDHVLASRPRNPVADIIRYNSTDVAFAPYGEYWRTARKVVNTHLLSAKMVFSKRREREEEVRLVVARIXRDAAEASPGTALDMTELLGGYASDFVCRAVLGESHRKQGRNKLFRELTETSAALLGGFNVEDYFPKLADVDLFLRIICAKAKGVSKRWDSLFNELLSEYALSGGKQGDHNSEDFVHLLLSLQKDYGLTTDNIKGILVNMFEAAIETSFLVLEYSMSELMNNRHVLAKLQKEVRTATPDGRMVMEEDLSRMPYLKATIKESMRIHPPAPFLLPHFSTHDCEINGYTIPAGTRVIVNAWALARDPTCWDKAEEFFPERFLEQGRDAEVDMYGKDIRFVPFGAGRRICAGATFAIATVEIMLANLIYHFDWEMPAEMERTGAKVDMSDQFGMTLRRTQKLYLVPRIPK

SEQ ID NO: 6719 - protein, 381 aa, Zea mays
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECRDCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSIVAVFGLGTVGLAVAEGAKSAGASRIIGIDIDTKKFDVAKNFGVTEFVNPKEHDKPIQQVLVDLTDGGVDYSFECIGNVSVMRAALECCHKGWGTSVIVGVAASGQEIATRPFQLVTGRVWKGTAFGGFKSRTQVPWLVAKYMKKEIKVDEYITHNMNLADINDAFHLLHEGGCLRCVLAMQI

SEQ ID NO: 6720 - protein, 402 aa, Zea mays
  misc_feature (260)..(260): Xaa can be any naturally occurring amino acid
MDPNRPPLGRRAFLSSSVHAATALLSILLLVTLLRLPLSTSPHAASTIADQKPKEQTCDPTSPLDCADPRLFHLMMRSAIEAFPAVHFARFGRPVPGDPPSSSCDMAWRSRSDFDSPSKATTKDYRRFAIGRDPHTCAYSVLSIGDYHSGPNARKPRRGATNATIATPPPPALSRSQFAKGAYLAYLGGGDRCKPMPHYLRSLLCALAEARYLNRTLVLDLTLCLAASYAAPGTGGMPEEGKRLAFYIDVEHLHSQVPIXEERQFWADWDSWGVQGQLRAHLIEDSRLALIKFSKGKGTLIIRKFGDLEPGNYWYNVCEGEAKHLLSPLPWVIRWTPSLMHIGDDILSRMQPDFDSGHIDAKGEDLRQKVEEVLGGRPQVYFSRVGVNKALVESLKEKCIGH

SEQ ID NO: 6721 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGYSTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 6722 - protein, 253 aa, Zea mays
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMEVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 6723 - protein, 304 aa, Zea mays
  misc_feature (263)..(263): Xaa can be any naturally occurring amino acid
  misc_feature (273)..(273): Xaa can be any naturally occurring amino acid
MEPGSTPPNGSAPATPGTPAPLFSSGGPRVDSLSYERKSMPRCKCLPLPAVEGWGVATHTCVVEIPAPDVSLTRKLGAEFVGTFILIFFATAAPIVNQKYGGAISPFGNAACAGLAVATVILSTGHISGAHLNPSLTIAFAALRHFPWLQVPAYVAVQALASVCAAFALKGVFHPFLSGGVTVPDATVSTAQAFFTEFIISFNLLFVVTAVATDTRAVGELAGIAVGAAVTLNILVAGPTTGGSMNPVRTLGPAVAAGNYRQXLWIYLLAPTXWAALAGASVYKAVKLRDENGETPRTQRSFRR

SEQ ID NO: 6724 - protein, 373 aa, Zea mays
MDRLVVFSRRRRRWILLAAAGAAAAVGAYKIYHHPAVAERRRRLVRLAAAIAAFADAAASSADAVALVTSDLADFVRSDADEVPRSVKQLAKLAASREVSATVSTLSEAVTSGILRGSGSSSSGPASGGTVALSDRLVDRLFSDSGERLASAVAGSFARHLVLAFYSAPSPQGEASSSPTMWVNVVATGKCRKAISNWVEVFVGTAVREFIDKTIHINTYEQLFEGLTNPRHDAKVKELLVSVCNAAVETLVKTTHHALYSTNGNLGANGSVSGNANGAGEGWVETVSSTLAVPSNRKFVLDVTGRVTFETVRSFLEFVLWKLQDGARKGGGSVVDSGLRVVRYMSDKSMVIATICITLCLHVLNGTRLLVTA

SEQ ID NO: 6725 - protein, 568 aa, Zea mays
MYMRPPTANDRPPSGGGGGAAAGAGAAAGDDDFAFYCSYLQDADAAAASATSTLALAVDDPNPNPSAAGMTNGRRRKQRGAEDAGAAGEGEEEAKKDGKKRSIAKLLTSLAALEAEEHADRAGAADASRRELALLESNADTRSQATMDYYAKMESSFDATAESEAAARSKRSRLAASAATAAVVAGEEAAASAAASPSASASPTRAAGQGQGGHHQRRLWVKDRSRAWWDRCNSADYPEEEFRRAFRMGRGTFDMICDALGSSVAKEDTMLRAAIPVRQRVAVCVWRLATGEPLRLVSKRFGLGISTCHKLVLEVCAAIKSVLMPRFLQWPDADAAARFKEGFERASGVPGVIGAMYTTHIPIIAPKISVAAYFNRRHTERNQKTSYSITLQGVVGPDGAFTDVCIGWPGSMPDDQVLEKSMLHQRAAAGMMHDSWLVAGASYPLMDWVLVPYTHPNLTWTQHAFNEKVAELRRVAVEAFARLKARWACLQKRTEVKLQDLPVVLGACCVLHNICEIRGEEVDPAIRCELVDDETTPENPVRSETASRARDNIAHNLLHRGLGGNTFF

SEQ ID NO: 6726 - protein, 726 aa, Zea mays
MPANDHHPNGLLQESAPGLQHDDMENQQQQVCWERFLLKDTLNVLLVESDASTRQVVSALLRCCMYQVISAENGQQAWAYLEDKRNNIDLVLTEVFMPGVSGISLLSRIMSHNICKNIPVIMMSSSDAMSTVFKCLSKGAVDFLVKPIRKNELKNLWQHVWRQRCHSLSCSSGSGSESGIQTQKCTKSKGANESGNNSGSNDDEAGMGLNARDDSDNGSGTQAQNSWTKLAVEIDSPQAMSLDQLADPANSTCAQVIHSKSEICSHRWLPGSSNRNCKKQKYTNDDFKGKDLEIDGPGNLYMDHQSSPNERPIKAADHENNSKEPIKAADHENNSKESMIENLEEPTVRAADLIGSMAKNMDTQQAARAAEDTPNFSSKVPEGKGKNDQHDNYVLPSLELSLKRSRSCGDGANDTVNDDEQRNSALRRSNLSAFTRYHTSAASTQGGTGLVGSCSPHDNSSEAVKTDSTYNMKSNSDAAAIKQGSNGSSNNNDMGSTTKDVVTKPSTNNERVMLPSAIKANGYTSTFHPVQQWMVPDNATAGKAKADEVANNAGRNSHPGDVQSNLTQQHRPTLHYVHFENSGSGALQCGSSNVFDPPLEGQATNNYGVKAGSNSGSNKGQNNGSTAGASTAAANAGRTDTEIRAIDKSGPGGGSGSGNDTYVRRLAASMTPRQEQLKKYREKKKDRNFGKKVRYQSRKRLADQRPRVRGQFVKQAVQNQEGDGER

SEQ ID NO: 6727 - protein, 111 aa, Zea mays
  misc_feature (99)..(99): Xaa can be any naturally occurring amino acid
TSSSYTHDDNSHPLESNDHGSRKVCPSRRVTARYGRGQDGSGGHLPPCGTLCRSHAPQDDIIVHVKKLVAAQTGTRTEKIRIHMWYNIYKDHITLKDYXVHYGMGHELYYN

SEQ ID NO: 6728 - protein, 79 aa, Zea mays
NPGWGLPKAGALLLLGSAAAAGLAYPLGDPVNGFSNATRFRSFLISLMALRLATNSRKAGSALILASRKKHRTVSLTFS

SEQ ID NO: 6729 - protein, 63 aa, Zea mays
MGGGRFQHATLKGPSVVKEILIELTLVLIVEGLWKIHHWTRQRKTRSFYNMLDRGQISVFVKE

SEQ ID NO: 6730 - protein, 113 aa, Zea mays
  misc_feature (101)..(101): Xaa can be any naturally occurring amino acid
GADQAVRQPFQSRFDLLLLLAGPNTTRLASKLARGPTVIMASSETAVAPFKGLKSAAGFPVSRRRTRSLGNLRNGGGIRSMQVWPAYGTKKFKTLSYLPPXLSTDNLLKQVDY

SEQ ID NO: 6731 - protein, 498 aa, Zea mays
MGCTRARLMRRRARVTVSGLMDPDTVIRKLHKAGKPAQLWGATAKPAVATQLEKLQLKDAGGKGQGQPPKNAGGKGQPPKNAAGKGQGQGQKQQQPKGGAGGAGAGAKVVALPHSQPTPQQLMQMQQQMQMNGMKFAHPELMAMGAGRMPMPMPFPAAAQAQAQAAAAKDPKTVKFDLPGGEEFGDDGSDLDDEFDELDDVDFEDDGLDDDDDGDLYDGPGMVMKPMGMPPAAAAGGGNGNGGGKKGGGGNEVPVQINGNASNGGGAKQNGGGKSGAKNGKGGGGGGGVVAPGGGNQAGQGKPKGGFPGGAGLGGPMMGGAPPPHAGMMMRPPNMMGGAGGFPGMGQMGGHPHMGGGGMPQAGGGAAHGMPAGGSISMAAGGMPGAGFFPRGVGGGMPAGAEMLGMSQLPPQQQQHMAAVMQQQQQHMAAIMQQQQQQMMMMNGHGHGHGHHGHGGYGYGRPAMPQYPPPPAYYYPMPQRHPHDSMFSDENPNGCSVM

SEQ ID NO: 6732 - protein, 405 aa, Zea mays
  misc_feature (176)..(176): Xaa can be any naturally occurring amino acid
  misc_feature (313)..(313): Xaa can be any naturally occurring amino acid
MLRRSLPEAGSFFRRLLGRVSNEGGLAAGSSASVRHFVEQLVGGTAPISRVPSALAVASAERGTGGSNGASLTVHFLRHSCGLEEADAAKAAERVHLRSTKNAHAVVALLRDTLGMPPASVARLVSAYPAVLSSVTLGAKLNFYLRELGLSSAELRRFLLASPHRFLLAGIETRLXPTSASSRTFFGTEENVLAAVKQSMELIYDNLEIVLLPKLQVLREHGVTEEVLVKLLTTHPRALVHRSTRFDEGLTAMKDLGVSPKSGAFPYAFGVFARMYQSKWDRRVENYVSLGWTEEQVRRAFVRHPYFMTVSEXKVKKRMQFIAEKLGWNPDVLSSYPTILSFSHEKRVLPRYRVLHILASRGVIKKGIRMSHLTMPEKKFKERYVDKHQEEIPQVLEAYGARTEA

SEQ ID NO: 6733 - protein, 337 aa, Zea mays
LQPPSQAPTRLVTHSSNISQLISQRLAPARDDGPLRRGARAVLYFAEDNWKRVWVMALWLAINAGLFTWKFLAYRRHPTFDVMGYCVCVAKGGAETTKFNMALILLPVCRNTITWLRSRTRLGAAVPFNDNINFHKVVAGGVAVGVALHAVTHLTCDFPRLLHASAAAYEPMKAYFGQRRIPNYWWFLRGVEGITGVIMVVLMAVAYTLAHPWFRRGKLSEGNPLRRLSGFNMFWYSHHLFVIVYVAFIVHGVCLYINRTWYKQTTWMYLAIPILLYAGERLLRALRSHGLTTVRIEKVALYPGNVIAIHMSKPHGFSYKSGQYIYVNCGEVSPFEW

SEQ ID NO: 6734 - protein, 231 aa, Zea mays
  misc_feature (48)..(48): Xaa can be any naturally occurring amino acid
MSSSTCGTREMLSANSTATSIGQVQKVPGFAKLQGENFGYFMQTYSMXLGRTSRRYTADFDLSKYECGSQCVSRCHACIFYDFELRHCAIEVLGRNGCTIRGVSYLPGSVPGKKKKIKLNSQDLIEIAGIKFYFLLPSRSIFATLAARDATMLPPQSPSLLHPNYPGNPSANDCGRSNGENGVKISNDMQGKLVKQKRSFSGELDISYSYGTKKNVDRVGTLDGCGMLSLL

SEQ ID NO: 6735 - protein, 218 aa, Zea mays
  misc_feature (197)..(197): Xaa can be any naturally occurring amino acid
  misc_feature (208)..(208): Xaa can be any naturally occurring amino acid
MAYRADDDYDYLFKVVLIGDSGVGKSNLLSRFTRNEFSLESKSTIGVEFATRSIHVEDKVVKAQIWDTAGQERYRAITSAYYRGAVGALVVYDVTRHVTFENVERWMRELRDHTDANIVMMLVGNKADLRHLRAVPTEDAKAFAERQNAFFMETSALEAMNVEDAFTEVLAQIYRVVSKKALDIGDDPAAPPRGHTXINVGGKDDVSXAVKKSACCSS

SEQ ID NO: 6736 - protein, 363 aa, Zea mays
  misc_feature (78)..(78): Xaa can be any naturally occurring amino acid
  misc_feature (133)..(133): Xaa can be any naturally occurring amino acid
  misc_feature (151)..(151): Xaa can be any naturally occurring amino acid
  misc_feature (199)..(199): Xaa can be any naturally occurring amino acid
  misc_feature (351)..(351): Xaa can be any naturally occurring amino acid
WALLKAARVADVPTLDVVVAPGLVAVAKARSAAAVGGRFSVIGHRGKGMNALASEDPRLRDVRENTVRSFNDAGRLPXVDYVEFDVQVTKDGCPIIFHDNFIFTQDDGKISQKRVADIQLEDFLQYGLQNEQXKVGKPLLRRLKDGRMVKXWNVQSEDALCTLEEAFDKVNPRLGFNVELKFDDSGFSSTPRDRPILFXSVFQPDAAQLMRKLQGTYPVYFLTNGGTELYADVRRNSLEEAVKLCLAGGLQGIVSEARGIFRHPAAVPKIKEANLSLLTYGTLNNVPEAVYMQHLMGVNGVIVDLVPEITEAVSELIALPEPDLDLEVGSLSNQAAARGATTSKFHAAQDXSFLLRLIPELVQ

SEQ ID NO: 6737 - protein, 71 aa, Zea mays
  misc_feature (12)..(12): Xaa can be any naturally occurring amino acid
MRFAGWYLKIAXGGASIGAAMELFMIHTGFYEKVTVLGSEKRAWESSLEAQAMREALNPWQKHDEQEQQKK

SEQ ID NO: 6738 - protein, 273 aa, Zea mays
MYKQGGAGGGAGLDRKRINDALDKHLEKAVASPSTSRGSAGGGRDHHRLVVPSSVSSIPKGRCSEGESDSDSEASDVSGSDGEDTSWISWYCNLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKLSQRYVPRVFGFKLHKP

SEQ ID NO: 6739 - protein, 174 aa, Zea mays
MAETVFTPSLEDKFGAAMAIVKNDISGNITRLENKYSSDPSKYGHLYSMVQEEVQNKTAKGSSSCTNGLLWLTRAMDFLVELFRNLLEHPDWTMTQACTDSYTKTLKKFHGWLASSSFTVAMKLSPNRDKFMEVISGTGDINADIEKFCTTFSPFLKENHEFLASVGLDDMKAS

SEQ ID NO: 6740 - protein, 239 aa, Zea mays
MDSDLWISRLTAAKRQFALQRAQRQHAAPASHHDRFGYDDIEPEDDLHSDFPCPYCYEDHDVASLCAHLEDEHPFESKIVSCPVCSARISKDLVDHITLQHGYLFKLQKHQRVRRVTGNGNHNLSYAGRDLQLQETYLKVLLGNSSRSSSTNASSTVTDSLLPSLVLNLSSPEVEDASKFSAPAVVENNWFKRSLPSKTWKLRTVDSTLSHEERERRRRRAAVRSAFVQHLLVTTIFED

SEQ ID NO: 6741 - protein, 469 aa, Zea mays
  misc_feature (41)..(41): Xaa can be any naturally occurring amino acid
  misc_feature (80)..(80): Xaa can be any naturally occurring amino acid
  misc_feature (408)..(408): Xaa can be any naturally occurring amino acid
MFPVVDVKEHEFFNQCNWSHKDKIPGDTMTWLEWILSQWLXGGIAESNPQGMDGFWLQKGSAPPRPAGEVTQEDVQERAXTSLATFVVMDDESANVDPARSEAVMQNGGIRMLLDLARCSRESAQSEAAKAIANLSVNTKVAKAVADEGGITILINLAKSMNRLVAEEAAGGLWNLSVGEDHKAAIAVSGGIKALVDLIFRWPAGTDGVLERAAGALANLAADDKCSLEVAKAGGVHALVTLARSCKLDGVLEQAARGLANLAAHGDNNDNNAAVGQEAGALEALVQLTSSQNEGVRQEAAGALWNLSFDDRNREAIAAVGGVEALVALVQQCLNASEGLQERAAGALWGLSVSEANSIAIGQGGGVAPLLTLARSEVEDVHETAAGALWNLAFYSGNALRIVEEGGXPVLVKICSSSRSKMARFMSALALAYMFDGRMDEVAVPFLLFFLGCLTCLPFDIRICFLVLS

SEQ ID NO: 6742 - protein, 612 aa, Zea mays
  misc_feature (430)..(430): Xaa can be any naturally occurring amino acid
  misc_feature (537)..(537): Xaa can be any naturally occurring amino acid
MGHTSSGNEVPLKYSSGKAFPLGVSQVDDGLNFAIFSQHASSVTLCLNFPERGNQDDVDIVEFALDRQRNKTGDIWHVSVEGLPASGVLYGYRINGPQGWQQGHRFDDSVILLDPYAKLVYGRKHFAVEKEKPSQLFGTYDFDSSPFDWGDNYKLPNLPETDLVIYEMNVRAFTADESSRLAPAIRGSYLGVIDKIPHLLELGVNAVELLPVFEFDELELKRFPNPRDHMVNTWGYSTINLFAPMSRYASAGGGPVAASKELKQMVKAFHNSGIEVILDVVYNHTNEADDVNPYMTSFRGIDNKVYYMLDLNNSAQLLNFSGCGNTLNCNHPVVKELVLDSLRHWVKEYHIDGFRFDLASVLCRGPDGSPLDAPPLIKEIAKDSVLSRCKIIAEPWNCGIDGVTNGLNVLNLWSKQKENFRVAIRSFPGXAHDMKGVLATRDSGSADLYQGNNRKPYHIVNFVIAHDGFTLCDLVSYNSKHNDANGEGGRDGCNNNYSLNRDRVLDKNDVTLQRIRWGNQDSNFLAFTIHEGSSGVXSNRHSIIKIMVSMIFSYLGPPPDAVIPPPPHHKIWSRVVDTNLESPKDIVPEGVPFTGSGYRIAPYSSILLKAKP

SEQ ID NO: 6743 - protein, 140 aa, Zea mays
MDEATKKVEATVLEIPRGSDMESVTENKEEAKAAEEGDAGRESKDKERKEDEEEDEGKGGGKREYDDQGDLILCRLSSKRRVTLSEFKGRSLVSIREFYVKDGKEMPSAKGISMTMEQWEAFCNAVPAIEAAIKKLEDSD

SEQ ID NO: 6744 - protein, 196 aa, Zea mays
  misc_feature (162)..(162): Xaa can be any naturally occurring amino acid
MSEDPVGSRRWRCDLGGDERWLSGAAGDDQFDRLPDALLLVIFNRIGDVKALGRCSLVSRRFHELVPLVDSVLVRVDCVIPDEPPSSSSSSSTPSSPTASVRARGVFSQIARIVLGGIVKPIQALGQILSPANSASGFPASSASSLSSSSSSSSPLAAGDVXDHSPSEVLRSFKELPHLCIELPAGELGMDDGVML

SEQ ID NO: 6745 - protein, 112 aa, Zea mays
MVEIGSRVRGFLRNRWLVFVAAMWMQSCAGVGYLFGSLSPVIKASLGYNQRQVAGLGVAKDLGDSVGFLAGTLCSVLPLWAALLVGAAQNLVGYGWVWLAVTRRVPVPPLWA

SEQ ID NO: 6746 - protein, 82 aa, Zea mays
MPALSMRLHYAPLIELPGGTLLKGATLVAIKPSEDALREGQGAGAAGPVGTCWISEAFEEPYRTAAKVLLKRRAYCLEMNSF

SEQ ID NO: 6747 - protein, 179 aa, Zea mays
  misc_feature (73)..(73): Xaa can be any naturally occurring amino acid
PFLYSLHSKAARRRGLPFPRPKGTRSPPPALGRRRERSPPRPPSPVASPPALCLPPLSVSRVEARSEQLDMYXLDVATDVYPMHAGEKFNMVIAPTLNLDGTPDTGYYTQAGRKTLADNYEYVMQGKLYKISEDTSSSQNAKVEMYASFGGLLMLLRGDPSTAASFELDQRLFLLIRKV

SEQ ID NO: 6748 - protein, 436 aa, Zea mays
MPILSFEGSTWMDHPRGTSRQKKKTSPCFEDIATTTYIHGVCLSGVPNCFQTNAFAFCCCSTTLIACYFFVLFLQVSRPAGDSADKCLPLFAQPALGRTHSPVRPSVRGAPTRHRHQHHRPPGARHAREEEEEEGTGRQRAMAAVVCVTGAGGFIGSWIVKILLARGYAVRGTSRREAADPKNAHLWALDGAAERLTMLQVDLLDRASLRAAFRGCDGVIHTASPMHDNPEEIIEPIIAGTRNVVEAAADAGVRRLVLSSTIGTMYMDPRRDPDAPLGDSSWSDLEYCKSTENWYCYAKTVAEQGAWEAARARGLDLAVVIPVVVLGELLQPSMNTSTLHRGELCRILAGLFPEYPIPTRCKDQVNPLKKGYKFTNQPLKDLGVKFTPVHGYLYEAVKSLQDKGFLPKTSGAKVPERRSCLPQTTSQPPPEIVSKL

SEQ ID NO: 6749 - protein, 333 aa, Zea mays
MEAEAAAKRAREGGEDATAPVAGAEAVVAGAGEQAGISAVIPGWFSEISPMWPGEAHSLKVEKVLFQGKSDYQNVMVFQSSTYGKVLVLDGVIQVTERDECAYQEMITHLPLCSIKDPKKVLVIGGGDGGVLREVSRHISVEQIDICEIDKMVVDVSKQFFPHLAVGFEDPRVSLHIGDGVAFLKNAPEGTYDAVIVDSSDPIGPAQELFEKPFFHSVARALRPGGVVCTQAESIWLHMHIIEDIFVNCRQVFKGSVNYAWTTVPTYPSGVIGFMLCSTEGPAVDFQHPVFNIEEDEHSTKSKGPLKFYNSEIHTASFCLPSFAKRVIESKAS

SEQ ID NO: 6750 - protein, 498 aa, Zea mays
MMKPPAPAVPSPEPPRLAGGGRGPRGLRSLPALSYNTHRALVLGLTFLAYALYHASRKPPSIVKRELARSWPPFADPALLGATDVAFLTSYSLGMFVAGHLGDCLDLRRFLAFGMVTSGAAVALFGAGYFLGQHSLAFYVVAQVIAGLLQSTGWPSVVAIVGNWFSGRRRGLIMGIWNAHTSVGNITGSLVAAAMLGYGWGWSFVVPGGLIALGGVLVLFFLAPYPQYVGFGPSPIEEPVTDESTDGEDISAADGAGKDRRDAVGIFKALAIPGVVIFALCLFFAKLVAYTFLYWLPFYLSQTAIGDEHMSAASAGYLSVLFDVGGIVGGVLAGFISDQLNARATTAAVFMYLAIPSLFLFHAYGSTSKATNIGLMMISGLFVNGPYALITTAVSADLGTHKSLKGDSRALATVTAIIDGTGSLGAALGPFITGLISRKGWDLVFTMLALCALVAAVLLSSHVKTEIPQIIQKWRDRSTNTQNGNADPGVQPLLVDES

SEQ ID NO: 6751 - protein, 463 aa, Zea mays
SKFGSRDCVRLNFSHGTQEDHRKLFNLVKSLSVKYQHQVSIMCDIQGPKIRTGRMEKPFEIRAGEKIDVTPEDVLGTPQLIQIKYATMLKDLDAGDVIFINDGIIKLTVESKSEKALHCVCNAGGQISDRKGCNIPSGNISLDVVTPKDDKDLQLIAELNPEYVASSFIGTAEDVLKVKKVLAGYGNTNIKIISKIERPVALENIDAIIEVTDGLMVARGDLGVEIDTWDVPSAQKMLCQKANAAGKPVIVATQMLESMTQNSRPTRAEANDVYNAVLDGADAVMLSGETATGKYPIAAIQVMDKIVEAAEGHMPERLSTNFLSTKVGMTETIALSVYETAKNFTRIGRKCKIIVITYPPSAYTARMVSKFRPPADVITITSDLRIAREINLLWGVRSVHFPELSEENNMEVRNLTAIKKLIEVGLVQLDNYVICVSRSLFGKHTGACSNVYCLPVLKEEGLL

SEQ ID NO: 6752 - protein, 380 aa, Zea mays
  misc_feature (35)..(35): Xaa can be any naturally occurring amino acid
RTVGGTRTRPMEMRTAEAPAAVAAADGRKPSEMTXGAAVAPLTTIGHPNAPIAQSTSGKKLVFFGSAAAAAPFDLEDLLRASAEVLGKGAFGTTYKAVLESGATLAVKRLKDVTLSEPEFRERISEIGELQHEFIVPLRAYYYSKDEKLLVYDFMPMGSLSAVLHGNVSSGRTPLNWDLRSSIALAAARGVEYIHSTTSTASHGNIKSSNVLLGESYQARVSDNGLTALVGPSSSPSRTTGYRAPEVIDSRRVSQKADVYSFGVLLLELVTGKAPSQAALNDEGVDLPRWVQSVNRSEWGSLVFDMELMRHQTGEEPMAQLVLLAMDCTAQVPEARPSMAHVVMRIEEIKKSSVTPNIEHAGDQSSKAESEAAPTNPFAT

SEQ ID NO: 6753 - protein, 252 aa, Zea mays
MGAAPSSDDSSRAGDGRAVASSAASGTGSNSHQAQSKRAPPPHKFHEIVAQEATTAGGGGGTAAAAELEDQACSTGVYLAGKTKKYWVDEKTRCNCFVLFARALSITWGDDPRYWIWHPVRETNDAEIVEAASLQNVCWLEVHGRLELSHLTPGCSYDVAFQVMLTEPAYGWSVPVNLRLRFPDGTVQARKEKLQGMPTEQWLELRAGEVKAPAQPGGAGRSGELEISMFEYDGGLWKKGLLIKGIKIVPKE

SEQ ID NO: 6754 - protein, 214 aa, Zea mays
AAGDVGDGYSAKCRRVFGRAHEFNIHSVSTNCDGETLVSADDVRINLWHAEVTRQCFNIVDMKPADMEDLVEVITTAEFHPSSCSMLAYGSSSGLVRLVDLRRSALCDHSVRMRVTSVFCNNPPIELSTHHAFQDRENRPQPSTFFSEIISCITDLKFTGDGEHLLTRDYMNLKQAAMRQQRLTLKPRCLQLWDLRVETSPVATYKVHEFLRPK

SEQ ID NO: 6755 - protein, 533 aa, Zea mays
MSSEASSVVVADENGAAETVGVGRYVEMEKDQESSAAKSRLSGLLWHGGSAYDAWFSCASNQVAQVLLTLPYSFSQLGMLSGILFQLLYGLMGSWTAYLISVLYVEYRARKEREKADFRNHVIQWFEVLDGLLGRHWRNVGLAFNCTFLLFGSVIQLIACASNIYYINDKLDKRTWTYIFGACCATTVFIPSFHNYRIWSFLGLVMTTYTAWYLAVASLIHGQVDGVKHSGPTKMVLYFTGATNILYTFGGHAVTVEIMHAMWRPQKFKAIYLMATLYVLTLTLPSAASVYWAFGDQLLTRSNALALLPRTAFRDAAVVLMLAHQFITFGFACTPLYFVWEKLVGLHDCRSLCRRAAARLPVVVPIWFLAIIFPFFGPINSAVGSLLVSFTVYIIPALAHMITFRSATARENAMEPPPRLLGRWTGAYMINAFVVAWVLVVGFGFGGWASMTNFVRQIDTFGLFTKCYQCPPPPPLPFPGGGLGNITMPFNGDGLPPYPGSFAGALLLPPPPASQPPPRALMRDDEMNPAYHQ

SEQ ID NO: 6756 - protein, 128 aa, Zea mays
ENWRRAWVLALWFAAMAALFVWKFVQYRRMAAFQVMGYCLPTAKGVAETLKLNMALVLLPVCRNTLTWLRSSWARFFVPFDDNITFHTMIATAIVVGITLHAGNHLACDFPRVIAASPEEYALVAGAF

SEQ ID NO: 6757 - protein, 576 aa, Zea mays
SPSSASHNLAAPAANRPENRTEMTTSVPVPLASQSQAPQRKPRTYTPSPWGDFFLHHTPCTPSQLLSMKERAKVKEQQVRQIIQETMASSNLLRKLELVDTLQRLGVDYRYNEEIDQLLRSVYDDDDRDGGGSDDLYLTSLRLYLLRKHGYTTSSDVFEKFRDERGSVSSDDAGCLLMLYDAAHTRTHGEEILDDIIAWSKSRLQSLLEEKNLEPELAEEVRCALETPRFRRVKRVEARRYISVYEKKGGRDGTILEFAKLEYNISQAIYCDELKELTVWWKDFQSHIDMRFTRDRLVELHFWMLGVIHEPYYSYSRIMMTKFYIFANFFDDLYDNYGTTEESDVFTAAMERWDEQIAHQLSAGLKVLLVSILNATNKIEEELKLQGNMHAELVKKMVIDTAKSYHAEVKWRDEHFVPTTVEEHLQISIPSSVCMEMTNLALISSRGNMTTREDVEWVFTFPKIVKGACIVGRICNDIVSHEREQASSDHVASTVQTCMKQYGVTTEEATEKLREVIEKAWMDIVQDNLEQERPIALLDTAINVARIADFIYKREDAYTLSFSLKDIIGSMYVYSV

SEQ ID NO: 6758 - protein, 78 aa, Zea mays
  misc_feature (43)..(43): Xaa can be any naturally occurring amino acid
  misc_feature (52)..(52): Xaa can be any naturally occurring amino acid
VCATPTLLLIYIGGWIERLGLICLIAMSCEVKPAVREIIIEVXLVTRLLGRXFIWPDQYFRELIIGDLFVHDMDICYY

SEQ ID NO: 6759 - protein, 347 aa, Zea mays
SGHGPSAEAGEAWLGRGVGCRDKIYRKMGEGTFGQVLECWDRESKEMVAIKIVRSVKKYSDAAMIEIDVLQKLAKNDAAGKHCVQIRNWFDYRSHICIVCEKLGPSLYDFLQKTGFHPFPIDLIRRIGQQLLESVAFMHRLQLIHTDLKPENILLVSSDYVKLPDPKDGSFSRKLPKSSAIKLIDFGSAAYHHQDRSYIVSTRHYRAPEVILGHGWSYPCDIWSVGCILVELCSGETLFQTHENLEHLAMMDRVLGPLPRHMLERADQHAEKYVRKGGLNWPQAITTVESVRAVLKLPRLQNLVMQHVDHSAGDFIDLLKRLLAYEPSGRLTAQEALGHVFFTRYRQ

SEQ ID NO: 6760 - protein, 506 aa, Zea mays
  misc_feature (51)..(51): Xaa can be any naturally occurring amino acid
MASPAMVPLRQLFVDGEWRPPAQGRRLPVVNPTTEAHIGEIPAGTAEDVDXAAVAAARAALKRNRGRDWARAPGAVRAKYLRAIAAKVIERKPELAKLEALDCGKPYDEAAWDMDDVAGCFEYFADQAEALDKRQNSPVSLPMETFKCHLRREPIGVVGLITPWNYPLLMATWKVAPALAAGCAAVLKPSELASVTCLELADICKEVGLPPGVLNIVTGLGPDAGAPLSAHPDVDKVAFTGSFETGKKIMAAAAPMVKPVTLELGGKSPIVVFDDVDIDKAVEWTLFGCFWTNGQICSATSRLLIHTKIAKKFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTQYGLAGAVISGDRERCQRLSEEIDAGCIWVNCSQPCFCQAPWGGNKRSGFGRELGEGGIDNYLSVKQVTEYISDEPWGWYQSPSKL

SEQ ID NO: 6761 - protein, 229 aa, Zea mays
  misc_feature (66)..(66): Xaa can be any naturally occurring amino acid
MDSEHWISRLAAAKRFYAAQLGHSDRAGMDELEMDEEVRPEFPCPYCYEDHDVGSLCAHLEEEHPXVEPQAAACPVCSEMVTKDMVNHITTQHGYLFKNRRRLRRFIIPGSQALSLLSRDLREAHLQVLLGGGGQRSSDNNSSSATNISADPLLSSFGLGFPTSDAEQASKSTVSIPDDATTVKEAPAQARKLSIDSSLTSEERELKRKQARVRATFVQDLLLSTLFGD

SEQ ID NO: 6762 - protein, 229 aa, Zea mays
  misc_feature (182)..(182): Xaa can be any naturally occurring amino acid
MGANGHPPASTVAQNGSHSGGGGGGGGGVNPSNGGTGAALRHDPGLAREWSTEEQTILDELLVKYASDLPVVRYAKVAMKLPEKTVRDVALRCRWMNKKESAKRKKEDHNSSKKSKDKKEKVSDSSSKPPVHMVGRPNVPPYPLPVLPMDDDEISSKAIGGPTGEILETNAHVLGQISSNLXSNMQDKISSAPPCQTRDNILRVLKEYVLNCYCVYIKIFLKSYIRLIR

SEQ ID NO: 6763 - protein, 375 aa, Zea mays
MAAAAIHQFAECITCHAWSPDQSMIAFCPNNHEVHIYKFFTDKWEKLHVLSKHDQIVSGIDWSNSSNKIVTVSHDRNSYVWTQEGSDWIPTLVILKLNRAALCVQWSPKENKFAVGSGAKSVCICYYEQENNWWISKVIRKRHESSVTSLAWHPNNIYLATTSTDGKCRVFSTFIKGVDTRGSQSSTSTNSKFGEQIAQLDLSSTWVFGVRWSPSGKTLAYAGHNSMVYVIDEVESSPVAQNLTLRDLPLRDVLFVSERTLVGVGFDCNPMIFAADDTGLWSFVRFLDEMKAAPSASKASQLSEALGKLYGQSKQGASSDTVEPSKARGGAHENCITCIVPLRKGSDGTIKRFSTSGLDGKVVVWDLENHVSIAK

SEQ ID NO: 6764 - protein, 512 aa, Zea mays
MDSAASVLAILSKLQSLGFCADLRVPDAVAASDPSEAFDAVLATFLREAYTGGREARPIPVALGNGRCVDLLRLFLAVRAAGGYAGVPNTPGGWAAAAESAGIDSALAAPVKLVYAKYLGALDRWIQRLVEAHGPFLDGDMRKRQELFIGTDGVEGEEGLLGYNGREQRHVMLKRKRGDVVGMLGWVREMAENAGNDVAVSAGSSAECFSMALAVRKMVTTKKARRASMLDASLFQEIFPMACNCCIGPTGVGNCAKAKLLNGSSVLTKPDINLTGEGKHESRTSNSSNGWLFKSHQKNEIPVGPNYQIHVPQWTSEVPTNYDDPETLKWLGTKVWPPENEGCKTLFCGDPIGKGREVVCGCVYPGSVECVRFHVAEWRLKLKHELGAAFYAWGFNRMGEEIALSWTDEEEASFKAAAQHSAASSGRNFWNRLHLFFQFKGRKELVSYYFNCFLLRRRCYQNRITPKNIDSDDDEETEFRFLGNRLGHRAAKYHSTKHTACIENTHSMDLDE

SEQ ID NO: 6765 - protein, 251 aa, Zea mays
DTCNFINVLLCIFFLKIDKVTPLLTLARSEVEDVHETAAGALWNLAFYSGNALRIVEEGGVPVLVKICSSSGSKMARFMSALALAYMFDGRMDEVALVGASSASSSKSVNIEGARRIAFKHIETFVLTFSDPQMFSTAAASSAPAALSHVAEAVFIQEAGHLRCSRSEIGRFVVMLRNPSPILRACAAFALLQFTIPGGRHAVHHAGLLQEAGAGRVLRAAAAATTASIEAKIFARIVLRNLEHHQSGTST

SEQ ID NO: 6766 - protein, 369 aa, Zea mays
  misc_feature (229)..(229): Xaa can be any naturally occurring amino acid
MDSLAAACLCSRRRRARRLLLAAAAATTGYGLYRLYRYHRRRIVAALSLADAVSQVGSDLAEFLRSESDQVPRSLLQLSKLAASEPVSSAASSLSESLASGVLRAISHQRQLHQQQQKNPQTPLQDRILDRLLSPEGAGFASAVVGSLARSLVLSSCDARRAEAGDREEPRWLAALCSATGKEASADLVRVFVSTAVAAYLDRTAAVRSNNHLLAGLSDPRHEAQVKDXLAVSVCNGAIETFLRTSRQLAKEASSARIEVTSMERVVEDSDSNCVIHKVSSTLAAPSNRRFVLDVTGRVTAETVRSFLDFLAQRMSDGARKSIVIARDEVAERGLVAVKYLGAKSMAIFTISLALCMHILMGTRFLLPA

SEQ ID NO: 6767 - protein, 562 aa, Zea mays
MHLTVMSLSAAVANGAAAYRYDTIQPVARLRFCGLRRKAHRLHSPRYSRHLVAARRSVVVAATAGNGAAASGTFDYDLVIIGAGVGGHGAALHAVEKGLKTAIIEGDVVGGTCVNRGCVPSKALLAVSGRMRELQDEHHMKSLGLQVSSPGYDRQVVADHANNLASKIRSNLTNSMKALGVDILTGIGTIVGKQKVRYGKVGFPDNEITARNIIIATGSVPFVPKGIEIDGKTVFTSDHALKLESVPEWIAIVGSGYIGLEFSDVYTALGSEVTFVEALDQLMPGFDPEIAKLAQRILISPRKIDYHTGVFASKITPAKDGKPVLIELIDAKTKEHKETLEVDAALIATGRAPFTKGLGLENINVVTQQGFVPVDERMQVMDATGNVVPNLYCIGDANGKLMLAHAASAQGISVVEQISGRDNILNHLSIPAACFTHPEISMVGLTEPQAREKADKEGFEISVVKTSFKANTKALAENEGDGLAKMIYRPDTGEILGVHILGLHAADLIHEASNAIALGTHVQDIKFAVHAHPTLSEVLDELFKAAKVNTAGSHSMNEPVAV

SEQ ID NO: 6768 - protein, 233 aa, Zea mays
MGKLAARLRAFSRNRWLVLVAAMWVQSMAGIGYLFGAISPVLKARLGYNQRQLAALAVAKNVGGYVGVVAGTLSAALPAWAMLLMGAAQNLLGYGWLWLIVTGKAPPLPLPLMCVLIFVGNNSATYFNTASLVTCVQNFPASRGPMVGILKGFLGLTSAILTQVYAVTRATDQASLILIIAVGPSLVAVAVMLVVRPVGGHLQARASDRVSFVFVYAVCLLLASYLAGVKLVQ

SEQ ID NO: 6769 - protein, 131 aa, Zea mays
STSIHLNTPKVPRQFCGGGNFKMNGVTDSIKSIVSNINNSKRDPSTEVVIAPPAIYLALTRALADPSVGVSAQNVYDKPSGAYTGELSAEQLKDAKIDWTIVGHSERHVLLREDDDFVARKTKAAIDGRLS

SEQ ID NO: 6770 - protein, 406 aa, Zea mays
  misc_feature (20)..(21): Xaa can be any naturally occurring amino acid
  misc_feature (271)..(271): Xaa can be any naturally occurring amino acid
RCFVRDVGSFLLTLSALSIXXTIGKVTVWGAMMFVSIYVVYAFVVAANEVLRKHARRLKFDVFTPLLPVRASIFEQGAEQDESAYSSLLEEDADGEVTQMNTSVPQWMWASHVAIYSNHGNRDGSPGSSRPLWGWSEGEVDNSTFNIYKLFSFMELPLTIPRKLTIPIVEEDRWSKEYAVASSCLAPVLLAFLWSSQDTVFTKVSIAAYVMAVMLGIALAALVFLFTSNERPPRRFLFPWVFGGFVMSIIWFYIIANELVALLVALGVILXINPSILGLTVLAWGNSMGDLMSNVALAMNGGDGVQIAMSGCYAGPMFNTLAGLGISMLLGAWSTAPNSYVLPQDHSLIYTMSFLVAGLIWALVMLPRGDMRPNKILGVGLISLYSVFLFIRVSNAVGILPLPGLS

SEQ ID NO: 6771 - protein, 74 aa, Zea mays
  misc_feature (51)..(51): Xaa can be any naturally occurring amino acid
MAGGVAHTSTRMANGGAPRGELTMSETCCQLRKQGKRASMPFITAGDPDLXTTWKASKILNSCGSDDINMTRPY

SEQ ID NO: 6772 - protein, 420 aa, Zea mays
  misc_feature (313)..(313): Xaa can be any naturally occurring amino acid
MASWDNLGELSNIAQLTGLDAVKLISLIVRAASTARLHKRNCRRFAQHLKLIGGLLEQLRVSELRKYPETREPLEQLEDALRRGYLLVNSCQDRSYLYLLAMGWNIVYQFRKAQSEIDNYLRLVPLITLVDNARIRDRLEHPERDQCEYSFDEEDKKVQDALLNPDPCSNPTIVLKKTLSCSYPNLPFNEALRKESEKLQVELQRSQSNMDLGSCEVIQHLLGVTKTVESTIPEKETNVKAPEKKGSNYSESKGETAKSFDDDDDYPKKQKDTCSTQRCSSQVPYGHDLVSSRGSYSDEWHADLLGCCSEPAXCLKTLFFPCGTFSRIASIAKDRPMSSGEACNDIMAYSLILSCCCYTCCVRRKLRQKLDIAGGCCDDFLSHLLCCCCALVQEWREVEIRGAYSEKTKVTPPACQYMEH

SEQ ID NO: 6773 - protein, 104 aa, Zea mays
  misc_feature (65)..(65): Xaa can be any naturally occurring amino acid
TRVRSRLCPRIRIRVRAGASYVVTAAANVPANQKACCHAVNGPGYASPLEDMDNGTMEKLVYVTXVYNGTGFNKPNYLTTANLYPSCPTYSYLIHRLTVTHICD

SEQ ID NO: 6774 - protein, 419 aa, Zea mays
RYYSDTDSVSACIDNAMRALFLLALFCVVHGEKAKSKDNDAKASGPGGSFDITKLGASGNGKTDSTKAVQEAWASACGGTGKQTILIPKGDFLVGPLNFTGPCKGDVTIQVNGNLLATTDLSQYKDHGNWIEILRVDNLVITGKGKLDGQGPAVWSKNSCVKKYDCKILPNSLVMDFVNNGEVSGITLLNSKFFHMNMYKCKDMLIKDVNVTAPGDSPNTDGIHMGDSSGVTITNTVIGVGDDCISIGPGTSKVNITGVTCGPGHGISIGSLGRYKDEKDVTDINVKDCTLKKTANGVRIKAYEDAASVLTASKIHYENIKMEDSGYPIIIDMKYCPNKLCTANGASKVTVKDVTFKNITGTSSTPEAVNLLCSAKIPCTGVTMDDVNIKYSGTNNKTMAVCKNAKGSAKGCLKELACF

SEQ ID NO: 6775 - protein, 175 aa, Zea mays
MSATDHLVMARVIQDVLDPFTPTIPLRITYNNRLLLPSAELKPSAVVSKPRVDIGGSDMRAFYTLVLIDPDAPSPSHPSLREYLHWMVTDIPETTSVNFGQELIFYERPDPRSGIHRLVFVLFRQLGRGTVFAPEMRHNFNCRSFARQYHLSIATATYFNCQREGGSGGRRFREE

SEQ ID NO: 6776 - protein, 453 aa, Zea mays
MTKDEEFKLVKIQNHALKVNIHCDGCKHKVKKLLQKIEGVYSVAIDVDNHKVSVTGDVDSETLIRKLTRGGKHAELWSQHKGGSAQQKQQAQQQQQQKQGGNPSKDGHSKSSNNGGGQKKDQGKQGGGGGVGGGLVQGLKAFKNQHGGNKQHHQLPELLSSEDDDGMFDDDVDGEFDDDYEEELRFLGDKMSQLGLHGGGNNNQHHHHNKNGNNVVAVNSNHSNGGKKGNGCAAANRHQNNNQNQKNVNVVNMAAANGKMGGGGGVQNHKNANAINMAAAAAAAANAKMANGAQRNAGAMGGIGMLGLSHGLGAGGAAAPPPPGFQGYAGFNHPPYAGAAGYGGGLQQQQQQSNSLMASMQGYHHHHPAATAAVVNNLRGLNGNMVMMHQQPQQQQQPQMMYHSSPQISPYTGYYNPYNYYYHPHPGSAGYPPSNGDVETMFSDENTKGCVVM

SEQ ID NO: 6777 - protein, 425 aa, Zea mays
PPPPPPPPLPKTLPTLFSPSLSFHLHSNGGPTRPAKLLVLVSTIFIRYFAILLKYSPPPLPWPPSTLSNSSAAAAAQKAEAKKSAVAPAGKAAQPAATTKFPTKPAPPSQTVRDARGGGSSARGGFGRGERGRGRGGRGYGQNRGFSGDNGSDFQGGYGGGGYGDGAVTGGSEGERERDTRPPYRGGGRRGGYRNVEFADDSERPPRRNYERHSGTGHGYEMKRDGAGRGNWGTATDELIAQDAEDSPKMEEAAPVAEKQGEQNDAPAADENKDNKDATANEEEEKEEDKEMTLEEFEKIREEKRKALLALKAEERKVEVDKDLQSLQPLSNKKENDEVFIKLGSDKDKKKENAERDERAKKSVSINEFLKPAEGERYYGGRGRGRGRGDRGGFRGGYGGGYSRGPAAAAPSIEDQAQFPSLGGK

SEQ ID NO: 6778 - protein, 393 aa, Zea mays
  misc_feature (292)..(292): Xaa can be any naturally occurring amino acid
MAIRRGGSQSYGFPIYCAAWLPLAHILKPDRPAAEADADAPSPSPPPPPMVLLGGGGGKGRNGVPNKLVMAALAAGEEAAPALSPDTVIEVRTQEEVPYRMAVHPRGDGVFCAFPNGCKLYRWESQEGEGLQNLSLEPDQEALAELKEDGLQLAISFSQEGSILAIGGEDGHLRVFKWPAMAPVLTETDTKTSIKDLTISSDERFIAVNRSSGPCRVWDLHSSEVVASLPREAGEMFGFCRFCNKADNSHVLFITAMEGDYGKIVSWNTTSWTRTGSKKITREAISAFAVSXNGALLAIGTIEGSVVIVDSKDMRTLVTVKKAHLGVVTTLSFSQDSRTLLSTSFDSTARVTYVGSPKSNGTSIWPILLAIILAVLVYYCMQHKEDILAMLPR

SEQ ID NO: 6779 - protein, 95 aa, Zea mays
  misc_feature (31)..(31): Xaa can be any naturally occurring amino acid
  misc_feature (77)..(77): Xaa can be any naturally occurring amino acid
PPAGSPTHEVSIFVKQLKVRNWVLPERPGLXLDCVISLFDRNLYLGNWLQGNIRQDTIEDPEEPFLAQQSCRGGLLXKGRDVVYVTVNVHEQHTD

SEQ ID NO: 6780 - protein, 179 aa, Zea mays
  misc_feature (36)..(36): Xaa can be any naturally occurring amino acid
  misc_feature (55)..(55): Xaa can be any naturally occurring amino acid
  misc_feature (95)..(95): Xaa can be any naturally occurring amino acid
MGDCSEFFFAPTPAECIYQHKQLALTMDHDHTRVSXEFLQDMEPRMQQDFVDMRXSEKGDIAKPDEGRMVGHYWLREPALAPDSFLRNKIQTALXRILGFSQDVISGKNLSPSGRFTSNLSIRIGGSALRPQFVAEPLAPDNPPLKVTFIDNIDPGGIDHQIAQLGSQLATSYSCNCHF

SEQ ID NO: 6781 - protein, 126 aa, Zea mays
  misc_feature (44)..(44): Xaa can be any naturally occurring amino acid
  misc_feature (79)..(79): Xaa can be any naturally occurring amino acid
  misc_feature (90)..(90): Xaa can be any naturally occurring amino acid
GGSGIASHNPAERPCEGFLPRTECIYGQRCLYPHSYCISDSICXLTLLKGHKQGVTGIALTAGSYKLYSASKDGTVPMXDRQTGHCARVXTTGREVRCLIIEGAGVFGGIPDAHEGVEYANSRGND

SEQ ID NO: 6782 - protein, 695 aa, Zea mays
  misc_feature (671)..(671): Xaa can be any naturally occurring amino acid
MRSPSHHDRDLLLLLLVLAAAVGSRSDDTHACRSRPYLCGGVNISYPFHLASDATAVPGHDGESYCGYPGLAVSCDGGNKAVLNLGDHDYTVSRIDYANQTVSLADAGASSGCPVVDHNVTIPQDVRLSLLHSIDYLLFFAGCSFGPGAGPDPRPPKPPSIEPVTCGESGDLGKPAAAMTFVLPRAEVPPGDWASACRKVFQVPVLKGSVPPDAQHDPLWTSGGGYGEALRAGFQLGWDRGSGPCARCEQSGGKCGYGRAGEFLGCLCAGSRVDGGGDCSKMSAGSSDLPWFGPKSKTAVIAGVAAGAGVAILAAAIFLFVRRKRKQKRVVNSSSKLLKYSGSGGTPRSRVGDMESGSIEDPPTHLFTYEELEEATSCFDENRELGDGGFGTVYKGYLKDGRVVAVKRLYNNSYRRVEQFQNEAAILSGLRHPNLVMFYGCTSSQSRELLLVYEFVANGTVADHLHGQRAAERALPWPLRLGVAVESAAALTYLHAIEPPVVHRDVKTTNILLDADYHVKVADFGLSRLFPLDVTHVSTAPQGTPGYVDPEYHQCYQLTDKSDVYSFGVVLVELISSKPAVDVTRHRNEINLAGMAISKIQKCQLEELVDIDLGSEADPATKKAMTAVAELAFRCLQQNGEMRPPIKEVLEVLRSIQGEYQTGKDGDKNKXGPLSPTTVHAPWESRATTPNTSRD

SEQ ID NO: 6783 - protein, 263 aa, Zea mays
MDCSSGDVKAETTRPAAVAAAAAAAAGGGTPSLLRGWREFRRSAVPARFLCFEDGKWVDVAGEAAAQLRRAFQERRVMADASCGGKAYLFDFLRMVRIDEATGEETGLAWIDHRGGCFFPAPAACGGGRKRGRDDDGAPAEDKAEAESSSAASGVDDRSGGESRGADAKRRKALGNAAASLGEKDRSYQVVSKLFLEYGMAQRGAAVTAVRKVACGARAAAFRDQGRFLADARGAGAGSGKFAWYGASADDVAGVVDRSFASN

SEQ ID NO: 6784 - protein, 684 aa, Zea mays
  misc_feature (644)..(644): Xaa can be any naturally occurring amino acid
MRSPSPPPWRLRRIRFSFPMLLLVASLAGADDLASDARALVAFRDAVGRRLAWNASDVAGACSWTGVTCEHGRVAVLRLPGATLSGTVPAGTLGNLTALHTLSLRLNGLSGALPADLSSAAALRNVFLNGNRLSGGFPQAILALPGLVRLSLGGNDLSGPIPVELGNLTRLRVLLLENNRFSGEISDVKLPPLQQFNVSFNQLNGSIPASLRSQPRSAFLGTGLCGGPLGPCPGEVPPSPAPAGQTPSPTPVPSGRGGGGGGGGGTNGGSGVENGHKGKKLSGGAIAGIVIGSALGAALLLFLLVCLCRRSGGIRTRSLEMPPSSPAPAGGRKPPEMTSAAAVAPLTTIGHPNAPIVQSTSGKKLVFFGSSAAVASFKLEDLLRASAEVLGKGTFGTTYKAVLESGATLAVKRLKDVTLSEPEFRERISEIGELQHEFIVPLRAYYYSKDEKLLVYDFMPKGSLSAVLHGNITSGKTPLNWDLRSSIALAAARGVEYIHSTSSTASHGNIKSSNVLLGESYQAHVSDNGLTALVGPSSSPSRATGYRAPEVIDPRRVSQKADVYSFGVLLLELVTGKAPSQAALNDEGVDLPRWVQSVSRSEWGSKVFDIELMRHEADEEPMAQLVLLALDCAAQVPEARPSMXSVVTRIEEITKSSVTANISKAESEAAPTNPFATSTDPFCY

SEQ ID NO: 6785 - protein, 239 aa, Zea mays
  misc_feature (55)..(55): Xaa can be any naturally occurring amino acid
  misc_feature (115)..(115): Xaa can be any naturally occurring amino acid
  misc_feature (123)..(123): Xaa can be any naturally occurring amino acid
  misc_feature (159)..(159): Xaa can be any naturally occurring amino acid
  misc_feature (206)..(206): Xaa can be any naturally occurring amino acid
MAALAASSTAAFAAKPRLPRARLTVACSATGGDGNGSSSSSVSLASSVKTFSAAXLALSSVLLSSAATSPPPAAADIAGADPVQGSPRAFAKREKNSIKKLTASLKKYAPDSAPXALAINATXEKTKRRFENYGKFGLLCGADGLPHLIVSGDQRHWGXEFVTPGLLFLYIAGWESGGSARSYLIAISGEKKPAMREIIIDVELAXASSPRGFIWPRPRPYRELINGDLVVDDKDIGYY

SEQ ID NO: 6786 - protein, 453 aa, Zea mays
MTTTTKQLRRVRTLGRGASGAVVWLGSDEASGELVAVKSARAAGAAAQLQREGRVLRGLSSPHIVPCLGSRAAAGGEYQLLLEFAPGGSLADEAARSGGGRLAERAIGAYAGDVARGLAYLHGRSLVHGDVKARNVVIGGDGRARLTDFGCARPAGGSTRPVGGTPAFMAPEVARGQEQGPAADVWALGCMVVELATGRAPWSDVDEDDLLAALHRIGYTDDVPEVPAWLSAEAKDFLAGCFERRAAARPTAAQLAAHPFVVASAAACAAIRGPAKQEVVPSPKSTLHDAFWDSDAEDEADEMSTGAAAERIGALACAASALPDWDTEEGWIDLQDDHSAGTADAPPAPVADDFISWAEPSDAELEPFVAVAAAAGLPHVAGVALAGATAVNLQGSYYPPMHLGVRGNEIPRPLLDHHGDALEKGQGSHRTCNRETEKVTMKRISLKKKKKKK

SEQ ID NO: 6787 - protein, 572 aa, Zea mays
  misc_feature (55)..(55): Xaa can be any naturally occurring amino acid
  misc_feature (111)..(111): Xaa can be any naturally occurring amino acid
  misc_feature (162)..(162): Xaa can be any naturally occurring amino acid
  misc_feature (185)..(185): Xaa can be any naturally occurring amino acid
  misc_feature (198)..(198): Xaa can be any naturally occurring amino acid
  misc_feature (211)..(211): Xaa can be any naturally occurring amino acid
  misc_feature (223)..(223): Xaa can be any naturally occurring amino acid
  misc_feature (231)..(231): Xaa can be any naturally occurring amino acid
  misc_feature (243)..(243): Xaa can be any naturally occurring amino acid
  misc_feature (280)..(280): Xaa can be any naturally occurring amino acid
  misc_feature (364)..(364): Xaa can be any naturally occurring amino acid
  misc_feature (497)..(497): Xaa can be any naturally occurring amino acid
MGSSGFSWTLPDHPKLPKGKPVAVVVLDGWGEANPDQYNCIHVAQTPVMDSLKNXGAPEKWRLVKAHGTAVGLPSDDDMGNSEVGHNALGAGRIFAQGAKLVDQALASGKXIYDGDGFNYIKESFESGTLHLIGLLSGMVVSTSRLDQLQLLLKGVSERGAXKKIRVHILTDGRDVLDGSSIGFXVETLENDLLELRXRKGVDAQIASGGXERMYVTMDRYEXNDWDVVKXVGWDAQVLGEAXPYKFKSALEAVKTLRAQPKANDQYLPPFVIVDDSGNXAVGPVLDGDAVVTINFRADRMVMLAKALEYADFDNFDRVRVPKIRYAGMLQYDGELKLPSRYLVSPPEIDRTSGEYLVKNGIRXTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSXGKPLLDKNDRIQILTSHTLQPVPVAIGGPGLHPGVKFRNDIQTPGLANVAATVMNLHGFEAPADYEQTLIEVADN

SEQ ID NO: 6788 - protein, 395 aa, Zea mays
MLKKASRSHDHDPYFGTPVPRLYAAPARSLLRITFPSYSLSLSLSLSLSLLLSLSRPLGLLLYPPHKPRPSAVCTATAVHGRRARRDDDDDDRAAMTTTTTAAAAVAQLCAGPRRRKQAAGARLDLRWARLLRLAVVTRVLRLARDQLLACSSCGGGTAARRRYRRLGPPTSASAGPVLSPVDRDDDCAADAEAAAPRDAADDEDNVVSLKVSLLGDCQIGKTSFMVKYVGDDGEEQNGLQMTGLNLMDKTMPVRGARIAYSIWDVAGDHQSVDHVPIACKDAVAILYMFDLTSRCTLNNIVDWYGRARKWNKTAIPILIGTKFDDFAQLPLEMQWAIVNQARAYARAMKATLFFSSATHNINVNKIFKFITAKLFNLPWTVERNLTIGEPIIDF

SEQ ID NO: 6789 - protein, 121 aa, Zea mays
MPCLNVSTNVNLEGVDTSAILAEASKSVANIIGKPEAYVMVVLKGSVPMAFGGTQEPAAYGELVSIGGLNPDVNKKLSAGIASILESKLSVPKSRFYLKFYDSKAHPAQENAQCLHALHQE

SEQ ID NO: 6790 - protein, 70 aa, Zea mays
IGGSALGPQFVAEALAPDNPPLKIRFIDNTDPAGIDHQIAQLGPELATTLVIVISKVHKDPKLSYFVDIF

SEQ ID NO: 6791 - protein, 112 aa, Zea mays
FNPQQDFVLIWGINSTYTLQLLSIYEHRIAVQGFIWGINSFDQWGVELGKSLASQVRKQLHGTRMEGKHVEGFNHSTSSLLARYLAVRSFAMSCPLMVIIIIKPVKFLKYHI

SEQ ID NO: 6792 - protein, 103 aa, Zea mays
LFRSKLAAAILGGVDQIHIKPGATVLYLGAASGTTVSHVSDIVGPDGLVYAAEFSHRSGRDLINLAKKRSNIIPVIEDARHPHKYRMLIAMVDVIFADVAQPD

SEQ ID NO: 6793 - protein, 237 aa, Zea mays
AAVVAKNGGHGAVVEEIHGLIRVYKDGHVERLPAIPAVPCTWGGTAAPDAPGGVVARDVVVDPATGVWARLYAPTSAGDGARRPVVVYFHGGGFCVGSAAWSCYHEFLAQLAARAGCAVMSVDYRLAPEHRLPAAFDDGLAAVRWLRPCSNDDLSWWRARCGFDRVFLMGDSAGASIALHVAARLGQGQLGALPPLTVRGARLIQPFLGGEGRTASEKNVAQPPRSAADAAHLPTAT

SEQ ID NO: 6794 - protein, 499 aa, Zea mays
LQLPATVRIDIPPTSPGRAALKVWEELVNVLRKDGADPAAAFVHRKKVQHAEKSIRDAFLALYRGLDLLKKFSSLNVKAFTKILKKFVKVLDLPFTQNPDTHTLTLCCAVSEQHRKGDLFSEKVKRSPFSSSDKVLQLADEVECIFLRHFAGNDRKVAMKYLKPQQPRNTHMVTFLVGDMFALISLHVFLYGCNLSMWKGTRINHNFIFDFSSTALTHRDAFLMSASIMCTVVAALVVNLFLRNAGATYANALPGALLLLSAGVLFCPFNIFYRSTRFCFMRVMRNIVLSPFYKVLMADFFMADQLTSQIPLLRHLEFTGCYFMAETFRTHAYGSCTSSSQYKNLAYVLSFLPYYWRAMQCLRRYLEEGHDMNQLANAGKYVSAMVAAAVRFKYAATPTPFWMWMVIASSTGATIYQLYWDFVMDWGFLNPKSKNFWLRDQLILKNKSIYYASMMLNLVLRLAWAESVMKLRLGMVESRLLDFSLASLEIIRRGHWNFY

SEQ ID NO: 6795 - protein, 149 aa, Zea mays
DRLEYIERDQCEYSFDEEDKKVQDALLNPDPCTNPTIVLKKTLSCSYPNLPFNEALRKESEKLQVELQRSQSNMDLGSCEVIQHLLGVTKTVESTIPEKETNVKAPEKKGSNYSESKGETAKSFDDDDDYPKKQNNEYPKKQKDTCSTQ

SEQ ID NO: 6796 - protein, 292 aa, Zea mays
LGTPESSLLQEEFVTAASGEAHHQARARRASDETLAVHAGEKLAGKKDADVGGTGTETDSTATPIVSGTTHWFKSSEDLIAFKEGRRHSFKYGRYSNPTVKVLEEKISALERAEATLVTSSGMNAITTTLLALVPPGGHIVTTTDCYSEARVFIRDRLSMMGAIRSTFVDLDDGMKSLKAVLDENDDVALFYTDSPTNPMLKCVDIRHVAELCHRKGALVCIDSTMASPINQKPLTLGADLVLHSAIKYMAGHHDAIAGCVSGSEALITRIRAWHHHLGGVISPVCPSLTLA

SEQ ID NO: 6797 - protein, 118 aa, Zea mays
CCPVNFEFQNYTIITSKCKGPKFPAGPCCAALKEFACPYYTYLNDESNDCASTMFSYINLYGKYPPGLFSSDCKEGKQGLSCADVLERDSATASSGHHAQISLLALITVLSVVVALFH

SEQ ID NO: 6798 - protein, 89 aa, Zea mays
DLQEEIIRMCRSMGKAVIVATNMLESMIVHPTPTRAEVSDIAIAVREGADAVMLSGETAHGKFPLKAVKVMHTVALRTEATIPGGETPA

SEQ ID NO: 6799 - protein, 351 aa, Zea mays
  misc_feature (148)..(148): Xaa can be any naturally occurring amino acid
MAGRTEEARRSGERETVCVTGAGGYIASWLVKLLLSRGYAVHATVRDPRDPKNAHLGQLEWAAENLRLFKADVLDSDALAAAVSGCRGVFHVACPVPTDRVLDPESEVLAPAVQGTLNILQACSANNIQKVVVVSSTAAVHFDPNWAXHRPKDEDCWSDINFCKKNEDWYMVAKVIAEKTALEYGERNGLNVVTVCPTMALGPLLRPMLNVSHEFLMYIIKGGPTMMKNIPWHIVDVRDVVDALLMVYKKEESTGRYICAPNCISAKDLVNMLKRDYPNYNYVNCDNDMVLNSIVTPLMSEKLKNLGWKPMKTLEETLLDSVECYKKMGLLKDAEGCPCRLPHLFHMAIEK

SEQ ID NO: 6800 - protein, 347 aa, Zea mays
MAGRTEEARRSGERETVCVTGAGGYIASWLVKLLLSRGYAVHATVRDPRDPKNAHLGQLEWAAENLRLFKADVLDSDALAAAVSGCRGVFHVACPVPTDRVLDPESEVLAPAVQGTLNILQACSANNIQKVVVVSSTAAVYFNPSWPQGRTKDESCWSDRDLCIKNENWYCAAKTIAEETAVEYGEKNGLIVVTVCPCIALGPLLRPMLNVSNEFLMYIIKGGPSVLKNLPWNIVDVRDVADALLLVYEKVESSGRYICAPNRISTNNMVNLFKKSYPNYNYVNCDNKDYESEISPVTSEKLKSLGWNPRTMEKTLLDNIEYFEKAGFLRDAEGYPCRLPSYFSFRF

SEQ ID NO: 6801 - protein, 520 aa, Zea mays
  misc_feature (127)..(127): Xaa can be any naturally occurring amino acid
MGWVVSTMLCYVFRKRHCYIGCSKNWCLMWELAQYASTLRESGGPLSPSRILSNLRNIGCRLGGGTQEDAHEFLRHLVMSMQAACLDGLGGEKHVEPSLQETTLIQQMFGGRLKSKVKCLRCYHESXRTWNIMDLTLEIHGWVESLQDALTQFTAPEDLDGDNMYKCGRCSAYVKARKQLSVHEVPNILTVVLKRFQSGKYGKINKCVTFPDMLDMVPFVTGSGDNPPLYFLYAVVVHVDTENASFSGHYISYVKDMQGTWLRIDDSEVQVVSVNQVMSEGAYMLFYLRSFPRPPRIYIEKGLPVTSAKRHTSKSSKGSKHDRKQTELLFPANDQAYGVYDFRPDGEGYAQDQHAELRSRAFHHADDAFADSVSADFSEATSSEWSLFTSSDESSFTTESTRDSFSVVDYGDNAGLDPISSIFGPSYAPEHGAPGSFVSRTRFSPSSPQTRYFSESTGFVSDSSMPAHPHGIVHRGRYPDSRACASSAEPLASAAHQRSGYGRYPLSRDGFVQTSGFCQM

SEQ ID NO: 6802 - protein, 299 aa, Zea mays
PRPPVPRSAPRRRFSPIPICAPAADHFERLHDAVLLDVLNRIGDVKALGRCALVSRRFHALVPLVDSVFVRVDCVIPDDPPSSSSAAPAPTARGRGALARVARALLGGVARPIHALGQILSSAAATVSRRSEPLPASPPPAPVADVSHHSPSEVLRSFRELRRLHIELPTGELGIDDGVLLKWKADFGSTLGSCVILGASSVSSKSPAGSAQAETAAADSAAAAPDTGRETEEPGSLPDSLYTNGGLKLRVVWTISSLIAASARHYLLHPIICNHGTLESLDLTDADGQGVLTMDKRQL

SEQ ID NO: 6803 - protein, 272 aa, Zea mays
  misc_feature (20)..(20): Xaa can be any naturally occurring amino acid
MVRSPRGRPGRVSGRLVSDXNIELDEVSGSSESTTLLAGAEESDNLNEDQGSDFGGIKSVGKLLAPKLIRATLLLWMAFFGNAFAYYGIVLLTSELSNGNRICAKEDVESVHSTNASLYKNVFISSFAEIPGSFLSAMIVDRFGRKRSMASMLFTSCVFLLPLVFSRTDILTRISLFGARLCISASFTIVYIYAPEIYPTAVRTTGIGIASSVGRIGGILCPLVAVALVHSCQQTTAILLFELVIFLSGLAVSFFPFETKGCRLNDTDVDMN

SEQ ID NO: 6804 - protein, 169 aa, Zea mays
MAMAAGRGLLALFSVVVVAGLTSAANGPFLSDSVFQPSAGSTGRSLLQAKNSCPVNFEFQNYTIITSKCKGPKFPAGPCCAALKEFACPYYTYLNDESNDCASTMFSYINLYGKYPPGLFSSECKEGKQGLSCADVLERDSATASSGHHAQISLLALITVLSVVVALFH

SEQ ID NO: 6805 - protein, 360 aa, Zea mays
MVENGVEQPLLQGGGPPNNAGHAKPPPGARPPRRFRRCRTAPSTDAAQESPPRSQQDPSLQRGTTQLAPPKELLRGARPSFRLVGVLLLAYLLAGTVAFYLAMDHMSGDRTGSRVVDALYFSVVTMTTVGYGDLVPSSDAAKLLACAFAFAGVALVGTFLSKAADYLVEKQEALLFRALHARNRKALRVVEANRVRYKLYTAAALLAAALASGTAFMVEVEGMRPVDAFYCVCATVTTLGYGDQSFSSVAGRAFAAAWITVSTVVVALFFLYAAELGAERRQRALARWVLRRRTTCTDLEAADMDGDHRVGAADFVLYKLKELGKISQEEIAEFLEEFDELDADNSGTLSPHDLIVAQPG

SEQ ID NO: 6806 - protein, 138 aa, Zea mays
  misc_feature (78)..(78): Xaa can be any naturally occurring amino acid
VIDYKLTYPSGTATAMLINSFHTTTGAELADKQVRCLGKYLSISFIWNCFKWFFSGVGDSCGFDNFPSLGLAAFKNTXGDWYPADLGSNDFKGLYGYKVFISVSVILGDGLYNLIKIIYATIKEIMNARAKQGRLPLA

SEQ ID NO: 6807 - protein, 215 aa, Zea mays
MGLALSRRMAAEDGEADSPAPAPVPPTGAAAASGGGTEKKKQADDSSSSSKTTEWVPHKFSEIVGQRRPGEAGEGGIRGIYLPQSDQQPKTTKKYWVDGRNANCFMLFPKGFSITWGSDARYWSWRKLTQEEKREIDPEEAKMEMEVAYLKDVCWLEIRAKLEMSHLTPGFTYVVDFVAKLEQNGYGWSEPVDLQINCPRRRRQEAAEGESMEDG

SEQ ID NO: 6808 - protein, 261 aa, Zea mays
FPLVQTKIVDFFKIQRSPTPLVEAAELKKRKRKHGGALVASKKKSRRLLPFVPSPDPAQRLRQMASLATALTATGAAFSNELTYQPGMAPRSANRAALEAGGMQVLGREDAETLARCQQMIARGEWPPLVVAYDPVEGFTVEADRPIRDLTIITEYVGDVDFLRNREHDDGDSMMTLLSAASPARSLVICPDRRSNIARFINGINNHTPEGRRKQNVKCVRFAVGGECRVLLLANRDISKGERLYYDYNGSEHKYPTHHFV

SEQ ID NO: 6809 - protein, 510 aa, Zea mays
  misc_feature (271)..(271): Xaa can be any naturally occurring amino acid
MATPNGLARIETNGATKPDNGVCHDDSSAPVRAQTIDELHSLQRKRSAPTTPIKDGAASTFAAALSEEERHRQQLQSISASLASLTRETGPKVVKGDPARRGEAPATGAPPTPQAHHQHHHPAAPTIAVSDSSLKFTHVLYNLSPAELYEQAIKYEKGSFITSTGALATLSGAKTGRSPRDKRVVKDEVAADEHCWSENGVSNIEGGCYAKCIDLSQEKEPKRGILSLHSGCNMGKDGDVALFFGLSGTGKTTLSTDHNRLLIGDDEHCWXNVVFDEHTREVDYADKSVTENTRAAYPIEYIPNAKIPCVGPHPKNVILLACDAFGVLPPVSKLDLAQTMYHFISGYTALVAGTEDGIKEPQATFSACFGAAFIMLHPTKYAAMLAEKMQKYGATGWLVNTGWSGGRYGVGKRIRLPYTRKIIDAIHSGELLTANYQKTEVFGLEIPTEIKGVPSEILDPINTWTDKAAYKETLLRLAGLFKKNFEVFASYKIGDDSNLTDEILAAGPNF

SEQ ID NO: 6810 - protein, 43 aa, Zea mays
MLQVDLVSTVHIADKEYFDRLQRELEDYDCVLYEMVTTRENLS

SEQ ID NO: 6811 - protein, 284 aa, Zea mays
  misc_feature (123)..(123): Xaa can be any naturally occurring amino acid
  misc_feature (197)..(197): Xaa can be any naturally occurring amino acid
MPKPATANRRRKRGGGGGGEGGAADEQASSKRRPATSVLTSLDVNDAPRPELPLFQLSRPRQQAEQDDEEEEVTGGGGGGGAGSLLSSAVNGHGQSPHQQRRLWVKDRSRAWWEQCSSADYPXEADFRSAFRMGRATFAMLCDALGAAVAKEDTALRAAIPVRQRVAVCVWRLATGEPLRLVSKRFGLGISTCHKLXVLEVCAAIRGLLMPRFLRWPDDAARRGVQVPPTARPPWTLPGGSWRCSSPTPTPARRPPWTTTPRWRAASTPPPSPRPPPGPSAPGS

SEQ ID NO: 6812 - protein, 217 aa, Zea mays
MGVQLTTNNIIAEFYYDQFELDIRVAGIIAACFGMANLVSRPLGGVLSDLGARYWGMRARLWNIWILQTAGGAFCFWLGRASELPASVTAMNMGIMAMACTLSGRWRRAAADAGFEVRVAEPDHHSDMDTFVVLVNSAGWACTAPAHRHGVSAHGSVLIQMVSFDGLGWLTGVTFKDLMAHSACSASACPSTTAIRGGDMGGAGDMGSADDMDGGVT

SEQ ID NO: 6813 - protein, 167 aa, Zea mays
GYPCCRRDSFSRVLWHAVANYRTWVFVFVYGYSMGVQLTTNNIIAEFYYDQFELDIRVAGIIAACFGMANLVSRPLGGVLSDLGARYWGMRARLWNIWILQTAGGAFCFWLGRASELPASVTAMVLFSAATHEGHLEHGHHGHGMHVEREMAPRRGRRRLRGTGGGA

SEQ ID NO: 6814 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 6815 - protein, 218 aa, Zea mays
  misc_feature (27)..(27): Xaa can be any naturally occurring amino acid
  misc_feature (44)..(44): Xaa can be any naturally occurring amino acid
RPADFVVAPPFIYIDQVKNSLTGRIEXQLVDIGCQWVILGHSEXFIGKKAAYALSQNVKVIAYIGELLEEREAGKTFDVCFRQKKAFADSISNWADVVIAYESVWAIVTGKVATPEQAQEVHAAALFKDKKPVKVIKKNSAAVTKFLDELAKIDFPGAKVVSEAVAKSGTSPLLPAITFILDKVAPFIPKEEPKAEPAAEATPREVAVEEKKEEAEPG

SEQ ID NO: 6816 - protein, 176 aa, Zea mays
MLKQHYARYTPDLVQQACGTPKEKFLKVCEMLASTAVPGRAGTVLYALGWTHHSIGAQIIRTGAMVQLLLGNIGIAGGGMNALRGHSNIQGLTDLGLMSNLLPGYMTLPMQAEQDFDGYIKKRTQLPLRPNQLSYWKNYKAFHVSFMKSWWGDAATAENNWAYDYLPKLDKQYDLL

SEQ ID NO: 6817 - protein, 87 aa, Zea mays
  misc_feature (53)..(53): Xaa can be any naturally occurring amino acid
  misc_feature (82)..(82): Xaa can be any naturally occurring amino acid
STPIRSTVLSLVWQPNNVLLAAGSCDFKCRIFSAYIKEVEERPAPTRETLHNXFGELMFESSSSCGWVHGVCFSASGSRVAXVSHDS

SEQ ID NO: 6818 - protein, 454 aa, Zea mays
  misc_feature (154)..(154): Xaa can be any naturally occurring amino acid
  misc_feature (294)..(294): Xaa can be any naturally occurring amino acid
PLLLVHLLLLPAASSADHHRHYRGRRALHEPLFPLESTPTLPPPPPAPFFPFLPGAAAPPTPVATPEVGSASTPADTGAGDASSSPHPTAPANISSLAPLPVSHGAPLRAFLSSHRLLTVLVPPPPPPPPPPPPLLPPMPPVKDKGGATAATAXSGAEESPGRAPSEKPADADADADALPKLKPLHWDKVRASSGRPTVWDQLKASSFRVNEEMIETLFVSNSTWRSSKSGIKAPNSSSCSQENKVLDPKKSQNIAIMLRALNATKEEVCRALLDGQAESLGSELLEMLLKMAXSREEEIKLKECREDAVSKLGPAESFLKAVLAIPFAFKRVEAMLYITNFDLEVDYLKTSYKTLEAACEELQGSRLFHKILDAVLKTGNRMNTGTNRGNAHAFKLDALLKLVDVKGADGKTTLLHFVLEEIIRSEGGNVVATGQTSGQAGALADDLQVYSTG

SEQ ID NO: 6819 - protein, 382 aa, Zea mays
MPPLPRQFQQKQMNLSSCSKSVLDAGAGGKRPSEGAPPPPPPPPPPPLLPPMPPVKDKGGATAATAPPAPPPPLPRAGNGSGWLPRRHSERPATTVIRASASAVHPEESPGRAPSEKPADADADADALPKLKPLHWDKVRASSGRPTVWDQLKASSFRVNEEMIETLFVSNSTWRSSKSGIKAPNSSSCSQENKVLDPKKSQNIAIMLRALNATKEEVCRALLDDGASREEEIKLKECREDAVSKLGPAESFLKAVLAIPFAFKRVEAMLYITNFDLEVDYLKTSYKTLEAACEELQGSRLFHKILDAVLKTGNRMNTGTNRGNAHAFKLDALLKLVDVKGADGKTTLLHFVLEEIIRSEGGNVVATGQTSGQAGALADDLQ

SEQ ID NO: 6820 - protein, 328 aa, Zea mays
MDLASSDLAALGAAELVRVSASIPRAAPRTFALLTACLVFPLSFAVLAHSLFTHPILLRIRGAAHSGFAPWLGLFAYQFIYLIVLFTFSLLSTAAAVFTVASLYAGKPASVSSSLTALPPILPRLLRTFLWVSLLMLAYHLVFALTVLLLIVVFIPNASESESAPPSLAFVLFLLVVVFVFLGIHVYISALWHLASVISVLEPLCGLAAMAKSKDLLQGRTGTAATLVVSYFAVCGVTSVLFRAAVVKGRAEEGSFGLALPGRLLVGAVLLCVLVCVNLLGLLVQSVFYYACKAFHNQQIDRTALYEHLGGYLGEYVPLKSNIQMENL

SEQ ID NO: 6821 - protein, 120 aa, Zea mays
MEMTGFGSPCGACKFLRRRCARGCVFAPYFCDEQGAAHFAAIHKVFGASNASKLLAHLPLADRPEAAATISYEAQARLRDPTYGCVAHIFALQQQVHYGCVHEVPGGCRRRRLRFVSRDG

SEQ ID NO: 6822 - protein, 629 aa, Zea mays
  misc_feature (35)..(35): Xaa can be any naturally occurring amino acid
MPKRDKAASPRASPPHTPPPGTDSEAEEANRRPGXASAAEMGTYKCCIFRPRRFALGDTSTPEDVRALFSLYAGGSPYMLADDLRRYLAAWGGADGEVPEQIIDRILQDRSRTPRFGRPALTVDDFLHFLFSEDLNPPLRYSKVHQDMNAPLSHYFIYTGHNSYLTGNQLSSDCSDVPIIKALQLGVRVIELDIWPNSCKDDIDVLHGRTLTAPVSLIKCLRSIKEYAFVASPYPVIITLEDHLTPDLQERVAKMVLEVFGDILYYPESKHLQEFPSPEALKGRVMLSTKPPKEYLEAKGDTMKEKEIEARIKRGEREAAAWGVEVPDIQDEMQVADKDEDELLYRERGADGDDGKETKHVAAEYKHLITIKAGKPKGPLVDAIKNDPDKVRRLSLSEQELAKVAAHHGPNIVSFTHRNMLRIYPKGTRFNSSNYNPFLGWVHGAQMVAFNMQGYGRALWLMHGFYKANGGCGYVKKPDFLMQTCPDGKVFDSKADLPVKATLKVKVYMGEGWQKDFKQTHFDSYSPPDFYVKVGIAGVPLDSVMRKTKAVEDSWVPVWEEEFAFPLTVPEIAVLRVEVHEQDVNEDDFGGQTALPVAELRPGIRAVPLFDHKGLKFKSVKVLMSFEFA

SEQ ID NO: 6823 - protein, 185 aa, Zea mays
PRVRDVCNGLLGGFAAITAGCSVVDPWAAVICGFVSAWVLIGLNALAARLRFDDPLEAAQLHGGCGAWGVLFTGLFARREYVEQIYGTPGRPYGLFMGGGGRLLAANVVMILVIATWVSVTMAPLFLALNKMGLLRVSAEDEMAGMDQTRHGGFAYAYHDDDLSLSSRPKGMQSTQIADAASGEF

SEQ ID NO: 6824 - protein, 67 aa, Zea mays
PAPANGSPGGVGYLSPSLSNGNALKPGRLPLLRLPVVVTSQETSLATSCRRVYAHAHDYHINSISNN

SEQ ID NO: 6825 - protein, 315 aa, Zea mays
MGSGNLIVKKVVKHSSFDLDIQLDKSWMEDVTCPICLDYPHNAVLLRCTSYEKGCRPFVCDTDQTRSNCLERFKSAYELPSNAKVSSFAMPPLDSIIHIVPSNANNRPSCPLCRGDVIGWIVIGEARQHLNQKKRCCEEDCCSFVGNFNELQKHTQQKHPDSRPSEIDPARQVDWENFQQSSDIVDVLSTIHAQVPNGIVLGDYVIEYGDDDNGEDYEVFRGVRTHWWSCIFCKAFSRSSRSRRRARERRGSGRRIGNQANLENFNIEVPAQSVELREIRFDEIDDEYIVTGAIPSMATPGRMASFHYRDTRYGR

SEQ ID NO: 6826 - protein, 419 aa, Zea mays
MELLPVEVVGNILSHLGVARDVMIASAVCRKWRDACRRHLRLLSFNSNDFPRDMTTRQLEIVITQTIFQTMGLQRLSIHIDNTHEFSAAPVIAWLMYTRETLRSLSYNVRTIPNVSILEKCGRQKLEVLDLELDHNTITGVEPSYQRFTCLKSLSLRHVSILALDLSLLVAACPRIESLALDVLEVVTSELQSTMELTSHTLKSLFAKSVGVDKIILDADNLEVLHLNALNLDLFELNGKGTLKHFKIDDVSVTHLDIGDNTDHLEAVDVSNFTIVWPKFYSMISRASNLRMLRFWGVVFDDEDEIVDSETIAVSFPLLRHLSLSYELRDGLLHYSLQGSSLLENVSVLELGWTVISEHFGPWVFGMIGRCPNLKKLVIHGVLSETKTREDRQMLASFTSFIVCVMRKYVHVDVQFEYE

SEQ ID NO: 6827 - protein, 151 aa, Zea mays
  misc_feature (136)..(136): Xaa can be any naturally occurring amino acid
KSLMEKAKAKGVSLLLPADVVIADKFAPDANSKIVPATAILDGWMGLDIGPDSIKTFSEALDTTKAIIWNGPMGVFEFDKFAAGTEAVAKQLAELIGKGVTPIIGGGDSVAAVEKVGLADKMSHISTGGGASLEIXNKGKPLPGVLAFDEA

SEQ ID NO: 6828 - protein, 595 aa, Zea mays
  misc_feature (192)..(192): Xaa can be any naturally occurring amino acid
MAMGKLEERTRAFWTNRWLVFVGAMWMQSMAGTTYIFGAISPVVKARLGYDQPQVAALGVAKNVGGCLGLLAGALSATWPPWALLAIGAAQNFLGYGWLWLVVSGNAPALPLWLMCVVIFIGTNGQTYFITASLVTSIQNFPKSRGPTVGILKGFMGLTSAILTQVYTVMHTPDHAALIFMVAVGPSLVAIXLMFVIRPVGGHRQIRPSDKNSFMFIYTVCLLLASYLVGAMLVQDFLQPSYDVVVFLTVILFVLLISPIAIPVIVSFMPEKAQHLMEDALLSEPLTGEASSSRQKEDQPEVILSEVEEEKSKETDSLPPSERRKRIAELQAKLVEAAARGGVRIKRRPHRGDNFTLMQALVKADFWLIWLSLLLGSGSGLTVIDNLGQMSQAIGYKNAHIFVSLVSIWNFLGRVGGGYFSEIIVRERTYPRHIALAVAQIVMAAGHFLFAMAWPGTMYIASLLVGLGYGAHWAIVPAAVSELFGVKHFGAMYNFLILANPAGSLIFSELIVSNLYEHEAEKQASQHQMSALLSPRLLRDTGFLADDALKCEGPACFFFSSLIMSVFCAVAAGLSLLVVQRTRQVYPRLYSSVRT

SEQ ID NO: 6829 - protein, 652 aa, Zea mays
SSAMDSAAARPDEEEARRRRSTDCIYFLASPLTCKKGSECEYRHSDAARMNPRDCWYWFHGNCANPKCSFRHPPLDNMAGAPTTPRPAQQSVPHQASASVPAQPQGSVPATAKQGVPCYYFQKGMCTKGDRCAFLHAPRSAGNPAPQPPAKVFTTPALQPNLHPPLNNSWTKPNLSAPAVAVVDKSKASTYHDGKPLHHKENLTSRTENPSRVVYQNHSSSYAQPGAPKRYQPQPSARDGLTDNGMEAGEFAREPSAGSCVTAGFNGAGGMTRQTHGGYEPERSYRNSAERSSSEKRIPQREHIPSVAAGSSDLRHRLLKQRKSNNNSRSAEALGRHDTHLEDERNDQHRPRGEQQDGLSRSRLHDRIRLPGETAFDSLGSRSEEWDRGSRARLSPPKSSDLRGRLHERLKGRLGEEIPGSSAKGLAVKASSSEDTESLNFAGPKSLAELKAKKGVGRSGEDAVVKGLGSSRMTSEIVWSREAASFEGPKPLSAILKRKREPASEIPAAQPGITQEADNYAAGAEEEIQTLANDTVGENMEGIGEEEEEEEAFHPEDDVAYDDNANEAAVAQELDEYEDADAAAQDYDDEAAAAQEVEEHQDGEAAAEDYDYEEADVNAEEENEYQDYQDEDDDDLEDGDDDFARKVSVMIS

SEQ ID NO: 6830 - protein, 438 aa, Zea mays
MATPSSMTSTEKEKAIDDWLPITSSRNAKWWYSAFHNVTAMVGAGVLSLPYAMSELGWGPGVVAMVLSWVITLYTLWQMVEMHECVPGKRFDRYHELGQHAFGDKLGLWIVVPQQLIVEIGVCIVYMVTGGKSFEKCYTVACPDCKPLRTSSWIMVFAAIHLLLSQLPNFNSITLVSLAAAVMSLTYSTIAWAASAHKGRHSAVDYSMKASTTTGQTFNFLSALGDVAFAYAGHNVVLEIQATIPSTPDKPSKKPMWQGVVLAYLVVAICYLPVAFVGYYVFGNAVDDNILITLEKPRWLIAAANIFVVVHVIGSYQIYAMPVFDMLETFLVKKLRFKPGMPLRLIARSLYVVLTALVGIAVPFFGGLLGFFGGFAFAPTTYYLPCILWLKIKKPKKFSLSWFINWFCIIVGVLLTVLAPIGGLRSIVVNASTYKFFS

SEQ ID NO: 6831 - protein, 129 aa, Zea mays
QKLRHPHADNGHPLVRLYGPRVKFDRGPSLAFNVFDWKGERVSPLLVQKLADRHNISLTCGFLCNIWFSDKHEAERAVVLEHRLVVNASLGFLSNFEDAYRLWAFVAKFLDADFVEKERWRYTALNQKT

SEQ ID NO: 6832 - protein, 766 aa, Zea mays
MGSACQAGTDGPSRKDVLGIGNAALENGHHQAEADADEWREKEEDLANNGHSAPPPGMQQVDEHKEEQRQSIHWERFLPVKTLRVLLVENDDSTRQVVSALLRKCCYEVIPAENGLHAWRYLEDLQNNIDLVLTEVFMPCLSGIGLLSKITSHKICKDIPVIMMSTNDSMSMVFKCLSKGAVDFLVKPLRKNELKNLWQHVWRRCHSSSGSESGIQTQKCAKLNTGDEYENGSDSNHDDEENDDGDDDDFSVGLNARDGSDNGSGTQSSWTKRAVEIDSPQPISPDQLVDPPDSTCAQVIHPRSEICSNKWLPTANKRNVKKQKENKDESMGRYLGIGAPRNSSAEYQSSLNDVSVNPIEKGHENHMSKCKSKKETMAEDDCTNMPSATNAETADLISSIARNTEGQQAVQAVDAPDGPSKMANGNDKNHDSHIEVTPHELGLKRSRTNGATAEIHDERNILKRSDQSAFTRYHTSVASNQGGARYGESSSPQDNSSEAMKTDSTCKMKSNSDAAPIKQGSNGSSNNDVGSSTKNVAARPSGDRERVASPLAIKSTQHASAFHTIQNQTSPANLIGEDKADEGISNTVKMSHPTEVPQGCVQHHHHVHYYLHVMTQKQPSTDRGSSDVHCGSSNVFDPPVEGHAANYSVNGGVSVGHNGCNGQNGSSAVPNIARPNIESINGTMSQNIAGGGIVSGSGSGNDMYQNRFLQREAALNKFRLKRKDRNFGKKVRYQSRKRLAEQRPRVRGQFVRQSEQEDQTAQGSER

SEQ ID NO: 6833 - protein, 395 aa, Zea mays
MMDQKSNFQKILLSTIACLLLLTIGALGWACKIRGKWHKKKIQTRRMLEYLSSTDEAGGKNIEFSFIAFENIVTATDNFSDCNILGKGGFGKVYKGMLEGTKEVAIKRLSKNSGQGAEEFRNEVVLIAKLQHKNLVKLLGFCVHEDEKMLVYEYLPNKSLDYFLFDSSRASVLQWPTRFKIIQGVARGIMYLHHDSRLTVIHRDLKASNILLDKEMNPKISDFGMARIFSGDQLQANTNRVVGTYGYMSPEYAMKGAFSVKSDTYSFGVLILEIVSGLKISSPYLIMDFSNLITFAWNMWKDGKPEDFLDSSVTESCSLDEVSGCIHIGLLCTQDDPSCRPLMSTIVSMLENKATPLPTPKQPKDFALRDYNPGNEGVHRELSVNDTSLTMVQGR

SEQ ID NO: 6834 - protein, 375 aa, Zea mays
MVQQAAKEVIPLLTPYKMGQFELSHRVVLAPLTRCRSYGNVPQPHAAVYYSQRATRGGLLIAEATGVSATAQGFPESPGIWTQEQVEAWKPIVDAVHRKGAIFVCQIWHVGRVSTNELQPNGDAPISSTDKQISPDAKSGTAYSKPRRLRTDEVPGIVDDFRRAARNAIQAGFDAVEIHGAHGYLLEQFMKDSCNDRTDQYGGSLENRCRLAVEVVDAVVREVGARRVGIRLSPFVDFVDCVDSDPVALGHYMVQQLNRHSGLLYCHMVEPRITAHGRRQIPHGLLPFRKAFHGTFIAAGGGGYDREEGNKVVAEGYADLVAYGKLFLANPDLPRRFELDVALNKYDRSTFYTQDPIVGYTDYPFFEEEDGKNER

SEQ ID NO: 6835 - protein, 189 aa, Zea mays
MAAAAEIGGFAAARVAVATLRPAAHPAPAAAPQQPRRAVAAQSLRTTATEALTADLAGTTNGAVHARMNSKATSEITSQAVTANSRRKTKIVCTIGPSTNTREMIWKLAETGMNVARLNMSHGDHQSHQKVIDLVKEYNAQNTDGNVIAIMLDTKGPEVRSGDVPEPIMLKEGQEFNFTIKRGVSTEVL

SEQ ID NO: 6836 - protein, 138 aa, Zea mays
KLVFSAKVKDTYFRKKELTKVGKNCSFNSESGRPKGFTPKFSLAPLVGRLSELLGIQVQKADDVIGPEVEKLVAALPNGGVLLLENVRFYKEEEKNDPEFAQKLASLADLYVNDAFGTAHRAHASTEGVTKFLQPSVA

SEQ ID NO: 6837 - protein, 78 aa, Zea mays
  misc_feature (5)..(5): Xaa can be any naturally occurring amino acid
  misc_feature (42)..(42): Xaa can be any naturally occurring amino acid
  misc_feature (54)..(54): Xaa can be any naturally occurring amino acid
  misc_feature (60)..(61): Xaa can be any naturally occurring amino acid
  misc_feature (64)..(64): Xaa can be any naturally occurring amino acid
  misc_feature (66)..(66): Xaa can be any naturally occurring amino acid
  misc_feature (68)..(68): Xaa can be any naturally occurring amino acid
  misc_feature (72)..(72): Xaa can be any naturally occurring amino acid
  misc_feature (74)..(74): Xaa can be any naturally occurring amino acid
LELAXAEAEMRYAFPPDLRAVLAAGLPLGPGFPDRRSRAGLXSAFDLPIAAMSXQIARGXXPTXPXHXLRLXRXLSAP

SEQ ID NO: 6838 - protein, 593 aa, Zea mays
MAFWWPLLVLAAAYALCRLLLFLIPPTVPSIDVDASDVLAKEDSFIYIPRRGKSTQTDKVQCYEPATMKYLGYFPVVTPDEVKEHVAQSRKAQRIWAKSSFKQRRQFLRILLKYILEHQDLICEVSSRDTGKTMVDASLGEIMTTCEKITWLLDEGEKWLKPEYRSTGRSMLHKRAKVEFYPLGVIGAIVSWNYPFHNVFNPVLAAVFSGNAAVIKVSEHATWSGCFYFRIIQAALSAVGAPENLVHIITGFAETGQALVSSVDKIIFVGSPGVGKMIMKRASETLIPVTLELGGKDSFIVCEDVDLPSVVQVATRAALQSSGQNCAGAERFYVHDDIYSAFVSQIVKTVKSISVGPPLSGRYDMGAICMIEHSEKLQNLVNDALDRGAEIAVRGSFGNLGEDAVDQFFPPTVLVNVDHTMKIMQEETFGPIIPIMKFSSDEEAIKLANDSKYGLGCAVFSGNQKRAIRIASQLHCGVAAINDFASSYMCQSLPFGGVKDSGFGRFAGVEGLRACCLVKSVVEDRLWPYIRTVIPKPIQYPVSEHGFEFQQLLVETLYGYSVWDRLRSLVNLIKMVTEQNSAPASNATTKKRR

SEQ ID NO: 6839 - protein, 433 aa, Zea mays
  misc_feature (78)..(78): Xaa can be any naturally occurring amino acid
HASGGGKGQQTKGGGGGGGGGKGGRDANMVLPQPTPQQMQQQMQMKGMTLPPELLMGMGGSKMPPFPTPAPAPGPPPXRPEDPKPAKFSYPEDDEFGDEGSEFDDEFDDFDDEDDFEDDGFDDDDLYGDPKMMAKPVAMPPAAGKKGGNGGKKGGGGGNEIPVQVKGNAHSGGGKKDSAAKQNQGGGKNGGGGGGSQAPQNGKGGGNGNQQGKKGRGGGGGPPAGSGAPMMGGMAMPAPRPPLPQQQQPGPGMMMRPPNMMGGAGFPGGGMGPGMGQMGGAPMGHPHHPHPHQHMGAGGNGMQMQPGAGGGGAVHGMPAGAMPGHAAGFYQGGGGAAGGGMPSGPEMLQAAGNPMAMAAQQQQQQYMAMMQQQQMMNGHGAGGPGGYPAMGYGYGRPAMQYPPPPPYYYHPMPQRHPHDNMFSDENPNSCTVM

SEQ ID NO: 6840 - protein, 556 aa, Zea mays
  misc_feature (117)..(117): Xaa can be any naturally occurring amino acid
  misc_feature (481)..(481): Xaa can be any naturally occurring amino acid
MAAMNGEVLGECGRNINSLKRKRESPAAYAAGVFCTSELHQHTVNDSAVRFHLDKDRKAKIVCHFNKQVLQSYKKFMSSAPPKRILLRQGAVWKDFPEKIVKLAQADFRAKKMITEXDIRTSYFLLDFAHMTFIDTKTGLQRPIAWIDENGNRYFPESFVQDQKIFMKKDFGNGYHDYISVESNGTREMNDQLGTSESSAESSNFGSSTEDVSSPKRARAENNSIIKKYCDMGEAIGENEPCTLLPTACNLLPRQANLGEVSRAQRTIEAVEKLLLQGMGSVIESKDIIGIYRTPLLDDHGQVRYHNHEKHVQVTRCHRGNANVRYAWLPCSKSTVHEMMLNSSLQVHKPPIKCAAYGEGTFLTPANRSDACVKFSAVDENGIVHMMLCRVIMGNVEIVHPGSKQHQPSSDYFDSGVDDLKNPQHYIVWDMNLNRHIYPEFVVTVKLPSKTKDYFVSQEDCQNSSDLSLVLNSSSPDCISXAISTKVSPQIMDMVIGCYEEFKSKKISRCELIKELRHVVGDRVLISTIMRLQDKLPPVERREAPGASAAKMVAKP

SEQ ID NO: 6841 - protein, 165 aa, Zea mays
  misc_feature (137)..(137): Xaa can be any naturally occurring amino acid
GRARLRYKERRKLRPLGSGLSPNGIALSRAGMDNLALMDKALDVDAKKKTVTVHAGIRGAELDDALREHGLTLQNFASIREQQVGGFTQVGAHGTGATLPPVDEQVISMKLVTPAKGTIELSREKDPELFYLARCGXLGGLSVVAEVTLQCVERHQLVEHTFVSN

SEQ ID NO: 6842 - protein, 58 aa, Zea mays
AETLKLNMALILLPVCRNTITWLRNTKAARALPFDDNINFHKVIKLGFMLYLLINTSN

SEQ ID NO: 6843 - protein, 316 aa, Zea mays
DGLITDKQRLTGLVILGIKDEETFPLIFYRDNCADMGLVPEDIREEFITSSRAVAITGTHLSHPDTRAAVLKALDIARRNGLRTALDIDYRPVLWGLTSLGDGETRFIESGQVTQQLQEVVHYFDLIVGTEEEFHIAGGSTDTLTALKNVRKTSSATLVCKRGPLGCVVFEGEIPDSWEQTRLHSGVRVEVLNVLGAGDAFMSGLLRGWLNDESWEQACRYANACGALVVSRHGCAPAMPTKEELDDFLSRDNAVKRPDLDARLNHLHRVTTRKQQWPELNVFAFDHRKQLADMAREAGVSEDRMPQLKLLLLQAC

SEQ ID NO: 6844 - protein, 542 aa, Zea mays
  misc_feature (321)..(321): Xaa can be any naturally occurring amino acid
  misc_feature (346)..(346): Xaa can be any naturally occurring amino acid
  misc_feature (358)..(358): Xaa can be any naturally occurring amino acid
  misc_feature (395)..(395): Xaa can be any naturally occurring amino acid
MAAQVVAAAGTPVARPLGGGSGADALRPAATMPRERRTGAVAARGRRESQVVSVISRAPRPDAGVLPVSPDDDAAVKEEANFQHLKAIQQLATAANGVWSKPNVRRKTKIVCTIGPSTNTRDMIWKLAETGMNVARLNMSHGDHASHQKVIDLVKEYNASHADNVIAIMLDTKGPEVRSGDLPQPIFLESGQEFTFTIKRGVGTDTCVSVNYDDFVNDVEVGDMLLVDGGMMSFLVKSKTEDSVKCEVIDGGELKSTRNIFAFTDEERVRQRLALYQGVCPVQMEFSDDAEKTFGNALSYLLKHGMVKDGEEVALVQSGKXHLEITINTQHSGEEDLMRNAHSILXLLEDIVSSSKPXRSCYNETTLVVSQSNCRLVLAVALEHCRLVVVIQFVXHLSMLRTFASRTPGGETPADLGQAFKNHMSEMFAYHATMMSNTLRTSIVVFTRTGFMAILLSHYRPSGTIFAFTDEERVRQRLALYQGVCPVQMEFSDDAEKTFGNALSYLLKHGMVKDGEEVALVQSGKHPIWRSQSTHNIQVRKI

SEQ ID NO: 6845 - protein, 150 aa, Zea mays
MVWQIIATAIALGICLHAGNHLACDFPRLIASAPEEYRLVARFFGRDRPSYRGLLAGAEGVTGIVMVTLMAVSFTLATRPFRKREEASRDKKKAAACACRGVPLAGFNAFWYSHHLLIVVYLLLLVHGWFMFLVDKWYQRTVRTLRENII

SEQ ID NO: 6846 - protein, 274 aa, Zea mays
  misc_feature (92)..(92): Xaa can be any naturally occurring amino acid
  misc_feature (109)..(109): Xaa can be any naturally occurring amino acid
  misc_feature (118)..(118): Xaa can be any naturally occurring amino acid
  misc_feature (124)..(124): Xaa can be any naturally occurring amino acid
  misc_feature (144)..(144): Xaa can be any naturally occurring amino acid
  misc_feature (218)..(218): Xaa can be any naturally occurring amino acid
MTSKGTRPWSRLSEAETAVNRAVAGSRVGRYFKLDARKSSFTKELRAGAATFLTMAYIISVNAAVLTDSGGPCTVRDCTPVPTNSTVAATPXGPECTGAGANNPGCQRXLARTKSDLXVVATAXAAMAGSFAMGLFANLPLALXAPGMGANAYFAYNMGGVHGAGPIGYSTALAVVMLEGLVFFALSVVGLRARLARMIPRNIRLPSAVGIGLFLAFXGLQAHQGVGLGGASPSTLVTLTACSDVDTVTGACLGGTMRSPTFWLGAVGFLITAT

SEQ ID NO: 6847 - protein, 159 aa, Zea mays
  misc_feature (63)..(63): Xaa can be any naturally occurring amino acid
  misc_feature (97)..(97): Xaa can be any naturally occurring amino acid
RRSTWPELLLPRRARGLRTCGACKFLGRRCVLECVFAPYFNSDHDQGAARFAANHKVLGASKXNTSKLLSHLPVADRCEAVVSITYEAQARLRDSAXPVYGCVAQIFALQQQVAILQAQLMHCRPRRSSRAASRAPRIRLRATTTNPIQSRERATITDC

SEQ ID NO: 6848 - protein, 370 aa, Zea mays
  misc_feature (330)..(330): Xaa can be any naturally occurring amino acid
MAGGKEAHGWAARDVSGHLSPYHFSRRVQRDDDVTIKVLFCGLCHTDLHVIKNEFGNAKYPVVPGHEIVGVVTDVGSGVTSFKPGDTVGVGYFVDSCRSCNSCSKGYESYCPQLVETSNGVSLDDDGGATTKGGFSDALVVHQRYVVRVPASLPPAGAAPLLCAGVTVFSPMVQYGLNAPGKHLGVVGLGGLGHLAVRFGKAFGMKVTVISTSLGKRDEALGRLGADAFLVSRDPEQMRAAAGTLDGVIDTVSADHPVVPLLDLLKPMGQMVVVGLPTKPLQVPAFSLVAGGKRVAGSAGGGVGECQAMLDFAGEHGITADVEVVGMDYXQYRHPAPREERCQVPLRCRRRGQQDWRLGITISSVLSIDV

SEQ ID NO: 6849 - protein, 239 aa, Zea mays
MDSDLWISRLMAAKRQFALQRAQRQHAAPASHHDRFGYDDIEPEDDVRSDFPCPYCYEDHDVTSLCAHLEDEHPFESKIVSCPVCLARISKNLLDHITLQHGYLFKLQRHHRVRRVTGNGNHNLSYAGRDLQLQETYLKVLLGNSSRSSSTNASSTVTDSLLSSLVLNLSSLEVEDTSKSSAPSVVENNWFKRSLPSKTWKLSAVDSSLSHEERERRRRRAVVRSAFVQHLLVTTLFED

SEQ ID NO: 6850 - protein, 352 aa, Zea mays
  misc_feature (92)..(92): Xaa can be any naturally occurring amino acid
MMGGFLSRVLLLALGYAYPAYECYKTVELNKPQIEQLIFWCQYWILVALLTVLERFGDFTISWLPFYSEAKVLSFVLGYHKYTKNNTFASEXNGSHDIVYLWYPKTKGTTYVYGTFFKPYISQHENEIDRNLLELRARATDMVVLYFHKAASVGQNTFFDVLKYVAAQSPSRKSRLHPHQEPQQQQPQVQVELQQPQPQKQAAPVMRRGASIAARQAAMAQQSLETIPVPSSPKIKRQTSGRPGSVASTKPAAAASTPKPGGSPKKGEVKPAVDPVQTPATSADSPKSEPSAPPLSETEEVDNMAIDEVSGDAAEGAEELDPALEETPMEETIRVTRAKLRRRTATEDSAGN

SEQ ID NO: 6851 - protein, 217 aa, Zea mays
  misc_feature (205)..(205): Xaa can be any naturally occurring amino acid
MPKPHSEAGTAFIQTQQLHAAMADTFLEHMCRLDIDSAPITARNTGIICTIGPASRSVEMLKEMIKSGMNVARLNFSHGTHEYHAETIKNVREATESFASDPILYRPVAVALDTKGPEIRTGLIKGSGTAEVELKKGATLKITLDNAYMEKCDENILWLDYKNICKVVEVGSKIYVDDGLISLQVKEKGADFLVTEVENGGSLGXQKGVNLPAAAVD

SEQ ID NO: 6852 - protein, 89 aa, Zea mays
  misc_feature (23)..(23): Xaa can be any naturally occurring amino acid
  misc_feature (25)..(25): Xaa can be any naturally occurring amino acid
MSQLLDKAKNFVSEKVNDMAKPXGXVTDVDFKRVSKDNVEYLAKVSVRNPYSTSIPICEINYSFKSASREIASGKIPDPGSLKAKDTTM

SEQ ID NO: 6853 - protein, 501 aa, Zea mays
MASSSPDLADDGFAAPRLFSQGVSYTYDDVIFLPGYIGFPADAVDLSTRLSRRVPLSIPCVASPMDTVSEAAMAAAMASLGAAAVVHCNTEPHSQAAIVRAAKSRRLPFVSSVPFFSPSSSPTLNDFAGSEYALVTERGDSLSRLVGIAVAADAASREVPISVSEYMRPTPRSASSAFDFEEAATFLADEGLDYAPLVSDDGEVVDLITAKDVERIRSYPKLGKPSLGANGKFVVAASIGTREDDKGRLEQLVKAGANAIVIDSSQGNSIYQLDMIKFAKKMYPEVDLIGGNVVTIAQAQNLIQAGVDGLRVGMGSGSICTTQEVCAVGRGQATAVYKVSSYAKDHNVPVIADGGISNSGHIVKALSLGASTVMMGSFLAGSHEAPGTYEYKDGRRVKKYRGMGSLEAMTKGSDARYLGDTLKLKVAQGVVGAVADKGSVLRFIPYTMQAVKQGLQDLGADSLQSAHDLLRSETLRLEVRTGAAQAEGGIHGLVSYEKKAF

SEQ ID NO: 6854 - protein, 211 aa, Zea mays
MIITEGMFNFIKLLTVSSIDLYKKRQQNDSGKIKYMLTSPSLSYDDRRRLDVFHGQRIPLHVPVAGYIGCAIVCSVVIPWIFQHIKLYHMALLFTILPVFTFCNTYGTGLTDWSVAQSYGRFIQFVIAAWVAVPGAVIASLAACGVSVAALNVSSQAMQDLKTGYMTSTSPRAVVAGHIYGVLIGSVIIPSIFLAFEANAKSTAPIGSKDS

SEQ ID NO: 6855 - protein, 473 aa, Zea mays
TRPLSFGSNGTSRAVSGSSRMGGGIGVSTSASGSQGMANYDGKGSYIIFNTADTLFISDLNSHDKDPIKSIHFSSSNPLCHAFDPEAKDGHDLLIGVFSGDVYSMSLRHQLQDPGKKPVSYQHFVNKDKDKDKDPSQGGAASSQCTCVAWVPEREGIFVVSHADGNLYVYDKFKDGNTDWTFPTVKDQSQVLISHAKSSKGNPIARWHICQGAINGISFSPDGAYLATVGRDGYLRVFDFTKEQLIFGGKSYYGALLCCSWSADGKYLLSGGEDDLVQVWSMDDRKIVAWGEGHNSWVSAVSFDPCWSQPNSDETEENVMYRFGSVGQDTQLLLWDLALDEIAVPLRHPSGGSPTFSSGSPSAHWDNACPPTGVLQPSPRMRDVPKLSPLVAHRVHVDPLSGLEFTSESIVTICREGLIKIWARPIHSENNQQPDSSEQVIGSATAKDKMLTSSNKAGAFSSSFKQPPSVLFT

SEQ ID NO: 6856 - protein, 565 aa, Zea mays
MASAAGSAGGAGAGSGGLKTYFKTPEGRHKLQYEKTHSPAVVHYSHSGKTVSQMTVAYLKEKPAGQGSTPSTPSAGSGMRSAAARLLGTGNGSRALSFGSNGTSRAVSGSSRMGGGIGVSTSASGSQGMANYDGKGAYIIFNTADTLFISDLNSHDKDPIKSIHFSSSNPLCHAFDPEAKDGHDLLVGVFSGDVYSMSLRQQLQDPGKKPVSYQHFVNRDKDKDKDPSQGGAASSRSTCVAWVPEREGIFVVSHADGNLYVYDKCKDGNTDWTFPTVKDQSQVLISHAKSSKSNPIARWHICQGAINDISFSPDGAYLATVGRDGHLRVFDFAKEQLIFGGKSYYGALLCCSWSADGKYLLSGGEDDLVQVWSMDDRKIVAWGEGHNSWVSAVSFDPYWSPPNSDETEENVMYRFGSIGQDTQLLLWDLALEEIAVPLRHPSGGSPTFSSGSPSAQWDNACPPAGVLQPSPRMRDVPKLSPLVAHRVHVDPLSGLEFTSESILTICREGLIKIWARPIHSESNQQPDSSEQVVGNATAKDKMLTSSNKAGASSPSFKQPPPVLFT

SEQ ID NO: 6857 - protein, 86 aa, Zea mays
LFGQVSGGVTMNNTLCLGVFLALIYFRNLTWDFSSEVLIILLVCVVMALFTSFRTTFPLWTCLVAYMLYPLSLIIVYILDYVFGWS

SEQ ID NO: 6858 - protein, 81 aa, Zea mays
AETLKLNMALILLPVCRNTITWLRNTKAARALPFDDNINFHKGQVLPAQAPCYLVSRTASWARPNSCTDHATAWPGGYRRI

SEQ ID NO: 6859 - protein, 124 aa, Zea mays
MAPHTTGVGGGSGAEEEVSEAASLERVFADKAVPSWREQLTLRAFVVSALLAVMFNVIVMKLNLTTGIVPSLNVSAGLLGFFFVRMWTAAVERMGFLCHPFTRQENTIIQTCVVSAYGIAFSGR

SEQ ID NO: 6860 - protein, 200 aa, Zea mays
MHAPRRFKKAFMAQLLLSLRAAGHASKSMGLRERRDAVRLSSDVAMALASARARAAPRSTVWARALIARHAAEQRNEALMRRIMGGAGYEMAAAAVRARKEARCRRIVRRSRRVCSGVGRKRRSLLAAEGGGGIRCSAMAAARRMVKARLQVLRSLVPGGEAMGGLSLLTETLDYVVCLKAQVELMQRLCKGSCSQSQLG

SEQ ID NO: 6861 - protein, 387 aa, Zea mays
  misc_feature (81)..(81): Xaa can be any naturally occurring amino acid
  misc_feature (103)..(103): Xaa can be any naturally occurring amino acid
MAMETQTPETIVPPTTIPPLLTPYKMGAFELEHRVVLAPLTRQRSYGNVPQPHGAVYYAQRATRGGLLITEATGVSDTAQXGYTDTPGVWTPDQVAAWRPIVXAVHAKGAVFFCQLWHVGRVSTTALQPGGAAPISSTDRAVAPQLSFDGHLEKFSPPRRLEAREIPAIVDDFRRAARNALLAGFDGVEVHGANGYLIEQFLKDSANDRDDEYGGSLENRCRFALEVVRAVAGEVGPGRVGVRLSPFTDYMDCHDSDPEALAGYLVRSLSDVGVLYCHMIEPRMAIVDGRRQIPHRLRPFREAFRGTFIAAGGYDRAEGDKVVEEGYTDLVAYGRLFLANPDLPRRFRLPDAPLNKYDRTTFYTSDPVIGYTDYPFLADADADKFFD

SEQ ID NO: 6862 - protein, 290 aa, Zea mays
GRAVASLLRAGPCVPPSPKQEHAAAKVQWARGKAGEDRVHVVVSEEHGWMFVGIYDGFNGPDATDYLVAHLYAAVCRELDGVLRLHADEPAEAGRNGGGRALAGEQGRHHDVLDALARALRSTEAGYFAEAEARAAECPELAMVGSCVLVALVKGADVYVMNVGDSRAVLAQRAEPEPDLSRALVAPRQGGGGVDLAGVKDEIRRQFNACETGDLAALQLTMDHSTSVYKEARRIRSEHLDDPACIVNGRVKGSLKVTRAFGAGYLKEPRWNEALLEVFRVRYVGTSPYI

SEQ ID NO: 6863 - protein, 167 aa, Zea mays
MPRSRINGNFIDKTSLIVAVVTTQSTRGEKRAFTYYRDGMLAQSEGNYAEALQNYYEAMRLEIDPYDRSYILYNIGLIHTSNGEHTKALEYYFRALERNPFLPQAFNNMAVICHYRGEQAILQGDSEIAEAWFDQAAEYWKQAIALTPGNYIEAQNWLKITKRFEFE

SEQ ID NO: 6864 - protein, 364 aa, Zea mays
QREEIDREREGEREPDTETEASALASLGSNITMSSNCGEDEKELVCVTGAGGFIGSWVVNELLQRGYRVRGTARDPADSKNAHLLALEGAKERLTLCRADVLDRASLRAAFAGCHGVFHVASPVSNDPELVPVAVEGTRNVINAAADEGARRVVFTSSYGAVHMDPSRSPDAVLDETCWSDYDFCKRTDNLYCCAKMMAEVTAAAEADARGLQLAVVLPCMTTGPMLQQTLNFSTNHVARYLMGTKRSIPNAVAAYVDVRDVARAHVLAYERPGARGRYLCIGTVLHRADLVDMLRDLFPQYPVTAKCEEDGKPMAKPFKFSNQRLRDLGLEFTPLRKSLYETVLCLQQKGHLPVIQPQQRAYL

SEQ ID NO: 6865 - protein, 270 aa, Zea mays
MIASQPRRVRPLAAVSLVLFLLLLYSRSDGGSPRAARLLGSGFYPVHRRFLSDADPAGPASSAANPSASGTVPLNGEQPEDPSVACAGIALHEGFGTQCEFLRAHPQCSSDGFVDYLGFFYCRCERFRVLGYAVLGVCLAALFYMLGNTAADYFCCSLEKMSALLRLPPTLAGVTLLPFGNGAPDVFASIAAFMGSGAGDVGLNSVLGGAVFVTCVVVGAVSLCVAEKNVQIDRRCFVRDVGFFLVTLLALSIVLTIGKVTVWGAKKKKK

SEQ ID NO: 6866 - protein, 596 aa, Zea mays
MATMKLGSKPEIFVLQDLTWLCTTELESDVVVEVGEMSFYLHKFPLLSRSGVLQRMISEYQAPADGGGMCTLQLDDIPGGAKAFELAAKFCYDVKIELNALNVVCLRCAAEYLRMTDDYAEGNLITQAECFLVDVLANWKDSIKALETCEGVLPTAEDLHLVSRCITALASKACGSDAAAPVVRNASVDKDALWNGIRSGDTTSSAAAAAAAAGMDWWYEDVSFLSLPMFKRLIQAMEAKGMRDESIAGAIMFYAGRFLPGLKRNRNITPRAASVSAPSEGDQRYFLEEIVALLPTKKGVASTKFLLGMLRTAMLLHASPLCRENLERRIGAQLEDASLDDLLVPNLGYHVETLYDIDCVQRILDYFMSSTDGIGTGYTSPALAEEGGGSLGIPQGATPSSSLSPITMVAKLMDGFLAEVAPDTNLKLPKFQALAAVVPDYARPVDDGIYRAIDIYLKSHPWLSESEREQLCRLLNCQKLSLEACTHAAQNERLPLRVVVQVLFFEQLRLRTSIAGWFFVSDNAAGGDGARPHAGGAIVPKGTDVKARVSDLEKECKSMKQEIRRLGKPRRSWSLLTRKCGFGAKVQQAQTAMSGK

SEQ ID NO: 6867 - protein, 274 aa, Zea mays
MANRGAAAGKLTVAETFSNLREQGKSAFIPFITAGDPDLATTSKALKILNSCGSDVIEVGVPYSDPLADGPVIQASATRALKKGTTLDSVIEMLKGVTPELSCPIVLFTYYNPILKRGVGNFMSFIKQAGIHGLVVPDLPLEETALLRSEAIMHNIELVLLTTPTTPTDRMKGIAQASEGFLYLVSAVGVTGARSNVNLRVEHLLREIKKVTDKPVAVGFGVSTPEHVKQIVGWGADGVIVGSAIVRQLCEAATPEEGLERLEEYARSMKAAMP

SEQ ID NO: 6868 - protein, 463 aa, Zea mays
  misc_feature (174)..(174): Xaa can be any naturally occurring amino acid
MAAAAIEAAGRRKGSCFLEVGRREIGSSFPRVSSRRISGSEHIVSSMSQYGKLHGHEGCVNTVSFNPAGDLLVSGSDDTNIILWDWLSKTKKLVYPSGHQDNVFHARVMPFTDDSTIVTVAADGQVRVGRLKEGGEVTTKLVGEHDSRVHKMAIEPGNPYIFYSCGEDGLVQHXRVKLNSIVIDPQNPYYFSIGGSDEYARLYDMRKFQLDGSRNTNQPVDTFCPKHLIKGASARVHITSIAYSYAREILVSYNDELIYLFQHNMGLGPNPVSTEPEFFNMLDQPQAYRGHRNFRTVKGVSFFGQHDEYVVSGSDCGNVFIWRKKGGELIRMMNGDKSVVNCIEPHPHFPFMATSGIDTTVKLWTPAAKKLIMPLPKNAKQIIAANELERTVHISQATASLSSDVMMHVLRLLRRRDSEMYIENEPASADLASDDDEAFYFGFEDDAERNERENSDPRECNMT

SEQ ID NO: 6869 - protein, 259 aa, Zea mays
  misc_feature (202)..(202): Xaa can be any naturally occurring amino acid
MAKEFPVPPVVFTPSTPTHRRYPPQGVGASPPPAFAPPRPSTSSAANPLPFMSFDVSAAAASSSSAPPLFAGPIGVAGSGSSFEDEPPLLEELGINTRQIWRKTISILHPLRSADPSLHADADLSGPFLFLLSFGLFQLLAGKFHFGIVLGWVTVASLFLYFVFSMLSGGRRGDLDLYRCVSLVGYCMLPMVIFSAVSLFLXRAGAGSYLEEGMAFVIWSARVCTRLLAELASSGDEHRGLIAYACWLVYRPRARPRGF

SEQ ID NO: 6870 - protein, 156 aa, Zea mays
  misc_feature (75)..(75): Xaa can be any naturally occurring amino acid
TILPHDVAASTRHYLLRSIINGHPTLQSLVLTDADGQGTLCMGAKQLEEFRENQLSTSACSNRTQVPACNMEHTXLHVAGWDLKLKYAPYVELPGGMALQGATLVAIKPSPEGSNGSHPNRKEAEGFVFGAFDGPFKAAVKALMKRRTYLLEMNGF

SEQ ID NO: 6871 - protein, 250 aa, Zea mays
MFCFRVRFPRPRLTRNLRCRAHARDIHHPDLAPHPPKFRPRDPSAHRWKAPLTTCQTRYRPHDAIPCPRPHPPHRSTKRPPPRPRSCPSSASTSPRHGLHSSVPLAAAVLGHLRASGVAVLPGLTELELAGAEAEMGFAFPLDLRAVLATGLPLGPKFPDTRSRVGLRSAFDLPIVAAALQITRGTLWLRCWGARPADLDCVLRLARSAICRAGEASIPRRRRSGPCRSRLSTRLIHAHGVVTSPRPPRK

SEQ ID NO: 6872 - protein, 166 aa, Zea mays
SSAMDSAAARPDEEEARRRRSTDCIYFLASPLTCKKGSECEYRHSDAARMNPRDCWYWFHGNCANPKCSFRHPPAQQSVPHQASASVPAQPQGSVPATAKQGVPCYYFQKGMCTKGDRCAFLHAPRSAGNPAPQPPAKVFTTPALQPNLHPPLNNSWTKPNLSAPA

SEQ ID NO: 6873 - protein, 134 aa, Zea mays
GAFTGEVSAEMLVNLGVPWVILGHSERRALLGESNEFVGDKVAYALSQGLKVIACVGETLEQREAGSTMDVVAAQTKAIAEVAESTRIIYGGSVTAANCKELAAQPDVDGFLVGGASLKPEFIDIINAATVKSA

SEQ ID NO: 6874 - protein, 432 aa, Zea mays
MAARRQHRRGFPLVPLLLSLLAAAAYGRLISDGGSSAQLLSVIRLSGSSPAAGAANKAEEKCEQSYGFLPCTTTVLGNLFLVLTYGFLMYKAATYLSAGSELLLEIMGPGLVGGLLLPILGALPDALLVLVSGLSGSKEEAQSQVLIGMGLLAGSTVFLLTLLWGTCVVVGKCDLGPNREAVDVTDTKGFSLTGTGITTDVQTSYAARIMGLSVIPFIIAQFPKMLKTHHGQRLAMLLALIVSFLLVLSYCLYQVFQPWIQRRKLAYAKHKHVISGILRHAQMQSLGRLLNDDGTPNDDVIRKLFRKIDMDQSESLSRAELHALIVGINFEEVDFDRTDAVDKVMDDFDTSRNDVVEQEEFVQGMKKWLNEAKRSVPVGGAFSTKFINEYHERTRQEHNELVDRSDEAVESVENPGWCIAKAVALLLLGAAI

SEQ ID NO: 6875 - protein, 636 aa, Zea mays
MIWIAWPTAAAVVSMPSVLSTSGSLRALQRNGGDQIISPIPPAHRSRQTCMAKPSASAAAAALRASLGVAFALLLLLASSRLPRRALSAELSSPSVVANERRGHGACAGVRTPDERYRAIAAGSDGRDRYPRGGGHVDYLYLFYCVLGGDRRPALGYAAMAAWLAVLFYLLADTAAVYFCSSLEGLARLLRLPPAIAGATLLSLGNGAPDALSAVASFFAGDGGEGGGTAAAVGLSGVLGGAMFVSSVVLGVIAIRLGGQEVAVHRASFFRDAAFLFLALVAVAVVVAAGQVTIWAAAGFASLYLVYVLAVAFTPDRWTRRHDAHAVDDPASAAAFSELHNVTETKFYTDQEARDPLLPDTAPLLQYYAGEANSNSNDGSTGNKSVFWTVLRVLELPLNLPRRLTIPDASKERWSKTAAVTAATLAPIFLSLLWSHRATGGPFVTVLLGGLAGLALGLIAFLTTDPFAPPTRFLGAWLAGGFAMSVAWAYVIANEVLSLLVSAGIILSVDSAALGVTVLAWGNSISDLIANVAVASRGGGAQVAVSGCYGGPVFNVLVGLGLSMLLACWSGYPQPVEIPREPGLYRTLAFVVAGLLWAVVMLPRRGMRVDRTLGVGLLVVYFCFLCINVSELKNAR

SEQ ID NO: 6876 - protein, 132 aa, Zea mays
VQYRDLNVRMTDWKEVMEETKPGPLLKTQSARCMDCGTPFCHQENSGCPLGNKIPEFNELVYQNRWHEALERLLETNNFPEFTGRVCPAPCEGSCVLGIIENPVSIKSIECAIIDKAFEEGWMVPRPPVQRT

SEQ ID NO: 6877 - protein, 171 aa, Zea mays
MAPAAGTATGSASGGSAVHDDAEAVELGHNNLIRRRHPGADVEDEADDRNVGASAAAGKELAPSSVEQAFADQPVPSWREQLTVRAFVVGALLSVVFNVILMKIDLTTGINPSLNVCASLLSYFLLRTWTRAIGCMGLLRQPFTRQENTMIQTCVVSAYGITFTGKIVSFL

SEQ ID NO: 6878 - protein, 338 aa, Zea mays
MAQAASGSSKIDTKAPTSADEAAQPKSYGDLVSTLPARGGWVSLVQYQNYWLNPGRLQNIIPVKELYKPRADDIVLATYLKCGTTWLKALAFAITTRGRHHQAFAAADHPLLTVHPQEAVPHLEVHTPGQGLADIERLPSPRLLGTHLPLSLLPPAVATSGCRVVYLCRQPKDVFVSLWHFVKGMRGGRSPVELDAALAMFCEGVSPFGPVWEHYLEYWKESLARPERVLFLRYEEMVADPVRAVRTLAGFFAVPFTDEEEGRGVPEEIVRLCSFEMLSGLESNRTGDLDCGDNTVIGKSTFFRKGKVGDWENHLTKEMGKKVDAVFEDKLQGSGLVF

SEQ ID NO: 6879 - protein, 153 aa, Zea mays
  misc_feature (45)..(45): Xaa can be any naturally occurring amino acid
  misc_feature (78)..(78): Xaa can be any naturally occurring amino acid
PPEPPGVSRRFHALVPLVDSVFVRVDCVIPDDPPPSSSSSAAPGXRRGRRQPRPRVLLGGIARPIHALGQILFPARAXADVSHHSPSEVLRSFKELRRLHIELPTGELGIDDGVLLKWKADFGSTLVSCVILGASSISSKPPTGYTQAESETA

SEQ ID NO: 6880 - protein, 215 aa, Zea mays
MTGLGSPCGACKFLRRKCVKGCVFAPYFCHEHGAAHFAAIHKVFGASNASKLLMHLPISDRCEAAVTMSYEAQARLQDPIYGCVAHIFSLQQQVVRLQAELESFKALAIQGCGDGSLTSNPQKENCERLAPYIQDGQLFYQPTMANNSSVKSERQLYFANDCFTSTSTQHSEGYEPDICMPDYYNNSNPSWTTQGSGYHDIDELQSVAFAYLDNA

SEQ ID NO: 6881 - protein, 323 aa, Zea mays
QRGHSTCPVTARPLRAEDLIPNHATRRMIQDWCVANRALGVERVPTPRVPLSAADAAELLAAVSAAARRGDAMVCRQLAAKARALGKESDRNRRCLAAGGAARALSSAFLRLVDQPASFGGALGEILATLVVFFPLDEECRSHIASPASLDAIVSILSHDGEATSKSSAAVVLREIASSSDSDPECLDALSETSGVHDALIKLLQKPVSAQATKAALVTAYYLVRGSDLAARRLVDLGMVELLVEMLVDADKGTTEKALAVLDSLLLTEEGRGKACAHALAVPVLVKKMQHVSEMATEFAVSALWRLCKSFSGEGPCKAEALQ

SEQ ID NO: 6882 - protein, 249 aa, Zea mays
MHRTRVCKRRRPMGSCVSRSGAMSTAAESVHALTAKVVDLDGSVAQFAPPVTAQEALAATASGAQPSSSSRFLCCSDALDFDAPISALAAHDALHPGQLYFALPASMLGRPLSAQGMAALAVKACAALGTAPVGSVPSSSSSLDRSEARAASSWPQRWQSTGRVAPLVVVRADAHGEWKTYPVHGGYKAARVGGGGGGGDQTVGKTKNGVGYKGIARDLAPIQRLSVIVEGAELVSDPFIEQYSVVLVN

SEQ ID NO: 6883 - protein, 235 aa, Zea mays
MSAGGGGGGTSTLGGGGPSGSGSGGPGGSGGGGPCGACKFLRRKCVSGCIFAPYFDSEQGAAHFAGVHKVFGASNVCKLLLQIPGHKRLDAVVTICYEAQARVRDPVYGCVAHIFALQQQVVNLQAELTYLQAHLATLELPAPPPLPAPPQMPMPGPFSISDLPLSTSVPTTVDLSALFDPPPPQWATAQQPHHHHQQPPQHHQLRQPAPYGAGASVRPGGGPGMAESSGGDELQ

SEQ ID NO: 6884 - protein, 500 aa, Zea mays
  misc_feature (239)..(239): Xaa can be any naturally occurring amino acid
MGSSSSHQRSKTRSRNRKPLGIQLLERVRGSPISFRSCQALVLVLTFLSYASYHATRKTTSVVKSVLDPKTKTNLGTSSAHYWPPSHLFYLHNLKGADNNSSSGGGWAPFNAAEDGTALLGEIDLAFLGAYAAGMFFAGHLGDRVDLRVLLTVGMVGTGLFTAAFGAGYWLDVHSFYYFLAVQMVAGLFQSSGWPSVVAVVGNWFGKSKRGLIMGVWNAHTSVGNISGSLIAAAMLRRXDLCLEDDEKKPSDMDAPLLERERRRADVEEKAVGFIEAWRIPGVASFALCLFFCKLVAYTFLYWLPFYISHTAIGGEYLSDSAAGVLSTLFDVGGVVGGILAGHISDHLDARALTAASFTFSAIPALFFYRVYGNVSLAWNIALMFVTGMLVNGPYALITTAVSADLGTHSSLNGNSRALATVTAIIDGTGSIGAAVGPLLTGYISARSWSAVFTMLMASALVAGLLLSRLVAAEVVAKMESRRTPAPADSDLPVSSMDEP

SEQ ID NO: 6885 - protein, 406 aa, Zea mays
  misc_feature (183)..(183): Xaa can be any naturally occurring amino acid
  misc_feature (224)..(224): Xaa can be any naturally occurring amino acid
MAMATAGAVIAACILALLAPPPARAAGGGRCAGESFSANRAYAACNDLPRLGASMHWTYDRASGDLHVAFVAAPAAPAAPGGWVAWALNPSGDGMAGAQALVAGPFPDGGGTWAVRTYNVSGYALGEPGPIAFPASDLAAELGADGRVRVFGTLGLGAAAVGGGGVLLNQVWQVGAAVSSGGXPAPHAMGADNLAAKAKLDLLRATTVAAGADSATRKRNIHGXLNAVSWGLLLPMGAIFARYLKTFRAADPAWFYLHVTCQLIGYGVGVSGWATGMKLGKESRGVTYTDHRNIGIAVFALGTLQVLALFLRPKKEHKFRVYWNTYHHSVGYAVIVLGVVNIFKGMSILGVEQRWRTAYIAAVCVLLVAAAALEAVTWGVVLRRRKADGKTFSSAPNGHLPHSVSV

SEQ ID NO: 6886 - protein, 328 aa, Zea mays
MDLASSDLAALGAAELVRVSASIPRAAPRTFALLTACLVFPLSFAVLAHSLFTHPILLRIRGATHSGFAPWLGLFAYQFLYLIVLFTFSLLSTAAAVFTVASLYAGKPASISSSLTALPPILPRLLRTFLWVSLLMLAYHLVFALTVLLLIVVFIPNASESESAPPSLAFVLFLLLVVFVFLGIHVYISALWHLASVISVLEPLCGLAAMAKSKDLLQGRTGTAATLVVSYFAVCGVTSVLFRAAVVKGRAEEGSFGLALPGRLLVGAVLLCVLVCVNLLGLLVQSVFYYACKAFHNQQIDRTALYEHLGGYLGEYVPLKSNIQMENL

SEQ ID NO: 6887 - protein, 263 aa, Zea mays
MNVGTNRGEAKAFKLDTLLKLADVKSTDGKTTLLHFVVQEIIRSEDAKSEKESAMIIHSSKDEQLRKQGLKLVSGLSSELGNVKKAAMMDFDVLHGYVSKLETGIEKIKSVLQLERQCTQGQKFFTTMQSFLKKAETEIDKVRGEEKKALVRVKDITEYFHGDTAKEEAHPLRIFMVVRDFLSTLDHVCKEVGRLQQDRTDRTARLRDKSPSHNTEFWKEHSTSAMPFLAAEADVALAFAPRHMFKVGRTKKLRSRLEKLPTF

SEQ ID NO: 6888 - protein, 295 aa, Zea mays
RASARASAEVLGKGAFGTAYKAVMENGSAVAVKRLKDVDLPEPEFRERIAVIGAVQHELVVPLRAYYFSKDEKLLVYDYMSMGSLSALLHGNRASGRTPLDWETRSAVALAAARGVAHIHSTGPTASHGNIKSSNVLLTKNYEARVSDHGLPTLVGPSFSPTRVSGYRAPEVTDIRRVSQKADVYSFGVLLLELLTGKAPTHAVVNEEGLDLPRWVQSVVREEWTAEVFDQELLRYQNVEEEMVQLLQLAIDCSAQHPDRRPAMSEVATRIDEIRRSSLGDRQVADSAEGDEPSL

SEQ ID NO: 6889 - protein, 367 aa, Zea mays
LGPTIVGNSGFGFSKKKKNKAASDRRSGERETVCVTGAGGYIASWLVKLLLSRGYAVHATVRDPRDPKNAHLGQLEWAAENLRLFKADVLDSDALAAAVSGCRGVFHVACPVPTDRVLDPESEVLAPAVQGTLNILQACSSNNIQKVVVVSSTAAVHFDPNWPPHRPKDEDCWSDINFCKKNKDWYMVAKVIAEKTALEYGERNGLNVVTVCPTMALGPLLRPMLNVSHEFLMYIIKGGPTMMKNIPWHIVDVRDVVDALLMVYKKEESTGRYICAPNCISAKDLVNMLKRDYPNYNYVNCDNDMVLNSIVTPLMSEKLKNLGWKPMKTLEETLLDSVECYKKMGLLKDAEGCPCRLPHLFHMAIEK

SEQ ID NO: 6890 - protein, 287 aa, Zea mays
MAKDVEQVTEQGEYSAKDYHDPPPAPLIDPDELTKWSLYRAAIAEFIATLLFLYITVLTIIGYKRQSDTKIPGNTECDGVGILGIAWAFGGMIFILVYCTAGISGGHINPAVTFGLFLGRKVSLVRALLYMIAQCAGAICGAGLAKGFQKSFYNRYGGGVNTVSDGYNKGTALGAEIIGTFVLVYTVFSATDPKRNARDSHVPVLAPLPIGFAVFMVHLATIPVTGTGINPARSFGPAVIFNNDKAWDDQWIYWVGPFVGAAVAAIYHQYILRGSAIKALGSFRSNA

SEQ ID NO: 6891 - protein, 88 aa, Zea mays
NEILIKSDLPYFRSGRIYVVDTRSNPRSPSLHKVVEPEDIISKTGLAYAHTSHCLASGDVMISFLGDKDGNAAGSGFLLLDHEFNLKG

SEQ ID NO: 6892 - protein, 101 aa, Zea mays
CVKEKKCTIVLYDLISKGYLSMLELCTKVWDLATLQCIQTLSDHTDVVMSVLCWDQFLLSCSLDQTIKVWAATESGNLEVTYTHKEDQGILGLFLETCRPA

SEQ ID NO: 6893 - protein, 245 aa, Zea mays
  misc_feature (212)..(212): Xaa can be any naturally occurring amino acid
  misc_feature (229)..(229): Xaa can be any naturally occurring amino acid
MAPLGDAVAPAAAAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAAMRAAKSAGILCSYDPNVRLPLWPSAQAARDGIMSIWEEADFIKVSXDDEVAFLTRGDATDEKXVLSLWFEGLKLLIVTD

SEQ ID NO: 6894 - protein, 348 aa, Zea mays
MDGGGGGVGGGGVGAGVMVGGGVGPGGGVGGGDVELVSKTLQFEHKLFYFDLKENPRGRYLKISEKTSATRSTIIVPVDGVAWFLDLFDYYIRTDERDAFSKELRLQTKVLARFLRGWPASFAVGPVLPLVLVPWLLTLAWLNYAHCAVQVFYFDIGENKRGRFLKVSEASVNRNRSTIIVPAGSSGEEGWEAFRSVLLEINNEATRLYVLPNHPNQQHMEPPERLPGLSDDVGAGFIAGHGSQSASGPEVDVERLVDLPPQEEISGMGMSKVIRADQKRFFFDLGSNNRGHYLRISEVAGVDRSSIILPLSGLKQFHEMVGHFVDIMKDRLEGMTGANVRTVEPSQR

SEQ ID NO: 6895 - protein, 158 aa, Zea mays
RFFFDFSATYVGVGMICPYLVNASVLLGGVVSWGIMWPLIEQKKGDWYPADLKPSSLRGIVGYRVFVSIALILGDGLYNFLKVMTRTVTALVVQVRRMMSEPTLPISGGGGEGGGIPLPAPEETFDDRRRTELFLKDQIPNTLALGAYLVIAVVSIAT

SEQ ID NO: 6896 - protein, 117 aa, Zea mays
YKASGIRLDSGDLAYLSIEARKVFSAVEKEYNVPGFAKMLITASNDLNEETIDALNKQAALGCVFKLVEINNKPRIKLSEDVAKVSIPCKKRCFRLYGKEGYPLVDIMIRESEPSPK

SEQ ID NO: 6897 - protein, 202 aa, Zea mays
ECSLFVGEVVVSPPYVFLPVVKSQLRQEFQVAAQNCWVKKGGAFTGEISAEMLVNLGVPWVILGHSERRALLGESNEGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDII

SEQ ID NO: 6898 - protein, 125 aa, Zea mays
  misc_feature (87)..(87): Xaa can be any naturally occurring amino acid
MGSAVLFYCICIAVVVALSSSMVAVGAAAPGETPKFISGLCPVRFDHTRGISAVASSCKDRPLPSPERCCGALKTYACPYSELINEXTPNNGCASEMFYVIMTRGRLRPGLFSQLCVEGPLGLQC

SEQ ID NO: 6899 - protein, 165 aa, Zea mays
DLQHCALLSGGGYAEKVVVPAGQLLPVPEGVSLADAAGLPEVACTVWSTIHGGSSGIGTFAIQIAKHLGIMVFVTAGTEEKLAACKGLGADVCINYKTEDFVERVKQETNGKGVDVILDNIGGPYLERNLNSLGVDGRLFIIGFQGGAVAEVNLQAVFAWRLTIQ

SEQ ID NO: 6900 - protein, 300 aa, Zea mays
ACLQQQTRKPKPSDKESGESSASLGRSNTPEQIFLLEPRKSHNISIILKSLTVGRDEIIDALRDGQTELGTDVLEKLSRLHISKEEESTILRFSGDPDRLAPTEAFLLRLLLDVPNPIARVNALLFKVNYGAEVAQLKHSLRTLELASQELRTKGLFFKLLEAVLKAGNRMNAGTARGNAQAFNLTALRKLSDVKSTDGSTTLLHFVVEEVVRSEGKRLAINRNYSIRRSGSFASQGPSREERQSEYMNLGLPIVGGLSTEFANVKRAALVDYDAVVSECAILDGRLNEIKRLLETCRHA

SEQ ID NO: 6901 - protein, 91 aa, Zea mays
STLDWCEENYVVTLFVAEFWNTVSNLIMIIPPIFGAIQGFRDRLEKRYIAAYVALTVVGMGSWCFHMTLKFEMQLLDELPMIYSCCIFVYC

SEQ ID NO: 6902 - protein, 294 aa, Zea mays
  misc_feature (239)..(239): Xaa can be any naturally occurring amino acid
  misc_feature (266)..(266): Xaa can be any naturally occurring amino acid
  misc_feature (280)..(281): Xaa can be any naturally occurring amino acid
  misc_feature (288)..(288): Xaa can be any naturally occurring amino acid
MATPNGLARIETNGATKPDNGVCHDDSSAPVRAQTIDELHSLQRKRSAPTTPIKDGAASTFAAALSEEERHRQQLQSISASLASLTRETGPKVVKGDPARRGEAPATGAPPAPAHHPAAPTIAVSDSSLKFTHVLYNLSPAELYEQAIKYEKGSFITSTGALATLSGAKTGRSPRDKRVVKDEVAARDLWWGKGSPNIEMDEHTFLTNRERAVDYLNSLDKVFVNDQFLNWDPENRIKXRIISAKAYHSLFMHNMCIRPTDEELEXFGTPDFTIYNAGQXXCNRYTHXMTSSTS

SEQ ID NO: 6903 - protein, 57 aa, Zea mays
KYKLPMSYIIPFPKKGDPSSAPDFGQGRQVLAVYPGTTALYRATVASHPRLISYLNL

SEQ ID NO: 6904 - protein, 124 aa, Zea mays
MVDVDRRMAGLTPAAHAAGLRRLSTRAAAGPSSASASPRHGLHSFAPLAAAVLGHLRASGVAVLPGLTELELARAEAEMGFAFPPDLRAVLAAGLPSGPGFPDWRSRAGLRSAFDLPIAAASLQ

SEQ ID NO: 6905 - protein, 233 aa, Zea mays
FEVNLHHVADPLKACDYAILLKRLIKNVAYDHEMDTTFMAKPYPGQAGNGLHVHISLLDKKTGKNIFASDDPLQSDALRHAIGGVLETMPASMAFLCPNINSYRRFGAQFYVPNAPSWGLDNRTVAVRVPTDSSENVRLEHRVAGADANPYLMLAAILAGVHHGLTNQVEPQAPIEGNSYEQLEQSLPNNLRDALRALDDSEVLNQYISPDYIDIFVACKESELAEFEVSISD

SEQ ID NO: 6906 - protein, 144 aa, Zea mays
VQTGPVPIVPYSVRFLHDPSKDTGYVGCALTSNMVRFFKTADGSWSHEVAISVKPLKVRNWILPEMPGLITDFVISLDDRYLYFVNWLHGDIRQYNIEDPAKPFLAGQVWVGGLLQKGSDVVYVTDDGQEQQYNVPQVKGHRLR

SEQ ID NO: 6907 - protein, 513 aa, Zea mays
  misc_feature (404)..(404): Xaa can be any naturally occurring amino acid
  misc_feature (422)..(422): Xaa can be any naturally occurring amino acid
MATCATDLAPLLGPAAANATGYLCSQFADTASAVDATYLLFSAYLVFAMQLGFAMLCAGSVRAKNTMNIMLTNVLDAAAGALFYYLFGFAFAFGTPSNGFIGRHFFGLQRLPRTGFDYDFFLYQWAFAIAAAGITSGSIAERTQFVAYLIYSAFLTGFVYPVVSHWFWSADGWAGASRTSGPLLFGSGVIDFAGSGVVHMVGGIAGFWGALVEGPRIGRFDHAGRSVALRGHSASLVVLGTFLLWFGWYGFNPGSFTTILKSYGPAGTVHGQWSAVGRTAVTTTLAGSVAALTTLFGKRLQAGHWNVVDVCNGLLGGFAAITAGCSVVEPWAAVVCGFVSAWVLIGANALAARLRFDDPLEAAQLHGGCGAWGVLFTGLFARQEYVEEIYGAGRPYGLLMGGGXGKLLAAQIVQIVVIAGWXVSCTMGPLFYALKRLDLLRISADDEMSGMDLTRHGGFAYEDPGDNAGVGEFTLKSAQNRVEPPAEQQPGVKFRNEFKNRDEVTCLPKKKKK

SEQ ID NO: 6908 - protein, 124 aa, Zea mays
VFMFQKTAIHKCNLEGKPVIITRVVDSMIDNLRPTRAEATDVANAVLDGTDGILLGAETLRGLYPVDAVSTVGRICAEAETVYNQPLQFKKVMWHVGDPMPHEESIMFCLWDTPANLAAVAGML

SEQ ID NO: 6909 - protein, 377 aa, Zea mays
WRPNPSGEAASACIYYLHQLIAAAAAAAQKAETKKSAVAPAGKAAQPAATTKFPTKPAPPSQTVRDARGGGSSARGGFGRGERGRGRGGRGYGQNRGFSGDNGNDFQGGYGGGGYGDGAVTGGSEGERERETRPPYRGGGRRGGYRNVEFADDSERPPRRNYERHSGTGHGYEMKRDGAGRGNWGTATDELIAQDAEDSPKMEEAAPVAEKQGEQNDAPAADENKDNKDATANEEEEKEEDKEMTLEEFEKIREEKRKALLALKAEERKVEVDKDLQSLQPLSNKKENDEVFIKLGSDKDKKKENAERDERAKKSVSINEFLKPAEGERYYGGRGRGRGRGDRGGFRGGYGGGYSRGPAAAAPSIEDQAQFPSLGGK

SEQ ID NO: 6910 - protein, 765 aa, Zea mays
MPLSPSPSPPPNATAAAAALPLLLLLVCASSIAAQPLASSQAKALLRVRRLLFYPPALEPLRGAPDPCALPPAPALAVACEGGQVTALSVLGDRDPDAAWRAALPASFSSEALFTTLTRLPALARLSLVGLGAWGPLPGAKLRRLQALQQLNLSSNYFYGAVPDGLARLYSLQSLVLSWNWLNGTVPSLSGLQFLEELDLSHNRLGPAFPDVGRSVARLVLDDNNFTGGIPAGVSSLGLLQYFDVSGNQLQGWIPSSVFALPALRYINLSRNRLAGQLPATTACAEALAFVDVSANLLTGARPPCMRGNSSARTVLVAGNCFADAKQQRASSYCNPGALAAVLPPPQGNGGGGQGTGKGREIGMVLAIAGSVVGAALLIALAMVVVLRRARRQRPEATILPKSPAATPTNKADGWKAPAKATQKIITTADKRHASQAARVNTLEVPAYRVCTLEELQEATDNFSSSNLIKTSPLAQDYNGQLQDGSRVLVRCLRLKPKYSSQSLVQYMEIISKLRHRHLVSIIGHCIVSDEENPNIASLVYLVSECVTNGSLRSHLTEWRKREMLKWPQRVCAAIGIARGVQFLHNLTAPGIVQNNLNIEHILLDKTLTSKISNFSLPMISTSKNGKILSETPFAVHEDNDIGSAQNAAQGDKEDIYQIGLILLEVITGKPTESQRQLESLKAQLSEALTEDPDRLKDMADPAIHGTFAVDSLSTVAEIALKCTTGDPSDRPSIDDVLWNLQYSMQVQDGWASSESLGLSVKSQA

SEQ ID NO: 6911 - protein, 187 aa, Zea mays
KVVPGGVGNYRAWVLALTYGYCYGVELIMENVAANFFRKRFHLPMEVAGAAAACFGAMNAVARPAGGLASDAVAILFGMRGRLWQQVPACHAPSSRHRRRVRTARDARSPNPAPTDTASILHIAETTVVSPLPRSRVTRALPSKIAAKVRPLPLIPSRSRPKCGVSGHSSYPVVALPLPLPALSVNW

SEQ ID NO: 6912 - protein, 372 aa, Zea mays
  misc_feature (269)..(269): Xaa can be any naturally occurring amino acid
  misc_feature (363)..(363): Xaa can be any naturally occurring amino acid
MGSGGANTAPLLTPYKMGKFDVSHRVVLAPLTRQRSYGNVPQPHAILYYQQRATKGGLLIAEATGVSDTAQGYKDTPGIWTHEQVEAWKPIVDGVHQKGGIFFCQIWHVGRVSNSTFQPNGQAPISSTDKPLKPQVRANGIDVATFAVPRRLETDEIPLVVNDFRVAARNAIEAGFDGVEIHGAHGYLIDQFLKDGVNDRTDKYGGSLENRCRFALEVTQAVVDEIGADKVGIRLSPFASYSEAPDSDPEALGMYMANALNEFGILYCXHMVEPRMVKLGEKFETPYSLRPIRDAFRGTFIVAGGYGREDGNRAISTGYADLVAFGRVFLANPDLPRRFEVDAPLNKYNRDTFYIPDPVIGYXDYPFLSSDV

SEQ ID NO: 6913 - protein, 544 aa, Zea mays
  misc_feature (151)..(151): Xaa can be any naturally occurring amino acid
  misc_feature (172)..(172): Xaa can be any naturally occurring amino acid
  misc_feature (503)..(503): Xaa can be any naturally occurring amino acid
MEEQQPRPRPSIMFVLSSLAKNNPESVLALIAVLTVVALRHLISSWRQQARLPPSPTSLPVIGHLHLLRPPVHRTFQELASRIGPLMHIRLGSTHCVVASTPEVASELIRGHEGSISERPLTAVARQFAYDSAGFAFAPYNTHWRFMKRLXMSELLGPRTVEQLRPVRRAGXVSLLADLLASSARGETVDLTRHLIRLSNTSIIRMVASTVPGSVTDEAQEVVKDVAELVGAFNVDDYISLVRGWDLQGLRRRAAGVHRRFDALLEDILRHKEEARAARRLDQDDDGRGSSKQDKKQATHSKDLLDILMDKADDPAAEIKLTRENIKAFIIDVVTAGSDTSAAMVEWMLAELMNHPETLRKVAEEIDAVVGGDRIASEADLPQLPYLMAAYKETLRLHPAAPIAHRQSSEEMVVRGFTVPPQTAVFINVWAIGRDPAYWEEPLAFRPERFMPGGAAESLEPRGQHFQYMPFGSGRRGCPGMGLALQSVPAVLAALVQCFHWAXVDGDGGVNKIDMSESDGLVCARKKPLLLRPTPRLTPFPAVV

SEQ ID NO: 6914 - protein, 66 aa, Zea mays
  misc_feature (57)..(57): Xaa can be any naturally occurring amino acid
LDKCLPLFLISCILSVCLSQIGHVTKTGDIAGPRLLEHIVDVVLYMEGERCSSHRLXRSVKNRFGQ

SEQ ID NO: 6915 - protein, 454 aa, Zea mays
VLLGMADSKEFASEVFVALARRRHINPDDGVTKEQLKEFWEEMTDQNFDSRLRIFFDMCDKNGDGKLTEDEVKEVIVLSASANKLAKLKKHAATYASLIMEELDPDHRGYIEIWQLETLLRGMVTASGPTNMGASASLARTMVPSSHRTPLQRRMNKAVDLVHENWKRIWVLSLWGVLNMALFVFKFTQYRRRAVFEVMGYCVCIAKGAAETLKLNMALILLPVCRNTLTRLRSTALSKVVPFDDNINFHKVIALAIAIGSATHTLAHVLCDFPRLVACPKDKFMEKLGPFFNYAQPTWATLLSSIPGWTGILLILIMSFSFTLATHSFRRSVVKLPSPLHHLAGFNAFWYAHHLLVIAYVLLVMHSYFIFLTKQWYKRTTWMYLAVPVVFYASERSIRRIREKSYRVSIIKAAIYPGNVLSLYMKKPTSFKYKSGMYMFVKCPDVSPFEWCGS

SEQ ID NO: 6916 - protein, 457 aa, Zea mays
TCATETSSYCDQHAKFLKGNRKSKRLFELLQMELLQDYNTRLSKEPPEESKIPNLHVTQADTVEARSRNTAEVSRCSLAATGESSSGHKQVTRRILIGSKLRKMYKKQKMLQKKFFPWNYDWHRDQPHVDESVIKSSEVTRRCKSGPVEHDAVLRAMSRALETTEEAYMDIVENELDRHPELALMGSCVLVMLMKDQDVYVMNLGDSRAILAQDNDHFDQYDSSSFSKGDLQHRNRSRESLVRVELDRISEESPMHNPNSHLNSNAKAKELSICRLKMRAVQLSTDHSTSIEEEVLRIKVEHPDDPQAVFNGRVKGQLKVTRAFGAGFLKKPKFNEALLEMFRIDYVGTSPYISCNPAVLHHRLCANDRFLVLSSDGLYQYFSNDEVVSHVLWFMENVPEGDPAQYLVAELLCRAAKKNGMNFHELLDIPQGDRRKYHDDVSVMVVSLEGRIWRSSG

SEQ ID NO: 6917 - protein, 295 aa, Zea mays
  misc_feature (197)..(197): Xaa can be any naturally occurring amino acid
MPAAAAAGGGGRLRLMCSFGGRIVPRPTDKSLCYLGGETRIVAVDRHASLADVHARLSRSLLGGRPFTLKYQLPNEDLDSLISVSTDEDLDNLVDEYDRIAATSSGSGSSRTSRIRLFLFPATPESSSSLGSLLDDSSKSENWFVDALNSAISGSLDGIPRGISTDSASVNCLLGLEDDSSVHSRTRQPAEAPGGRXAVAAAVGAGRHPHDVQSVSVPDSPMLDKNSSFGSTSSAPSLSNLPPIRVRPEDRPSDARIMQPTISSSRLETRHAGGNGSCQLPPPSISSGRCRSTLK

SEQ ID NO: 6918 - protein, 164 aa, Zea mays
  misc_feature (154)..(154): Xaa can be any naturally occurring amino acid
MPTMHALRLCPLLSTIRSTPPRATAAARQGALFVARCSSAGTPSAAEALKISSIPTKPVEGQKTGTSGLRKKVKVFQQENYLANWIQALFNSLPPEDYVGATLVLGGDGRYFNKEAAQIIIKIAAGNGVQKIIVGRNGLLSTPAVSAVIRKRKXNGGFIMSASH

SEQ ID NO: 6919 - protein, 70 aa, Zea mays
  misc_feature (42)..(42): Xaa can be any naturally occurring amino acid
VHCYGRSRKRNKTDISILIVSKFDDYAQLPLEMQCAIGNHAXSYARAMKATVLFSSATHNIDVNKIFKFI

SEQ ID NO: 6920 - protein, 214 aa, Zea mays
NSPCSPAGYVDYLRLFYCAFAGAPPAAACAALALWLAVLFYLLGDTASEYFCASLEGLSAALRLPPAVAGVTLLSLGNGAPDVFASVVSFASGDAGGGGVGVGLGSALGGALFVSTVVAGAVALAVGARGGAVVECRGFVRDLCFLLLALCYLLAVLVHGEVTVWVAASFVSLYVGYVVLVWTSHCCAEKGKPAADSLSEPVLLDDDVGDVVPS

SEQ ID NO: 6921 - protein, 369 aa, Zea mays
MDMGSGSSPVITDPISISPPLLGGLTSNLMPFSVMSGGCSSSPSMSNSSRRKIEEVLVNGLLDAMKSSSPRKKHNLAFGQDNSPDEDPAYTAWLSKCPSALASFKHIVANAKGRRIAVFLDYDGTLSPIVDDPDKAFMSPVMRAAVRNVAKYFPTAIVSGRSRKKVFEFVKLTELYYAGSHGMDIVTSAAAHATEKCKEANLFQPACEFLPMINEVSKCLVEVTSSIEGARVENNKFCVSVHYRNVAEKDWKVVAGLVKQVLEAFPRLKVTNGRMVLEVRPVIDWDKGKAVEFLLRSLGLSDSEDVVPIYIGDDRTDEDAFKVLRERSCGYGILVSQVPKDTEAFYSLRDPSEVMGFLNSLVRWKKHPL

SEQ ID NO: 6922 - protein, 472 aa, Zea mays
MELLPLLTWLLLAHALACLAWTAAARRRQSRCYLLDYVCHKPSDDRKLSTETAGNVIQRNARLGLTDYRFLLRVIVRSGIGEETYAPRNILEGREDSPTLQDAVDEMDAFFDEAIAELFARTGLAPRDVDVLVFNVSMLSPAPSLSSRIVRRYGLREDVAAYNLTGMGCSAGLIALDLARNALRTRPRALALVVSSESIAPNWYSGTDKTMMLANCLFRSGGSAVLVTNDPARRGQAKMELSCLVRANIGASDDAHACALQREDGEGRVGISLSKALPKAAVRAFAVNLRRLAPRVLPVGELARFATRLLARRLFTTSPHLRQQHLSGGKQKGDAAAAPKINFKAGVDHFCLHPGGTAVIEAVKKSLDLEDEDVEPARMTLHRWGNTSASSLWYVLSYMEAKGRLKVGDRVLMVTFGSGFKCNSCVWEVTGDMADKGAWADCIDAYPPEKLANPYLDKFGWINDVDGDTLML

SEQ ID NO: 6923 - protein, 117 aa, Zea mays
MVSAEVGIDYVLWTEDEVSTRVGEVAAELAADLRALPEPAVIVGVATGAFLFLADLVRRVDVRLVVDLVRVESYGAGTESSGKPRITADLKVDVAGKHVVVVSSSTLTRDREPLLCG

SEQ ID NO: 6924 - protein, 132 aa, Zea mays
KCAVILFIQALVIDYKLTYPSGTATAVLINGFHTPQGDKNAEKQVRAFLKYFGISFLWSFFQWFYTGGNACGFAQFPTFGLKARKHSFFFDFSMTYVGAGMICPHLVNLSALLGAVLSWGILWPLISRRKGD

SEQ ID NO: 6925 - protein, 227 aa, Zea mays
GFASMAAAAARRLLSRRASSSSLSALLRHGAVPEQSLVLRPAVVAAASRLGFQRGMARRPGGDGYVSTRSGAGGDRAPMATEMAPLFPGCDYEHWLIVMDKPGGEGASKQQMIDCYIQTLAKVLGSEEEAKKKIYNVSCERYFGFGCEIDEETSNKLEGLPGVLFVLPDSYVDAEYKDYGAELFVNGEIVQRTPERQRRVEPVPQRAADRPRYNDRTRYARRRENQR

SEQ ID NO: 6926 - protein, 141 aa, Zea mays
HASGAAQLHGGCGAWGVLFTGLFARRKYVEEIYGAGRPYGLFMGGGGKLLAAQIIQILVIAGWVSCTMGPLFYALKKLGLLRISADDEMSGMDLTRHGGFAYVYHDEDPGDKAGVGGFMLKSAQNRVEPAAAVAAATSSQV

SEQ ID NO: 6927 - protein, 96 aa, Zea mays
LALWVAAMAALFAWRFVQYRRSAAFRVMGYCLPTAKGAAETLKLNMALVLLPVCRNTLTWLRSTWARFFVPFDDSIAFHKIIATAIALGICLHAGN

SEQ ID NO: 6928 - protein, 701 aa, Zea mays
TTLNLGSFRTGPALATSPAAARRSPSPPPWRLRRIRFAFPMLLVVASLAGADDLASDARALVAFRDAVGRRLAWNASDVAGACSWTGVTCEHGRVAVLRLPGATLSGTVPAGTLGNLTALHTLSLRLNGLSGALPADLSSAAALRNVFLNGNRLSGGFPQAILALPGLVRLSLGGNDLSGPIPAELGNLTRLRVLLLENNRFSGEISDVKLPPLQQFNVSFNQLNGSIPASLRSQPRSAFLGTGLCGGPLGPCPGEVPPSPAPAGQTPSPAPVPSGSGGGGGTNGGSGVENGHKGKKLSGGAIAGIAIGSALGAALLLFLLVCLCRRSGGIRTRSLEMPPSSPAPAGGRKPPEMTSAAAVAPLTTIGHPNAPIVQSTSGKKLVFFGSAAAVASFKLEDLLRASAEVLGKGTFGTTYKAVLESGATLAVKRLKDVTLSEPEFRERISEIGELQHEFIVPLRAYYYSKDEKLLVYDFMPKGSLSAVLHGNITSGKTPLNWDLRSSIALAAARGVEYIHSTSSTASHGNIKSSNVLLGESYQAHVSDNGLTALVGPSSSPSRATGYRAPEVIDPRRVSQKADVYSFGVLLLELVTGKAPSQAALNDEGVNLPRWVQSVSRSEWGSEVFDIELMRHEAGEEPMAQLVLLALDCVAQVPEARPSMGHVVTRIEEIRKSSLTTNMEEEVDDQSSKAESEVPTNPFAS

SEQ ID NO: 6929 - protein, 514 aa, Zea mays
  misc_feature (266)..(266): Xaa can be any naturally occurring amino acid
  misc_feature (375)..(375): Xaa can be any naturally occurring amino acid
MTIARRLLRSNASAQAISLLKHVTGTASLQGHAHSPLDASVRHFSSAPSAQSDTTEENGFKGHGMLAPFTAGWQSNDLHPLIIERSEGSYVYDINGNKYLDSLAGLWCTALGGSEPRLVKAATEQLNNLPFYHSFWNRTTKPSLDLAQEILSMFTAREMGKVFFTNSGSEANDSQVKLVWYYNNALGRPDKKKFIARSKAYHGSTLISASLTGLPALHQKFDLPAPFVLHTDCPHYWRYHLPGETEEEFATRLATNLEDRVLKEGXETIAAFIAEPVMGAGGVIPPPKTYFDKVQAVVKKYDILFIADEVITAFGRLGTMFGCDYYNIKPDLVSLAKALSNAYVPIGATLVSPEISEVIHSQSNKLGSFAHGFTXYGHPVACAVAIEALKLYRERDIPGHVKQIAPKFQDGIRALADSPIIGEIRGLGMIMGTEFTNNKSPTDLFPAEWGVGAIFGEECQKRGMLVRVAGDAIMMSPMLIMTPGEVDELVSIYGEALRATEERVSDLKMKSEKN

SEQ ID NO: 6930 - protein, 178 aa, Zea mays
  misc_feature (147)..(147): Xaa can be any naturally occurring amino acid
MAPEMMEEGQSASYTVDDALLSSGFGRFQILILSYAGIGLIAEAMEMMLLSFVGPSVQLEWKLTSHQESMITSVVFVGMLIGAYSWGVVSDNYGRRRGFLFTAIMTSGAGFFSAFAPNYLSLISLRFLVGIGLGGGPVLGSWFLEFXPAPTRGTWMVVFSAFWTVGTILEASLAWTIM

SEQ ID NO: 6931 - protein, 156 aa, Zea mays
  misc_feature (23)..(23): Xaa can be any naturally occurring amino acid
  misc_feature (101)..(101): Xaa can be any naturally occurring amino acid
RQQHRHSFLLVLLLFSLLATTAXGHLISGGGPSVPLISVICLSGSRLATGVAATRERCEQSYGFLPCTAIVFENLFLMLEYAFLMYKVTTYLLVGSELLLXVMGVGLVGGLLLPILSALPDALLVVSSLSVHSPHSVLCCDTSLAIRLPAPWFESV

SEQ ID NO: 6932 - protein, 127 aa, Zea mays
MSSSVLGASAGGGGGGSSTGGPTRGVAGAGGGGPCGACKFLRRKCVTGCVFAPYFDSEQGAAHFAAVHKVFGASNVSKLLLQVPPHKRLDAVVTVCYEAQARIRDPVYGCVSHVFALQQQVCMHAAS

SEQ ID NO: 6933 - protein, 201 aa, Zea mays
IDTLCSVPQKLFVHGLGWGAGAEDLRSAFSRFGELEDCRVISDKQSGRSKGYGFVLFRSRRSALRALNRPQLQIGGRLAFCHLAASGPAPPAQSQNPISNANPDNIQRKIFVGNVHADVDVDRLYEYFAQFGEIEEGPLGFDKNTGRPKGFALFVYKSVESARRALEEPIKNFDGKTLNVQKAIDGRTKGSSGMNTNTNSN

SEQ ID NO: 6934 - protein, 268 aa, Zea mays
IPRRPRLRHQTRFRLIVKLVPTAHRCPLHLDLHRRRRSDPSPPLTPGVGCETLDPGALPVLGLIGLRNKGLPRRTASAWLPRFPSCSTSAPPPFAAVASMDAPPQGYRTNVGICLADPSLTKIFSASRIDIPSAWQMPQGGIDAGEEPRAAAFRELREETGVTSAEIVAEAPVWLTYDFPTDVRTKLNARWGTDWKGQAQKWFLFRLTGNDDEINLNGDGSEKPEFGEWTWMTPQEVIEKAVDFKKPVYEEALKHFAPYLQSDPAASS

SEQ ID NO: 6935 - protein, 216 aa, Zea mays
  misc_feature (15)..(15): Xaa can be any naturally occurring amino acid
SPCPSSSSSSTTAAXAPRLPRRTASARPLRFLSCSTSAPPLFAAVASMDSPPQGYRTNVGICLADPSLTKIFSASRIDIPSAWQMPQGGIDAGEEPRAAAFRELREETGVTSAEIVAEAPVWLTYDFPPDVRTKLNARWGTDWKGQAQKWFLFRLTGNDDEINLNGDGSEKPEFGEWTWMTPKEVIEKAVDFKKPVYEEALKHFAPYLQSDPAASS

SEQ ID NO: 6936 - protein, 155 aa, Zea mays
PASGNTLEDLANVVSNACIWLQDNNVPYNVLISDCGKRVFLFPQCYAEKQALGEVSQELLDTQVNPAVWEISGHIVLKRRSDYEEASETSAWKLLAEVSLSEERFEEVKAYIFSAAGLVLSDEEEEEASEGKGTTTFAPVPVSPMPVAEGCLVHQ

SEQ ID NO: 6937 - protein, 98 aa, Zea mays
MASWDNLGELSNIAQLTGLDAVKLISLIVRAASTARLHKRNWRRFAQHLKLISGLLEQLRVSELRQYPETPEPLEQLEDALRRATDEVGSSSFVSMSN

SEQ ID NO: 6938 - protein, 572 aa, Zea mays
  misc_feature (265)..(265): Xaa can be any naturally occurring amino acid
MGCVHGRPATSSPAPAATSSSRRDHPTASQTHKDGVDSAAAAPPVDAEAPEQQAAEKPQKVKRERRSRSSRSAAFAAHTEVRLGGSFANKARREHGAAGWPAWLSAVAGEAIDGWTPRRADSFEKIDKIGQGTYSNVYKARDSLSGKIVALKKVRFDNLEPESVRFMAREILILRRLDHPNVVKLDGLVTSRMSCSLYLVFDYMVHDLAGLAASPDIKFTLPQVKCYVRQLLSGLEHCHNRGVLHRDIKGSNLLLDNNGVLKIGXDFGLASFFDPNHKQPMTSRVVTLWYRPPELLLGATDYGVGVDLWSAGCILAELLAGKPIMPGRTEVEQLHKIFKLCGSPTEEYWKKSKLPHATIFKPQQPYKRRIADTFKDFPQSALRLIETLLAIDPSDRLTATSALNSDFFATEPYACEPSSLPQYPPSKEMDAKRRDEEARRLKAAGGRANGDGTRKTRTRDRPRAVPAPEANAELQANIDKRRLITHANAKSKSEKFPPPHQDGALGFPLGCSNHMEPSFEPPDPSSFSTVFPYEKSTVPTWSGPLADSAAGNQKRKHKSGRSSKQPATARAR

SEQ ID NO: 6939 - protein, 245 aa, Zea mays
MALPSSSTPTASAPASLGERWPPLESTPAVFNQFVWSLGVPEDDVEFHDVYGLDADALDMVPQPVLAVVLCFPDPPQDASYPSEQLLISGEKETQDQVYFIKQIESLGNACGTIALLHAVGNASSKVNLVENSCLDLFFKSTATMDPYERAVCLEKDDTMARAHLLAANDGATELSDLIEEHYICFVYVNGTLYELDGMKDGPIKHGPCSSISLLQDVVPVIKAIMCNIPNSINFNLMVLSRKEK

SEQ ID NO: 6940 - protein, 238 aa, Zea mays
MDSTLFIIGVIGNIISVLVFISPIKTFWRIVWSGSTEEFEPAPYVFTLLNALLWLYYGATKPDGLLVATVNGFGAAMEAIYVVLFIVYAANHATRVKTVKLAAALDICGFGVVFVATTFAINELNLRIMVIGMICACLNVLMYGSPLAAMKTVITTKSVEFMPFFLSFFLFLNGGIWATYAVLDRDIFLGIPNGIGFVLGTIQLIIYAIYMNSKVSQSSKEIASPLLASSQEEAASHV

SEQ ID NO: 6941 - protein, 321 aa, Zea mays
PLSCFSQDLPVVVTKYQAISGHKLLNLGDLLRFMLELRTRLPATSVTAMDYRGIMSEASCRWSAKRVDMAARAVVDALRRTEPPARWVTRQEVRDAARAYIGDTGLLDFVLKSLGNHIVGNYVVRRAMNPVTKVLEYCLEDVSSVLPAVGGVPSNGGGKMRVRFQLTRAQLMRDLMHLYRHVLKEPSQALTTGAFGAIPVAARMILDTKHFVKDYHEGFAPINSVGVGHVHMNLCCTLLLKNGGPELVAPYETVTLPAHATVGELKWEVQRLFSEMYLGLRTFTAESVAGVGVSQDACPVLGLIDVGSVVVIEGSVVEQQQ

SEQ ID NO: 6942 - protein, 166 aa, Zea mays
  misc_feature (155)..(155): Xaa can be any naturally occurring amino acid
MLDHLVGLLKLRVVRGVNLAVRDLRSSDPYVVVRIGKQKLKTRVVKKSVNPEWDDELTLSIEDPAVPIRLEVFDKDTFVDDTMGNAEVDIRPLVEIVKMKLQDVADRTVVKKLVPNRQNCLAEESSIYISEGKVKQDMVVRLRNVESGEIELQLXQWIDLPGSKGV

SEQ ID NO: 6943 - protein, 216 aa, Zea mays
  misc_feature (161)..(161): Xaa can be any naturally occurring amino acid
MTMNGAAAPERSPPPSPPPPAQAQAQAPPSPSPAQPLEWRFSQVFGERSAGEEVQDVDIISAIEFNKSGHHLATGDRGGRVVLFERTDVKDLASRKDAEKADHSISRHPEFRYKTEFQSHEPEFDYLKSLEIEEKINQIKWCQAANGALFLLSTNDKTIKXFWKVQEKNVKKLSEMNLDRSAAPTNGSPGGTGYPRPSLLNGNVLKPGGLPLATPS

SEQ ID NO: 6944 - protein, 145 aa, Zea mays
  misc_feature (80)..(80): Xaa can be any naturally occurring amino acid
ACLQLRLPDSGDGEGVPLVYIYGPKIKYDRGAAVAFNIKDCNTGTSLINPETVQKLAEKEGLSLGVGFLSHIRLIDNQKXPAANGRREKKNSKNAIIGTEVVTASLGFLTNFEDVYRLWAFAAKFLDSSFLEQERLSSIPEDAER

SEQ ID NO: 6945 - protein, 501 aa, Zea mays
NSHHAPHLPAFSGAYSSAQVREVIESEMDQDSSDRDGASTIYEESESVSVGEVMKSPVFSEDESSENSFWVDLGQSPLGSDHSEQSSKGKLGSPLPASWFSGRKSAKKASPKVPSKLSRSPIHDNHVMSFDAAVRSVSQEPGPEKGDLDEDNSHINIKNTPISEIEEDNKDAKVNKRFVKFSCANDTAEGEGCATSVFGSCTTRENGSTSEIFSESQAETKDSAIRRENEGDFRLLGRREAYNGRFNGGRFFGVEESERVPSMGHNVSFTLDDSKLCRNADAGETSGYGMADDDDDDDDAYSDYDEALDGRKEPEIICKHLDHVNMLGLSKTTLRLRYLINWLVTSLLQLRLPDSGDGEGVPLVYIYGPKIKYDRGAAVAFNIKDCNTGTSLINPETVQKLAEKEGLSLGVGFLSHIRLIDNQKHGAVDVGLSSSWPAANGRREKKNSKNAIIGTEVVTASLGFLTNFEDVYRLWAFAAKFLDSSFLEQERLSSIPEDAER

SEQ ID NO: 6946 - protein, 461 aa, Zea mays
IQFPVRCLFLFVVGMRFDLIGASITHYASKWLPGLTKDGPHGGALEEPWAQAQASPGGGLHMIIASGGGGGGGKDDIAGSTPAREQRMVVESLISIIPLQRDSVSCGFLLRLLRLAVMLKAAPALVTELEKRVGMQLEQAVLADLLIPSYGRAETAYDVDLVQRLVEHFLVQEQTELLASSSPGRVEQPPLPEYYGARTAGAAAASASAGLNAKARVARLLDSYLSEVSRDRNLSLTKFQVLAESLPESARTCDDGLYRAVDSYLKASQAHPTLTEHERKRLCRVMDCQKLSLDACMHAAQNERLPLRVVVQVLFSEQVKISNALASGSSSNAAAAALLANKAADGVAPPTRRQLLDGTPQSFQEGWAAAKKDINTLKLELESMKAKYLELQHEMDALQKLVERVGSKNHSQGPSAWSSGWKKLGRLAKMTGGDAAGHDGHVPGAPGDAPRKPRRWRNSIS

SEQ ID NO: 6947 - protein, 266 aa, Zea mays
MGPAMVVVTTRDSGILARFLIKPAAFHPWRDRATTQPTHQRRPNKSPALRARRLATLTFLPCSAAAATVASTAMVSAEVGIDYVLWTEDEVSTRVGEVAAELAADLRALPEPAVIVGVATGAFLFLADLVRRVDVRLVVDLVRVESYGAGTESSGKPRITADLKVDVAGKHVVVVEDIVDTGNTLSYLIAHLEKKGASSISVCTFLDKPARRKVNVHLVGDGKFYRGFECPDYFVVGYGLDYAELYRNLPYVGVLKPEMYTKDSSN

SEQ ID NO: 6948 - protein, 119 aa, Zea mays
  misc_feature (105)..(105): Xaa can be any naturally occurring amino acid
MPAEQFLKSIIDIPYIFQRLDALLFMSSLPEETSNVKHAFATLEVACQELKNSRLFLKLLEAVLKTGNRMNVGTFRGGAQAFKLDTLLKLSDVKGTDGKTTLLHXVVEEIIRSEGIRAT

SEQ ID NO: 6949 - protein, 648 aa, Zea mays
MIHPLVLSLPSPAIISRPRRHRHHTTTPSLPSHSRSLHHYRLLRVTPLVASCGDRRRIVRGASATMGLFTVTKKATTPFEGQKPGTSGLRKKVTVFQQPHYLQNFVQSTFNALPADQVKGATIVVSGDGRYFSKDAVQIITKMAAANGVRRVWVGQNSLMSTPAVSAVIRERIGADGSKATGAFILTASHNPGGPTEDFGIKYNMGNGGPAPESVTDKIFSNTTTISEYLISEDLPDVDISVVGVTSFSGPEGPFDVDVFDSSVNYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLAWLSIIAFKNKDNLGGDKLVTVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKTGRDSQEALAPLVDVALKLSKMQEYTGRSAPTVIT

SEQ ID NO: 6950 - protein, 378 aa, Zea mays
  misc_feature (101)..(101): Xaa can be any naturally occurring amino acid
  misc_feature (156)..(156): Xaa can be any naturally occurring amino acid
  misc_feature (217)..(217): Xaa can be any naturally occurring amino acid
MVQQQQAAKEVIPLLTPYKMGQFELSHRVVLAPLTRCRSYGNVPQPHAAVYYSQRATRGGLLIAEATGVSATAQGFPESPGIWTQEQVEAWKPIVDAVHRXKGAIFVCQIWHVGRVSTNELQPNGDAPISSTDKQISPDAKSGTAYSKPRRLRTDXEVPGIVDDFRRAARNAIQAGFDAVEIHGAHGYLLEQFMKDSCNDRTDQYGGSLENRCRLAXVRSVDAVVREVGARRVGIRLSPFVDFVDCVDSDPVALGHYMVQQLNRHSGLLYCHMVEPRITAHGRRQIPHGLLPFRKAFHGTFIAAGGYDREEGNKVVAEGYADLVAYGKLFLANPDLPRRFELDVALNKYDRSTFYTQDPIVGYTDYPFFEEEDGKNER

SEQ ID NO: 6951 - protein, 89 aa, Zea mays
  misc_feature (52)..(52): Xaa can be any naturally occurring amino acid
WELRYLLKLLCFSRYGSCLGHLEKLKPNLLLDIHLHEHVESLYMDIRYKAIXTLPFISVDLNTMATAFKTSVALITENKIQATLARSSF

SEQ ID NO: 6952 - protein, 85 aa, Zea mays
HAEVITSAEFHPTHCNTLAYSSSKGSIRLVDLRQSALCDNHSQIFEQHEAPGSRSFFTEIIASISDIKFSKDGRHILSRDYMTLK

SEQ ID NO: 6953 - protein, 212 aa, Zea mays
MAAGAKAAGALALALVLALAGANSEGDALSALRRSLRDPGGVLQSWDPTLVNPCTWFHVTCDRDNRVTRLDLGNLNLSGHLVPELGKLEHLQYLELYKNNIQGTIPSELGNLKNLISFDLYKNNISGTIPPALGKLKSLVFLRLNGNHLTGPIPRELAGISSLKVVDVSSNDLCGTIPTSGPFEHIPLSNFEKNPRLEGPELQGLAIYDTNC

SEQ ID NO: 6954 - protein, 435 aa, Zea mays
MSQRDGDLTGAHPEEGDRHAVRMDGSDDDELDQPTSKATEHITAMDVRKGKDMQGIPWNVMPTTRDKYRQSRLQGYANFENVPNSGRLSEKECMPAEKGQLYYEFQHSTRSVKPTIRHFQLRNLVWATTRHDVYLMSNFSVLHWSAMTCKKQEVINLLGHVTPCEKHHRNYYEGFYRTPVSTLAVKHNLLVTGGFHGEIICKFLDRQGVSYCCKTTNDDDGITNSLEIFEKPSGSLHFLASNNDCGLRDFDMEKFRICNHFHFAWPVNHTSLSPDGKLAAIVGDSPDGLLIDANSGKTVHKLHGHLDYSFASAWNPDGRTFATGNQDKTCRVWDVRNLSRSVVVLGGNIGAVRSIRYTPDGKFMAMTEPADFIHIFDVESGYSRKQELDFFGEIAGISFSPDTEALFVGVHDRFFSCCLLQFNRRRFYSYLDSTL

SEQ ID NO: 6955 - protein, 247 aa, Zea mays
MDSEHWISRLAAAKRYYAAQLGHVDDVPGIGTEEVEMEIEDDGGLEMEMEMALGLGDATWPDVACPYCYEDHDVASLCVHLEEDHPYEPHSAPCPICSQRVTRDMLNHMTMQHGYLFKNGHRSRRYIIPESHAISALSRDLRGTHLRALLGGGHGHRSSNAVTTNISSDPLLSSFGLGFSPSDAPEPSKSASSIPDGASIRKETPVQPWESSIDSSLTSEEREQKRKQATGRATFVQGLVLSTLFGD

SEQ ID NO: 6956 - protein, 81 aa, Zea mays
AAGDECGFKNFPTLGLEAYNNRFFFDFSPTYVGVGMICPYIVNVSVLLGGILSWGVMWPLIAKKKGSWYLASVDDSSLHGL

SEQ ID NO: 6957 - protein, 511 aa, Zea mays
MEMVPWLLGFLGRYPELMVSLACFLLLFRRLNQRDGLPTNWPVVGALPAITVNAGRMHEWVTEFLRAAGLSYVMKGPWGSPVDVIMTADPANVAHVFTSNFGNYPKGQEFAALFDVLGDGIFNADGESWAFQRRKAHALLSDARFRAGVAASTARKLRDALVPLLDGIAASGAVVDLQDVFVRLTFDLTAMFVFGIDPGCLAPDFPYVPFAAAMDTVEEVLFYRHVAPVPWLMLQKYLRTGHSKKMWNARRVLDASIAEFISLRRERAAEAEAEADLLTSYLACHDEIGKSGAELERFLRDTTLNLMVAGRDTTSSALTWFFWLLTKHPDVEAKVLEELRAHPPLSGAGGHRTAAELKQLVYLHAALSESLRLYPPVPFEHKAAARTDTLPSGARVGPSRRVIVSFYSMGRMEAVWGKDCSEFRPERWLTAAGRFRHEPSYKFVAFNVGPRTCLGRDLAYSQMKAVVAAVLPRFRVEVDAGAVVRPKLSIILHMKDGLKVRVPKREEDGLC

SEQ ID NO: 6958 - protein, 525 aa, Zea mays
MELPAPSSASFFLVAVVAGATLFLVTVLRLRARSTRKYRLPPGPRPWPVIGNLNLIGPLPHHSVHELSKRYGPLMSLRFGSFPVVVASSVDTARLILKTHDLAFIDRPQTAAGRYTTYNCAGLFYQPYGAYWRQARRLCQAELFSARRLMSLEHVRSDEVRAMLSDLRAASSAPAGGHDAVTLREHLYMVNLSVVSRMLLGKKYVVEGSSSPATPEEFRWLIDEHFFLNGVLNVADMIPWLSPLDPQGYVKRMKRSAKMLDRFLEHVVDEHNERRRREGEDFVAMDMMDVLLELADDPSQLEVPITRDNVKGFTLDLMGGGTDTSAVTVEWAMSELLRNPEVLAKATEELDRVVGRDRLVAEGDIPSLPYLDAVVKETLRLHPVAPLLTPRLCREDVSVGGYDIPAGARVFVNAWAIGRDPAVWEAPLEFRPERFAGSSVDVKGQHFELLPFGSGPRMCPGMGLALRMVPTILGNLLHAFAWRLPDGVAAEELGMEKTFGLTVPRLVPLQAVAEPKLPARLYAAL

SEQ ID NO: 6959 - protein, 549 aa, Zea mays
MGNACSGALRSKYLHSFKHAASQRHDSEYSASASADDSPRKPTPPATTDAHAPAPPATAMRRGGAGAPPDLGSVLGHTTPNLRDLYALGRKLGQGQFGTTYLCTELATGIDYACKSISKRKLITKEDVDDVRREIQIMHHLSGHKNVVAIKGAYEDQVYVHIVMELCAGGELFDRIIQRGHYSERKAAALTRIIVGVVEACHSLGVMHRDLKPENFLLANRDDDLSLKAIDFGLSVFFKPGQVFTDVVGSPYYVAPEVLLKSYGPAADVWTAGVILYILLSGVPPFWAETQQGIFDAVLKGAIDFDSDPWPVISDSAKDLIRRMLNPRPAERLTAHEVLCHPWIRDHGVAPDRPLDPAVLSRIKQFSAMNKLKKMALRVIAESLSEEEIAGLKEMFQTMDTDNSGAITYDELKEGLRKYGSTLKDTEIRDLMDAADIDNSGTIDYIEFIAATLHLNKLEREEHLVAAFSYFDKDGSGYITVDELQLACKEHNMPDAFLDDVINEADQDNDGRIDYGEFVAMMTKGNMGVGRRTMRNSLNISMRDAPGAF

SEQ ID NO: 6960 - protein, 556 aa, Zea mays
MGNACGGALRSKYQHSFKHAASSQRRASSEYSASAVADDSPRKPTQPPATTDAHAPPPPPATAAAAMRRGGAGAPPDLGSVLGHPTPNLRDLYALGRKLGQGQFGTTFLCTELATGVDYACKSISKRKLITREDVDDVRREIQIMHHLSGHTNVVAIKGAYEDQLYVHIVMELCAGGELFDRIIQRGHYSERKAAELTRIIVGVVEACHSLGVMHRDLKPENFLLVNKDDDLSLKAIDFGLSVFFKPGQVFTDVVGSPYYVAPEVLLKNYGPAADVWTAGVILYILLSGVPPFWAETQQGIFDAVLKGVIDFDSDPWPVISDSAKDLIRRMLNPRSAKRLTAHEVLCHPWIRDHGVAPDRPLDPAVLSRIKQFSAMNKLKKMALRVIAESLSEEEIAGLKEMFQTMDTDNSGAITYDELKEGLRKYGSTLKDTEIRDLMDAADIDNNGTIDYIEFIAATLHLNKLEREEHLVAAFSYFDKDGSGYITVDELQQACKEHNMPDAFLDDVINEADQDNDGRIDYGEFVAMMTKGNMGVGRRTMRNSLNISMRDAPGAF

SEQ ID NO: 6961 - protein, 242 aa, Zea mays
  misc_feature (151)..(151): Xaa can be any naturally occurring amino acid
MVCRDDQPRAVSPPDQQQAADSPVSRTPSNPPPPPRRRSSLSSQPPPIEPLAPAPSGGMEAGGEEFAIGVVLSAKTTLGEEFEGQIVAFDRPSNLLVIQEGVGRAESGERRNVRVLKANYIREFSVLSKGDDPLDPAGCMLDLNSIYAREXLALRQAEIEAERIGVGVTPEAQNIFDALSKTLPVQWDKTDIVVMKEVRVRSPYLPENVSGGTAAANERVKKVIDFERKRLHSRAPGPILLT

SEQ ID NO: 6962 - protein, 681 aa, Zea mays
  misc_feature (239)..(239): Xaa can be any naturally occurring amino acid
FGTRARLAWNTRRIIGLRYARGRPRGPPANLLALAILLLSTTPAPTAGEQTICSDATYERNSTYMSSLRSVAGALTGDAARLHSSTGAAGEGPDKVYGAVLCRADTAGADCARRLRDALAAITDGDGRSPCALHRDVAVYSELYQLRFSDRDFLADFSNAPEWVDVTNPGPVPLAVAARFDQRVTELLSALADAAAGRPGRWAVGEAPWSSSGGRDRAVYALAQCTLDMPPDHCRACGXLDGAMAERRRKVGGSKMGAAVFGARCTLRYEMDLQVFNVTGNSKMLSLLGKKKDRAFVIVATAYASAILCTRLLFWLLSVWRKQKRKMDLTEEPQNVDEILRSWRIEDASLEFSLYDFSQIADATVNFSPKNMIGEGGFGPVYKGVLTDGQEVAIKRLSARSRQGLVEFKNEIQVIAKLQHRNLVRLLGCCIHEEEKMLVYEYLTNKSLVPFLVDPIRQASLDWKRRIKIVDGIAQGLLYLHNLSRIRIIHRDLKAGNILLDSDLNPKISDFGMARIFPSDATQATASRLVGTYGYMAPEYVSDGLLSIKSDVFSFGVLLLEIISGKRSSGFQHNGEFYNLLEYAWELWKDRRWNEFIDQSFGDDYELEELMKYLAVALLCVQEKTVDRPTMPDVVAVLSSDGVTLPEPKQPAYSYAKVDVSVNVAVLSSRNDVTITTTNGR

SEQ ID NO: 6963 - protein, 46 aa, Zea mays
PFHLASPSVHSDGETFISADDLRINLWNLEISNQSFNIVDVKPAHM

SEQ ID NO: 6964 - protein, 206 aa, Zea mays
  misc_feature (24)..(24): Xaa can be any naturally occurring amino acid
  misc_feature (142)..(142): Xaa can be any naturally occurring amino acid
  misc_feature (159)..(159): Xaa can be any naturally occurring amino acid
  misc_feature (176)..(176): Xaa can be any naturally occurring amino acid
  misc_feature (183)..(183): Xaa can be any naturally occurring amino acid
RVKASLLEEGSFDAAVHGCDTVFXTASPFYHNVKDAKAELLDPAVKGTLNVLGSCKKASIKKVVVTSSMAAVAYNRRPRTPEVTVDETWFSDPQICETNQTLAEEAAWKFSRDNGLEIVTINPAMVIGPLLQPTLNTSAEAXLKLINGSSSTYPNFCFXWLSKDVPGHILLRVPIXKTDGERXCHYSELVNIIRNMYPTLPLRTSV

SEQ ID NO: 6965 - protein, 427 aa, Zea mays
MDDAGRAPPPAPAAVTVSATAAPAPTPPSATVAADKSSLDPDALYEEGMWQQMAMNSGATMQPGSYPERPGEPDCTYYLRTGLCRFGMSCRFNHPPDRNLAIASARMKGEYPERVGQPECQYYLKTGTCKFGPTCKFHHPREKAGIAGRVQLNTLGYPLRPNEKECAYYLKTGQCKYANTCKFHHPELFNVVPSSRGSPIYTSVHSSASAGSQSYTGTMSSWTFPRASFIPSPRWQSPSNYAPMVVPHGLVQVPSWNSYPGQLQSPGAQQTYGSSQQGEASAGNQGMLSPYRSSSFPVPQYALQRDNVFPERPDEPECQYYMKTGDCKFGAVCKFHHPRVRSQPPPDCVLSPMGLPIRPGEELCKFYSRYGICKFGANCKFDHPTMAAPMGVYAYGFSGSASVAPASTNAPMTRHLLGSPSGSGYMS

SEQ ID NO: 6966 - protein, 440 aa, Zea mays
MSTTKVKRRVGKYELGRTIGEGTFAKVRFARDTVTGEAVAIKILDKEKVLRHKMVEQIKREISTMKLIKHPNVVRIYEVMGSKTKIYIVLEFATGGELFDTIVNHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEFTFPPWTSFPAKRLLTRILDPNPMTRITIPEILEDEWFKKGYKRPEFDEQYDTTLDDVDAVFNDSEEHHVTEKKEEEPVALNAFELISMSAGLNLGNLFDSEQEFKRETRFTSKCPPKEIVRKIEEAAKPLGFDVQKKNYKLRLEKVKAGRKGNLNVATEILQVAPSLHMVEVRKAKGDTLEFHKFYKNLSKTLKDVVWKSDDLQTQHAS

SEQ ID NO: 6967 - protein, 521 aa, Zea mays
MAPKKRKADPAESPAAVEAATTNHRHEPASSEPKPRGSIYFPITDDPPEPNAAEEDEDEGAGDDEDDAEDIVKLLEPLSREQLVALLRTAAEASPATMAAVRRAVEADPASRKLFVHGLGWGAGAEDLRSAFSRFGELEDCRVISDKQSGRSKGYGFVLFRSRRSALRALNRPQLQIGGRLAFCHLAASGPAPPAQSQNPISNANPNANSNSTSNASGSSSSQTDNIQRKIFVGNVHADVDVDRLYEYFAQFGEIEEGPLGFDKNTGRPKGFALFVYKSVESARRALEEPIKNFDGKTLNVQKAIDGRTKGSSGMNTNTNSNPTTASVVAAQMTAPSSVAISPYDASAYSATVVPDMSFAQQAAMLGLGAQQQAFTQPNAMLAMIAAMQNPAALGMSPAMLAAMNPAFAAAALGAGGQQAHTVGLTGFGAQGFGTPSFGAGAAFPNAAGVQAAAAAYQGSGAPPGFQGPPGFQVGQATTQTSTAAAAAAAAATAAGYQAGASGQGQVPGSQVGGPGFQGGY

SEQ ID NO: 6968 - protein, 241 aa, Zea mays
  misc_feature (102)..(102): Xaa can be any naturally occurring amino acid
  misc_feature (197)..(197): Xaa can be any naturally occurring amino acid
  misc_feature (209)..(209): Xaa can be any naturally occurring amino acid
  misc_feature (215)..(215): Xaa can be any naturally occurring amino acid
QSNPISSPLRSSLTLSPNPSPPRRHSRARLPDRDPGDMPRYDDRHGNTRLYVGRLAPRTRSRDLEYLFSKYGRFSVFYPTMEMKLQVDAFEYLTHVSSLLFXGNYLRRIREVELKRDYAFIEFSDPRDADDAQYNLDGREVDGSRIIVEFAKGVPRGSGGSREYMGRGPPPGTGRCFNCGMDGHWARDCKAGDWKNXCYRCGESGHIEXNCQNSXRNLRRDKSYSRLHPPRGGTWPQPELQ

SEQ ID NO: 6969 - protein, 201 aa, Zea mays
  misc_feature (17)..(17): Xaa can be any naturally occurring amino acid
  misc_feature (64)..(64): Xaa can be any naturally occurring amino acid
SASSQTSPRTQGNPILXQLKSNSIGLRVVVGLASELSNVKKPSAMVSYVLSSYVAKLAGGIEKXPRVLRLNEELKARDDAWQFHDRMQRFLKKADDEIIRVQCQESVALSLVKEITEYFHGDSAKEEAHPFRIFMVVRDFLAVLEQVCKEVGRINERTIASSARHFPVPVNPMMPQLFPRLHALRAGFSDDESSAASVSSP

SEQ ID NO: 6970 - protein, 95 aa, Zea mays
  misc_feature (24)..(24): Xaa can be any naturally occurring amino acid
GAPRGHERRGDLDLYRCVSLVGYXMLPMVIFSAVSLFLPRGGGFIFGVGMAFVIWSTRVCTRLLGELASSGDEHRGLIAYACWLVYMLFSLLVIF

SEQ ID NO: 6971 - protein, 168 aa, Zea mays
CRLQRRHPQAAVPDSDDAVLLDVLNRIGDVKALGRCALVSRRFHALVPLVCSVFVRVDEPTSGLDNASALHIVGALRAMAEARGRTVLLSIHQPGACIVKMFDSVLLLAVGSVLHHGIVDQLRALLGDAGLHLPPHVDDVEFAIDSVDALRRHARRPPETERAAASVP

SEQ ID NO: 6972 - protein, 275 aa, Zea mays
  misc_feature (101)..(101): Xaa can be any naturally occurring amino acid
  misc_feature (136)..(136): Xaa can be any naturally occurring amino acid
  misc_feature (248)..(248): Xaa can be any naturally occurring amino acid
MSNSGRWRRRTRSVAPSPATSSPSSPGLREAQPFRLPQWKFSQVLGELPPAAEARRDGAPRPQDDDDADEISAIEFDGRGEYLAGGDNAGRVILFRRTRRXDGDDARPRAELERTDRAGAPPPRYSYATEFQSHEXRFDVLDSLDISERIKKVRWCARPNSSLLMLAANDRTVKLWEVSEHKAEAPKKGNGRPSWGTTPRGCSSAEPDERPEKVAGGVGDGYSAKCRRVFGRAHEFNIHSVSTNCDGXETLVSADDVRINLWHAGVTRQCLTSGA

SEQ ID NO: 6973 - protein, 399 aa, Zea mays
FTLGTLQWAQGKAGEDRVHVVVSEERGWVFVGIYDGFNGPDATDFLVSHLYAAVHRELRGLLWDQRDAHPDQPTTTSTTASDHQDRRRRRARRSRPPRGADDDQRRWKCEWERDCSSALKPPTQRPPRGSSQNDHLAVLKALARALRKTEEAYLDVADKMVGEFPELALMGSCVLAMLMKGEDMYLMNVGDSRAVLGTMDSVDVEQVTSDGLVGDGTPLLSPARLPSEHSTSVRQEVCRIRNEHPDDPSAISKDRVKGSLKVTRAFGAGFLKQPKWNEALLEMFRIDYVGSSPYVTCSPSLCHRRLSTRDRFLILSSDGLYQYFTSEEAVAQVEMFIATTPDGDPAQHLVEEVLFRAANKAGMDFHELIEIPHGDRRRYHDDVSVIVISLEGRIWRSCV

SEQ ID NO: 6974 - protein, 268 aa, Zea mays
QLQWAQGKAGEDRVHVVVSEERGWVFVGIYDGFNGPDATDFLVSHLYAAVHRELRGLLWDQRDAHPDQPTSTTAASDHQDRRRRARRSRPPRGADDDQRRWKCEWERDCSSALKPPTQRPPRGSSQNDHLAVLKALARALRKTEEAYLDVADKMVGEFPELALMGSCVLAMLMKGEDMYLMNVGDSRAVLGTMDSVDVEQVMASDGLVGDGTPLLSAVQLTSEHSTSVRQEVCRIRNEHPDDPSAISKDRVKGSLKVTRAFGAGFLKQ

SEQ ID NO: 6975 - protein, 401 aa, Zea mays
MSFPRLLLAVLAATVAAAYAPARAAGAGAGACAAEKLSSNRVFQTCADLPRLGASLHWSYDAAASSLSVAFLAAPPSAGGWVAWGLNPKGQSMDGTQALVAVPSGGGGGGGAYEVQTYSISGTSLGSPGAPLAYPTSDLAAELGGDGRVRIFGTLKLPNGTGGAEVNQVWQVGPYSGGIQIHEMKGDNMNAKGTLNLLTGATAAASGGGSILRKKNTHGILNAVSWGLLLPMGAIFARYLKTFRSADPAWFYLHVACQLLGYGVGVSGWATGIHLGNLSKGITYSLHRNIGITVFALGTLQIFALFLRPKKDHKYRVYWNAYHHSVGYTVIVLGVVNIFKGMAILDVEQRWKTGYIAAISVLGAVAVALEAVTWGVVLRRRKEESKSYNGTSNAGRLPLSM

SEQ ID NO: 6976 - protein, 266 aa, Zea mays
VRIDVPPTSPGRAALKVWEELVNVLRKDGADPAAAFVHRKKVQHAEKSIRDAFLALYRGLDLLNKFSSLNVKAFTKILKKFVKVSEQQRKTDLFSEKVKRSPFSSSDKVLQLADEVECIFSRHFAGNDRKVAMKYLKPQQPRNTHMITFLVGLFTGTFVSLFIIYSVLALVAGIFSSTGNTAYMEIVYHVFSMFALISLHVFLYGCNLLAWKSSRISHNFIFDFSPSTALTHRDAFLVSASIMCTVVARLVSVLLKLTDERGAPTR

SEQ ID NO: 6977 - protein, 560 aa, Zea mays
  misc_feature (502)..(503): Xaa can be any naturally occurring amino acid
LQLPATVRIDIPPTSPGRAALKVWEELVNVLRKDGADPAAAFVHRKKVQHAEKSIRDAFLALYRGLDLLKKFSSLNVKAFTKILKKFVKVLDHRKGDLFSEKVKRSPFSSSDKVLQLADEVECIFLRHFAGNDRKVAMKYLKPQQPRNTHMVTFLVGDCSYCSSSVCVVPGLFTGTFVSLFIIYSVLAHVAGIFSSTGNTAYMEIVYHVLSMFALISLHVFLYGCNLSMWKGTRINHNFIFDFSSTALTHRDAFLMSASIMCTVVAALVVNLFLRNAGATYANALPGALLLLSAGVLFCPFNIFYRSTRFCFMRVMRNIVLSPFYKVLMADFFMADQLTSQIPLLRHLEFTGCYFMAETFRTHAYGSCTSSSQYKNLAYVLSFLPYYWRAMQCLRRYLEEGHDMNQLANAGKYVSAMVAAAVRFKYAATPTPFWMWMVIASSTGATIYQLYWDFVMDWGFLNPKSKNFWLRDQLILKNKSIYYASMMLNLVLRLAWAESVMXXRLGMVESRLLDFSLASLEIIRRGHWNFYRLENEHLNNAGKFRAVKTVPLPFRELETD

SEQ ID NO: 6978 - protein, 568 aa, Zea mays
MAASRRQHRRGFPLVPLLLSLLAAAAYGRLISDGGPPAPLLPVIRLAAPPAEAECEQTYGFLPCTTTVLGNLFLVLAYGFLMFKAATFLSAGSELLLEIMGPGLVGGLLLPILGALPDALLVLVSGLSGSKEEAQSQVLIGMGLLAGSTVFLLTLLWGTCVVVGKCDLGPGREAVDVTDTKGFSLTGTGVTTDVQTSYAARIMGLSVIPFIIAQFPKMLKTHHGQRLAMLLALVVSFALVLAYCLYQVFQPWIQRRKLAYAKHKHVISGILRHAQMQSLGRLLNDDGTPNEQVIRKLFRKIDMDESRSLSRAELHALIVGINFEEVDFDRTDAVDKVMDDFDTSRNDVVEEEEFVQGMRKWLDEARRSVPVGGAFSSKFIHEARGAARRQHDELVDRSDEAVESVENPGWCIAKAVALLLLGAAAAAAFADPLVDAVHNFSNATHIPSFFISFIALPLATNSSEAVSAIIFASRKKQRTCSLTFSEVYGGVTMNNTLCLGVFLALIYFRNLTWDFSSEVLIILLVCVVMALFTSFRTTFPLWTCLVAYMLYPFSLVLVYILDYVFGWS

SEQ ID NO: 6979 - protein, 123 aa, Zea mays
MGKRWIPLEANPDVLNQFIWGLGVHEEDVQFCDVYGLDDELLAMVPQPVLAVLFLYPLTSLDEEKEESSVSAATSTSAGKVWLYHPVLFFSCAVMVMFLTQCLGHFSDALWSKSVPWSRKEKV

SEQ ID NO: 6980 - protein, 419 aa, Zea mays
TSPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLVGAALMDEETRNTVVKANPAALLALCWYWASEGIGKKDMVVLPYKDSLLLLSRYLQQLVMESLGKEFDLDGNRVNQGLTVYGNKGSTDQHAYIQQLREGVHNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAICENPTEPLTLDEIADRCHCPEDIEMIYKIIQHMAANDRALIAEGSCGSPRSVKVYLGECSVDEDMQAA

SEQ ID NO: 6981 - protein, 616 aa, Zea mays
MASISGAAAPPSSAVCRLRLRRHLLLRPSHLRLRAPHSIADLSRSSNSAPNPARPALGSGPENGSGGVRAVEKDPIKLWERYVEWLYQHKELGIFVDVSRMGFTEEFLRQMEPRMQQAFVDMRELEKGAIANPDEGRMVGHYWLRDPALAPNSFLRNKIETALDKILAFSQDVISGKILSPSGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLVGAALMDEETRNTVVKANPAALLALCWYWASEGIGKKDMVVLPYKDSLLLLSRYLQQLVMESLGKEFDLDGNRVNQGLTVYGNKGSTDQHAYIQQLREGVHNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAICENPTEPLTLDEIADRCHCPEDIEMIYKIIQHMAANDRALIAEGSCGSPRSVKVYLGECSVDEDMQAA

SEQ ID NO: 6982 - protein, 512 aa, Zea mays
MATVSLTPQAVFSTESGGALASATILRFPPNFVRQLSTKARRNCSNIGVAQIVAAAPTLRGGGWLGRRIATDAITTPVVNTSAYWFNKSAAAAASAAADVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVPAGGHIVTTTDCYRKTRIYMENELPKRGISMTVIRPADMDALQNALDNNNVSLFFTETPTNPFLRCIDIEHVSNMCHSKGALLCIDSTFASPINQKALTLGADLVIHSATKYIAGHNDVIGGCVSGRDELVSKVRIYHHVVGGVLNPNAAYLILRGMKTLHLRVQCQNDTALRMAQFLEEHPKIARVYYPGLPSHPEHHIAKSQMTGFGGVVSFEVAGDFDATRKFIDSVKIPYHAPSFGGCESIIDQPAIMSYWDSKEQRDIYGIKDNLIRFSIGVEDFEDLKNDLVQALEKI

SEQ ID NO: 6983 - protein, 484 aa, Zea mays
  misc_feature (65)..(65): Xaa can be any naturally occurring amino acid
MATVSLTPQAVFSTESGGALASATILRFPPNFVRQLSTKARRNCSNIGVAQIVAAAWSDCPAARXASAAAEVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVPAGGHIVTTTDCYRKTRIYMETELPKRGISMTVIRPADMDALQNALDNNNVSLFFTETPTNPFLRCIDIEHVSNMCHSKGALLCIDSTFASPINQKALTLGADLVIHSATKYIAGHNDVIGGCVSGRDELVSKVRIYHHVVGGVLNPNAAYLILRGMKTLHLRVQCQNNTALRMAQFLEKHLKIARVYYPGLPSHPEHHIAKSQMTGFGGVVSFEVAGDFDATRKFIDSVKIPYHAPSFGGCESIIDQPAIMSYWDSKEQRDIYGIKDNLIRFSIGVEDFEDLKNDLVQALEKI

SEQ ID NO: 6984 - protein, 484 aa, Zea mays
  misc_feature (64)..(64): Xaa can be any naturally occurring amino acid
MATVSLTPQAVFSTESGGALASATILRFPPNFVRQLSTKARRNCSNIGVAQIVAAAWSDCLAAXAASAAADVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVPAGGHIVTTTDCYRKTRIYMENELPKRGISMTVIRPADMDALQNALDNNNVSLFFTETPTNPFLRCIDIEHVSNMCHSKGALLCIDSTFASPINQKALTLGADLVIHSATKYIAGHNDVIGGCVSGRDELVSKVRIYHHVVGGVLNPNAAYLILRGMKTLHLRVQCQNDTALRMAQFLEEHPKIARVYYPGLPSHPEHHIAKSQMTGFGGVVSFEVAGDFDATRKFIDSVKIPYHAPSFGGCESIIDQPAIMSYWDSKEQRDIYGIKDNLIRFSIGVEDFEDLKNDLVQALEKI

SEQ ID NO: 6985 - protein, 156 aa, Zea mays
EKAITEKLKTLGNSVSIFHLVDYPVNGFVFEGGASLEDLSDVVSKVCIFLQENNRSFNVLISESGKRIFLLPQCYAEKQLLGKASQEFLDMRINPAIWELSGHLVLKRRKDYEEASEANICRFLVEAALSETEFQELNRCVLDFLAFFLGDQYQRA

SEQ ID NO: 6986 - protein, 439 aa, Zea mays
MEASGSRVRRGSPVPKRRRGVGVATGFGSTAQSLNDDILRSVFSRLDDHFDLARCSAVCGSWNRIIETAHLMRDMYYKRNPPARGSSSNISVKSYFEMLAMDEHASAFSRGPAEAFQWIGHPMRATLCRMKSGLILTGVGDKILRLWSAESCKFMNEYNVPNSKTLVDFDFDENKIVGLTSSQICIWRRSEPRSIFQSGGASFNHGLCMSFADPEVVIGCEDGRAFVYDMYSRSCSRIYRLHSSPVTCLMITDDQLIVGGSTFGNVAIADQTSGQKLGVLKSDHGPLAIRSLSSCTNSHMIFAGSSAGYAHCWDLRTLRPLWEKRVSPNVIYSTRHLPGDTATLAVGGIDGVLRVICQRTGDIIRSLVVDADLPAEATSRSRQQIEKKRVRRIDPDAQLDGIPRRLRPQITSLSVGMKKIVTTHGENYIRVWKFRMKSS

SEQ ID NO: 6987 - protein, 245 aa, Zea mays
  misc_feature (102)..(102): Xaa can be any naturally occurring amino acid
MTGFGSPCGACKFLRRKCVRGCVFAPYFCHEQGAAHFAAIHKVFGASNVSKLLAHLPLADRAEAAVTISYEAQARLRDPIYGCVAHIFALQHQVMTLQAQLXASLKAQAAQGQQGVHEDAKGYVGSAAAEQLGYGYPWCSGNGGAAAAAAGAVGAPAAQPGAYGNGAHESLTALLGSSDYMQQSLYHAFEQAGADDDDGRQGYAFEAAAESSSLGAEESGWRSSSGYQDCEDLQSVAYAYLNHRS

SEQ ID NO: 6988 - protein, 362 aa, Zea mays
  misc_feature (240)..(240): Xaa can be any naturally occurring amino acid
MRMRAVVITCAGGPEVLEAREVEDHPALGEGEVLLEVAAAGVNRADTVQRMGRYPPPAGASPYPGLECSGTILALGPNVPSRWAVGDKVCALLSGGGYADKVVAPAGQLLPIPEGVSLTHAAGLPEVACTVWSTVFMTSHLSPGESFLIHGGSSGIGTFAIQIAKHLGIKVFVTAGSEEKLAACKALGADVCINYRTEDFVERIKQETNGKGTTSMLSFLAASMYRALSSNSATSLTVIXNSLPGVDVILDNIGGSYLQRNLNSLGVDGRLFIIGFQGGIAAEVNLQAVLARRLTIQAAGLRNRSLANKAEIVSEVEKNVWPAVAAGKVKPVIYKTFPLCEAAEAHRLMEASTHIGKILLLP

SEQ ID NO: 6989 - protein, 274 aa, Zea mays
MAVHGGDYLRRFVAETEWYNEVVLNAVAPGDWWRGLPHPVQSWMRNCVGGYLLYFISGFLWCFVIYYWKRHAYIPKDAIPTNEAMKKQIAVASKAMPFYCALPTLSEYMIESGWTRCYFNISEMGFSAYLCYMAMYLIFVEFGIYWMHRELHDIKPLYKHLHATHHIYNKENTLSPFAGLAFHPLDGILQAIPHVLALFLFPTHFRTHIALVFLEGVWTTNIHDCIHGKVWPVMGAGYHTIHHTTYRHNYGHYTVWMDWMFGTLREPDDILKKA

SEQ ID NO: 6990 - protein, 238 aa, Zea mays
  misc_feature (155)..(155): Xaa can be any naturally occurring amino acid
  misc_feature (190)..(190): Xaa can be any naturally occurring amino acid
MDVEGEVPAAAAAAMANGLGGADEASPAPVSPEQLDVEAYAAQYSGRTRLARGVFVADRCGVEAIQLEALRMAYDEIKRGEDVQLDRDVAAKIGGRLGPRYGLDQAWVDTITRRADQRNEKLENELNGYRTNLIKESIRMGYNDIGDFFYAHGQXFKSYIRTRDYCTTSKHIVQMCMNVIQVSIELGQYXTHVSNYVSKAEQTPDSLDPIIVAKLKAAAGLANMETKKYKLAARKVSH

SEQ ID NO: 6991 - protein, 401 aa, Zea mays
MMGGFLSRVLLLAFGYAYPAYECYKTVELNKPEIAQLIFWCQYWILVALLTVLERFGDFTISWLPFYSEAKLMFFVLFFVYLWYPKTKGTTYVYGTFFKPYISQHENEIDRNLLELRARATDMVVLYFHKAASVGQNTFFDVLKYVAAQSPSRKSRLHPHQEPQQQQPQVQHENEIDRNLIELIAGATDMDVLYFHKDALVGQNTFFDVLKYVAAQCPSRKSRLHPHQEPQQQQPQVQVQVQQAQPQKQAAPVMRRAASIAARQAAMAQQSQETIPVSSSPKIKRQTSARSGSVASTKPPVAASALKPGGSPKKGEVKPAADPVQTPTTGADSPKPEPSAPSLPGAEGVDKMAIDEASGDAPEGAEELDPALEEETPMEETIRVTRAKLRRRTATEDPAGN

SEQ ID NO: 6992 - protein, 96 aa, Zea mays
DSQDTKGFRLFGSGVSSDVQTSYAARIMAISVLPFIIVQIPQIFRLHSGHRLTVLLGLIAAALLVLAYCLYQVFQPWVQRRRLEYAGLKHVMSGLY

SEQ ID NO: 6993 - protein, 62 aa, Zea mays
AETLKLNMALILLPVCRNTITWLRNTKAARALPFDDNINFHKGIVEDLAWRSACTGAVRRCR

SEQ ID NO: 6994 - protein, 475 aa, Zea mays
MSATQPWRSLFCCAAAGYDDADEPPPSSRGQRKGRSRRDRDRERLQLLLLPSSSSAASRVSLSSLGGSSGTLTPEDLSLTLSGSSLHAFTCAELRAATAGFSRANYLGCGGFGPVYRGRVAAGLRPGLDAQPVAVKYLDLDCGAQGHKEWLAEVFFLGQLRHKNLVKLIGYCYEAEHRMLVYEFMSFGSLENHLFKSTNGALPWMTRMKIAVGAAKGLAFLHDADPPVIYRDFKASNILLDSDYNTKLSDFGLAKDGPQGDATHVTTRVMGTNGYAAPEYIMTGHLTAKSDVYSFGVVLLELLTGRRSVDRSRRPREQSLVDWARPYLKKPDKLYRVMDPAMECQYSCQGAGRAAMVAYKCLSQNPKSRPTMREVVQALEPVLDMNDYLQIGSFVFTVVVEDSNDDDSQGKMVDVTIETTVEEKRQSHQDRHRQKFPNSLVNADVVLHRDGDLGKHIAALRRHRRTSSYVKERGA

SEQ ID NO: 6995 - protein, 482 aa, Zea mays
MATGGKSAAPQPPPAASSSSERALESVHFSSGNPRIEETRGVVVLHPDPPAAASWSHVPLGSKPRVCVLAVPNHMTYADFCRFCGAFVPHTLEMRIVRTDGAEDQYSVLINFDTQSSTDSFYKHFNGKQFSSLEGGVCHVRFVEEVHYTELIEHAHTSVTNLAEQPTCPVCLERLDQDPGGILTTICNHSFHCSCISKWTDSSCPVCRYCQQQPEKSMCSICGTSENLWICLICGHVGCGRYKGGHAIEHWKETQHCYSLELETQKVWDYAGDNYVHRLIQSKTDGKLVEYNFHGDHTAESTCSLCSGDAAMDEALLNSKFEAIVEEYNDLVTFQLEKQRNYYESLLLEVKEETEKEISAATEKAMSTKLQKLEVKFDKCMEEKKFLDEVNGNLVKNQEMWIETIRKAQAREQAALRLKDEKIEKLQEELRGLIAHFDCQSDTAQASNAISSDIPGGMILPVASESSSSGGVVGGTGNGEQN

SEQ ID NO: 6996 - protein, 726 aa, Zea mays
LQRENFAKCIGMADSNEFASEVFVALARRTHINPDDGVTKEQLKQFWEEMTDQNFDSRLRIFFDMCDKNGDGKLTEDEVKEVIVLSASANKLAKLKKHAATYASLIMEELDPDHRGYIEIWQLETLLRGMVTASAPPEKMNMASASLARTMVPSSHRSPLQRRINKAVDFVHENWKRIWVLSLWGVLCIALFVFKFIQYRRRAVFEVMGYCVCIAKGAAETLKLNMALILLPVCRNTLTRLRSTALSKVVPFDDNINFHKVIALAIAIGSATHTLAHVLCDFPRLVACPKDKFMEKLGPFFNYVQPTWPTLLASIPGWTGILLILIMSFSFTLATHSFRRSVVKLPSPLHHLAGFNAFWYAHHLLVIAYVLLVMHSYFIFLTKQWYKRTTWMYLAVPVVFYASERSIRKIREQSYRVSIIKAAIYPGNVLSLYMTKPPGFKYKSGMYMFVKCPDVSPFEWHPFSITSAPGDDYLSVHIRTLGDWTSELRNLFGKACEAEVTSKKATLARLETTVVAHGLAEDTRFPKVFIDGPYGAPAQNYRKYDILLLIGLGIGATPFISILKDLLNNIKSNEEMHDAELGCSLKTNGPGRAYFYWVTREQGSFEWFKGVMNDVAESDRDDVIEMHNYLTSVYEEGDARSALIAMVQSLQHAKNGVDIVSGSKIRTHFARPNWRKVFSDLANAHKNSRIGVFYCGSPTLTKTLRDLSIEFSSTTTTRFHFHKENF

SEQ ID NO: 6997 - protein, 173 aa, Zea mays
MSRYGRYGGETKVYVGNLGTGAGKGELERAFSYYGPLRTVWIARNPPGFAFVEFEDPRDAEDAVRGLDGKVICGSRVRVELSTGMPRRSRFDRPPARRPFDPNDRCYECGEKGHYAYDCHRYSRRRRSRSRSRSHSRSRGRRYSRSRSRSRGRRSRSASPRRSRSVSLRRSRS

SEQ ID NO: 6998 - protein, 217 aa, Zea mays
MALPSSSTPTASAPASLGERWPPLESTPAVFNQFVWSLGVPEDDVEFHDVYGLDADALDMVPQPVLAVVLCFPDPPQDASYPSEQLLISGEKETQDQVYFIKQIESLGNACGTIALLHAVGNASSKVNLVENSCLDLFFKSTATMDPYERAVCLEKDDTMARAHLLAANDGATELSDLIEEHYICFVYVNGTLYELDGMKDGPIKHGPCSSISLLQV

SEQ ID NO: 6999 - protein, 92 aa, Zea mays
  misc_feature (9)..(9): Xaa can be any naturally occurring amino acid
RGSIPYFAXGLMGVARIMPTSVALDVVAENLNLKFFEEPTGWKFFGNWMDAGMCSICDEESCATGSDHIRENDGMRAWLEWFSIVAFKNKDN

SEQ ID NO: 7000 - protein, 381 aa, Zea mays
  misc_feature (259)..(259): Xaa can be any naturally occurring amino acid
GALMHGNGDLGSEFYETLAKMAPTKEEELKLKGYNGDISKLDPAERFLKDVLDVPFAFKRVDVMLYRANFGAEVNYLKKSFGTLEAACTDLRSSKLFLKLLDAVLKTGNRMNDGTNRGEARAFKLDTLLKLADIKSTDGKTTVLHFVVQEIIRSEGLGSDQAAAAAANPGSTSKEQFKKDGLQVLAGLSSELSNVKSAAALEMDTLVGSVSRLETDLEKVKLVSRLRQTCPGHDQVSSEKFFEANDAFLGRVTRRSRQXEGGRGAALQRVKETTEYFHGDAVKEEPHPLRIFMVVRDFLATLDRVCRAVGRTPERVMMGSGKSFRVSAGTTSLPQRRNEQRRELAPLTRTAPRHRVTLLGNLFFFFLFLSLARRVVRDRGL

SEQ ID NO: 7001 - protein, 397 aa, Zea mays
MPISSTLATRLRTGHSSAPKPARRSPYTRPKPSGGAKASRPSPRLDPATTRPLEPSQKAVRSGLGRRAEPDVPDARAAESKPKLAHGDDRPPLEEKRRCSGEGGFVFLRALAGHTEAIGGISLPSGSNKLYSGSVDGSVRIWDCNSGKCVDVIKMGGKVSCMITHGPWVLIGIPKFVEAWNTKTGMKLRFQGPSSLVCSMAITDEMLFAGTGDGRIMAWRFPAKESNTEPVLILSGHQRPVISLSISARRLYSGSLDKTIKAWDLTTRQCVQTLSEHKAAVTSVLCWDEKLLSCSLDKTVKLWTLSESGNLQVKYTHAEENGLRTLFGMHRVGKTPVLLCSLHNSNRVRLLDLPSFDGIGTLLSTKEVRTIELAAGGLLFTGDCSGELKVWRWAPKD

SEQ ID NO: 7002 - protein, 318 aa, Zea mays
MQYQPIQNYCRCFLTVKKKKKKKKKKKKKKKKKAAKSNLEAPLSLSLSLFAVRSSAPQSNRHLAEMGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMEVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 7003 - protein, 168 aa, Zea mays
MGGGHEEQEGGGAKAGGYSSGLPPSEPPQEYGYGTFQGPRHPPVGFPQPAPPPGFGGGGGYHNQQQPYAHAETYYAQGYQAVPGYGPVAEGRPVRMRRLPCCGLGLGWCLFIAGFFLAAIPWYIGAFVLICVRVHDHREKPGYVACTIAAVVAAVAIFLGVTKGTHVW

SEQ ID NO: 7004 - protein, 215 aa, Zea mays
LVAAGIVIGVILHGGIHLACDFPRITRTDKAFFGRTIAADFGYHQPSYLEIVVSTEGTTGIAMVVLMFVAFLLASSPSRRNPGMLPPLVRQLAGFNAFWYSHHVFIAVYVLLIVHSMFLFLAKDVAEKTTWMYVAIPVVIYIGERMFRMVRSMVFDVKILNATVYPGMVLALKVTKPPGFRYQSGMYVFVQCPEVSKFEWRPWTFLPILIPDLLY

SEQ ID NO: 7005 - protein, 624 aa, Zea mays
MKFMKLGSKPDAFQSDGADVRYVVSDLATDVVVHVGEVKFYLHKFPLLSKSGKLQRLVLKAAEDETDEVRIDDLPGGAKSFEICAKFCYGMVVTLSPHNVVAARCAAQYLEMTEEMEKGNLIFKIEVFMNSSILRSWKDSIIVLQSTKALSPWSEELKVVGRCIDAIASKTSADPANVTWSYSHSNSKKGGACAEIVESAGKPSIAPKDWWVEDLCELDVDLYRRVMVAIKSKGRMSPELIGEALKAYAVRWLPDSYDALVAEGHMRRNQCLVETLIWLLPSDKSSGCSCRFLLKLLKVAILVGGGEHVKEELIRRISFQLHKATVKDLLLPATSPNDGTYDVRLVHNLVQRFVARTALSHNGGFIEKSDEKMIELNFEQESILSVGELVDGYLSEVASDQDLSLSMFVELATAVPEVARPVHDNLYYAVDAYLKEHPDINKSEKKKICSLVDVKKLSTDASMHATQNDRLPLRLVVQVLFFQQLRAGSGKELALVDNGEHACTRPTQDQCEPCERRIPKHPESLDKQVTSLSARESRQHHRTSDSEHRGGGRNSFKDQLGGLLPQSRSRRIFDKLWSSKGQGEHGGKGSETSGSSQSPPLSAKPAEVKPSPLPAVRNRRYSVS

SEQ ID NO: 7006 - protein, 92 aa, Zea mays
  misc_feature (28)..(28): Xaa can be any naturally occurring amino acid
STALTSRQVSMISIARIIGAGLFIGSSXPVATAGPAILISYTMTGLLVLLVMRMLGEMAIANPNSGSFSTYASEAIGPWAGFTIGWLYWWFW

SEQ ID NO: 7007 - protein, 718 aa, Zea mays
MLFETFVVATLLILLLVPVGRCADATAGSDDERFVYNGFKGANLTLDGASTVTPNGLLVLTNGTIQMKGHAFHPSPLPFRDRGAQNATAARSFSTTFAFAIFGPYIDLSSHGLAFFVSSDRAALSTALPGQFLGLLNSTDNGNGRTHVFAVELDTLFNADFLDRNSNHVGVDVDSLVSRAAADAGYYDDGTGQFRNLSLVSRKAMQVWVDYDSGSTQVTVTMAPLGLARPKKPLLQTTVDLSGVVQGTAAYVGFTSATGILFSRHFVLGWAFAFDGAAPALNISALPALPPAGPKPRPKVLEIVLPIATATLVFAVGVLVYALLRRRARYAELREDWETAFGPHRFSYKDLFHATGGFSDKRLLGAGGFGSVYRGVLRKSNTEVAVKKVSHESKQGMKEFIAEIASMGRLRHRNLVQLLGYCRRKGELLLVYDYMPNGSLDKHLYDRSKGARALGWPQRLHVIRGVASGLLYLHEDWEQVVVHRDVKASNVLLDGEMNGRLGDFGLARLYDHGTDAHTTHVVGTMGYLAPELGHTGKATPATDVFAFGAFLLEVTCGRRPVEQDEHNSHTVLVDWVAERWRRRLILDAADTMIPDGFNPDEYLDGDMVLPDLSPEYFGFTAVERMYSRECPLRWRGRSAALGRTVRDLGAGAVSSLRHTGRSAALGRTVRDLVTGSSSSSLLESRFRPLGEKILRPPKADLDDVESNRGGGGYAEGYN

SEQ ID NO: 7008 - protein, 707 aa, Zea mays
MLFETFVVATLLILLLVPVGRCADATAASDDERFVYNGFKGANLTLDGASTVTPNGLLVLTNGTIQMKGHAFHPSPLPFRDRGAQNATAARSFSTTFAFAIFGPYIDLSSHGLAFFVSSDRAALSTALPGQFLGLLNSTDNGNGRTHVFAVELDTPFNADFLDRNSNHVGVDVDSLVSRAAADAGYYDDGTGQFRNLSLVSRKAMQVWVDYDSGSTQVTVTMAPLGLARPKKPLLQTTVDLSGVVQGTAAYVGFTSATGILFSRHFVLGWAFAFDGAAPALNISALPALPPAGPKPRPKVLEIVLPIATATLVFAVGVLVYALLRRRARYAELREDWETAFGPHRFSYKDLFHATGGFSDKRLLGAGGFGSVYRGVLRKSNTEVAVKKVSHESKQGMKEFIAEIASMGRLRHRNLVQLLGYCRRKGELLLVYDYMPNGSLDKHLYDRSKGARALGWPQRLHVIRGVASGLLYLHEDWEQVVVHRDVKASNVLLDGEMNGRLGDFGLARLYDHGTDAHTTHVVGTMGYLAPELGHTGKATPATDVFAFGAFLLEVTCGRRPVEQDEHNSHTVLVDWVAERWRRRLILDAADTMIPDGFNPDEVCLALKLGLLCSHPLPNARPTMRQVMQYLDGDMVLPDLSPEYFGFTAVERMYSREVNGSGGLRQVAGSPGSALCDGADGPRPWAGRSATWAQERCLPCVTPDGPQL

SEQ ID NO: 7009 - protein, 247 aa, Zea mays
MANTAKGKVCVTGASGFIASWLVKRLLESGYHVLGTVRDPGNGKKVGHLWGLEGAKERLQLVRADLLEEGSFDDAVMACEGVFHTASPVEEMLDSAINGTMNVLRSCKKNPSLKRVVLTSSSSTVRIKDEADLPPNVLLDESSWSSIEFCESLQIWYAVAKILAEKAAWEFAGEHRIDLVTVLPTFVVGPTLSPELGPTASDVLGLFQGETGKFTTYGRMGYVHIDDVARCHMLAYQAAGARGRYIC

SEQ ID NO: 7010 - protein, 513 aa, Zea mays
  misc_feature (141)..(141): Xaa can be any naturally occurring amino acid
  misc_feature (160)..(160): Xaa can be any naturally occurring amino acid
  misc_feature (193)..(193): Xaa can be any naturally occurring amino acid
  misc_feature (345)..(345): Xaa can be any naturally occurring amino acid
  misc_feature (400)..(400): Xaa can be any naturally occurring amino acid
  misc_feature (406)..(406): Xaa can be any naturally occurring amino acid
MMIARRLLRPNAPAQASSLLKHVMTGTASLQGYADSLLDATVRHFGSAPSAQPEENGFKGHGMLAPFTAGWQSNDLHPLIIERSEGSYVYDINGNKYLDSLAGLWCTALGGSEPRLVKAATEQLNKLPFYHSFWNRTTKPXLDLAQEILSMFTAREMGKXVFFTNSGSEANDSQVKLVWYYNNALGRPNKKKXLARSKAYHGIYHWFQRGLTGLPALHQKFDLPAPFVLHTDCPHYWRYHLPGETEEDFATRLATNLENLILKEGPETIAAFIAEPVMGAGGVIPPPKTYFDKVQAIVKKYDILFIADEVITAFGRLGTMFGCDYYNIKPDLVSLAKALSNAYVXPIGATLVSPEISDVIHSQSNKLGSFAHGFTYSGHPVACAVAIEALKLYRERDIPXHVKQIXPKFQDGIRALADSPIIGEIRGLGMIMGTEFTNNKSPTDLFPAEWGVGAIFGEECQKRGMLVRVAGDAIMMSPTLIMTPGEVDELVRIYGEALKATEERVAALQSKKN

SEQ ID NO: 7011 - protein, 178 aa, Zea mays
GKFPVEAVAIMAKIAERIEQEDINPSQAEASRTSIPNAISSAVSQIAETLNAAAIMSLTKTGSTARHVSKFRPKTPILAVTPHVDVSRQLQLVWGVKPLLVLDLPSTSQTFQAAINVAQENHFLRDGDLVVMTAGTLQGVAGSTDLIKVEVVKAILGRGVGIGQGAVSGRARVASRPQ

SEQ ID NO: 7012 - protein, 568 aa, Zea mays
MATAAHSLLHTPEAHRAATRSPFSPPAPTPFLHLRPHRLPLRLRSTSPTASDLTAFPPNPNGIFASDRPIDVDAATEAELRENGFRSTRRTKLVCTVGPATSRPDQLEALAVGGMNVARLNMCHGDREWHRAAIRAVRSLNEEKGFAVAVMMDTEGSEIHMGDLGGASSVKAEDGEVWTFSVRSFELPLPERTINVNYDGFAEDVRVGDELLVDGGMARFEVIEKIGPDVKCRCTDPGLLLPRANLTFWRDGSIVRERNAMLPTISSKDWLDIDFGIAEGVDFIAVSFVKSAEVIRHLKSYIAARSRGSDMAVIAKIESIDSLKNLEEIIRASDGAMVARGDMGAQVPLEQVPSIQQKIVQLCRQLNKPVIVASQLLESMIEYPTPTRAEVADVSEAVRQRADALMLSGESAMGRYPDKALSVLRSVSLRIEKWWREEKRHEALELRSVSSSFSDKISEEICNSAAKMANGLGVDAVFVFTKTGHMASLLSRCRPDCPVFAFTTSTSVRRRLNLQWGLIPFRLAFSDDMESNLNRTFSLLKARGMIQSGDLVIALSDMLQSIQVMNVP

SEQ ID NO: 7013 - protein, 311 aa, Zea mays
  misc_feature (155)..(155): Xaa can be any naturally occurring amino acid
PCRVDADADGRMSEEKVRQTITQRASENKLSKITKQAEEYARLIMEELDPDKLGYIEVRNLERLLEDPSQSVSIGTGKDMSQMLRSQSLRPTPEPNPLRRTQYFLEDNWRRVWVVLLWLSICVGLFAWKFAQYRRRYVFQVMGYCVCVAKGGAEXKFNMALILLPVCRNTITWIRNHTAVGRVVPFDDNISFHMVVAAGIAVGAGLHVVSHLTCDFPRLLHATDAEYAPLGQYFGVPRPPNYWWFVRGTEGWTGLAMLVLMAVAFTLAMPWFRRGELALPGPLKRLTDTLKLTDPLKRLTDTLKRLTAGMQ

SEQ ID NO: 7014 - protein, 607 aa, Zea mays
MGNSLACFCCGGGAAGRRRHVAPAALPSDPAYDEGLGHSFCYVRPDKVLVPFSAAAAAEEPTTFRAISGAALSANVSTQLSTSVLLLLPDESSSAAAASSSSSGFESSESFAAVPLQPVPRFPSGPICAHGGGFLSGPIERGFLSGPLDAALMSGPLPCAATSARMGGGAVPALRRSLSHGGRRLRNFTRALLARADKFQDSMDLGSAAAAACGAGSAGLQWAQGKAGEDRVHIVVSEERGWVFVGIYDGFNGPDATDFLVSHLYAAVHRELRGLLWDQMSTTASYHQDQPANGRRARRSRPPRGADDDQRRWKCEWERDCSSLKPPTQRPPRSSSENDHLAVLKALARALRKTEEAYLDVADKMVGEFPELALMGSCVLAMLMKGEDMYLMNVGDSRAVLGTMDSVDLEEISGGSFDGLVGDGTPLLSALQLTSEHSTSVREEVCRIRNEHPGDPSAISKDRVKGSLKVTRAFGAGFLKQPKWNDALLEVFRIDYVGSSPYITCNPSLYHHRLSTRDRFLILSSDGLYQYFTNEEAVAQVEMFIATTPEGDPAQHLVEEVLFRAANKAGMDFHELIEIPHGDRRRYHDDVSVIVISLEGRIWRSCV

SEQ ID NO: 7015 - protein, 660 aa, Zea mays
MGPASTTTLRTGPRALSAPLQPARSRPAMGNSLACFCCGGGAAGRRRHVAPAALPSDPAYDEGLGHSFCYVRPDKVLVPFSADDDDLVADAKAAAAAEEPTTFRAISGAALSANVSTQLSTSVLLLLPDESSSAAAASSSSSGFESSESFAAVPLQPVPRFPSGPICAHGGGFLSGPIERGFLSGPLDAALMSGPLPCAATSARMGGGAVPALRRSLSHGGRRLRNFTRALLARADKFQDSMDLGSAAAAACGAGSAGLQWAQGKAGEDRVHIVVSEERGWVFVGIYDGFNGPDATDFLVSHLYAAVHRELRGLLWDQCEQEEQRDTDPDQPMSTTASYHQDQPANGRRARRSRPPRGADDDQRRWKCEWERDCSSLKPPTQRPPRSSSENDHLAVLKALARALRKTEEAYLDVADKMVGEFPELALMGSCVLAMLMKGEDMYLMNVGDSRAVLGTMDSVDLEEISGGSFDGLVGDGTPLLSALELTSEHSTSVREEVCRIRNEHPGDPSAISKDRVKGSLKVTRAFGAGFLKQPKWNDALLEVFRIDYVGSSPYITCNPSLYHHRLSTRDRFLILSSDGLYQYFTNEEAVAQVEMFIATTPEGDPAQHLVEEVLFRAANKAGMDFHELIEIPHGDRRRYHDDVSVIVISLEGRIWRSCV

SEQ ID NO: 7016 - protein, 473 aa, Zea mays
  misc_feature (450)..(450): Xaa can be any naturally occurring amino acid
MEAADHGKLFVGGISWETSEDRLREYFGRFGEVTEAVIMRDRSTGRARGFGFVVFADAAVAERVTTEKHMIDGRMVEAKKAVPRDDHSIVTKSNASSIGSPGPGRTRKIFVGGLPSNVTEADFRRYFEQFGVITDVVVMYDHNTQRPRGFGFITFDSEDAVDKALHKSFHELNGKMVEVKRAVPKEQSPGPAARSPVGVGQNYAMNRVHSFLNGFNQGYNPNPIGGYGIRVDGRYGLISGARNGFSSFGPGYGMGMNVEGGLGGTFGASSGFISNSNGRQMGSYFNASSNRLGSPIGYLGLNDVPGSMLSSMSRNVWGNGSLNYPSNPTNMSAFASPRNGGQVSLPSDNWGGLPSAHGMDNISSLGSGNLGRGTGDNNFGLPSGSYGRNNSTGTIGEPFSAAGNTYEVNNRDTYGSSSIYGGTAWRFASSEVDMPSFVHDIGNVDPTIKXYMSASHMGNYPVNNNQPSRGISS

SEQ ID NO: 7017 - protein, 691 aa, Zea mays
  misc_feature (396)..(396): Xaa can be any naturally occurring amino acid
  misc_feature (516)..(516): Xaa can be any naturally occurring amino acid
MAIVLLALLLFPSAYAQPWSVCGNTGNYTAASTYQDNLSQLAASLPKKASSNTSPLFATGTAGAVPDLVYALALCRGDINASACKDCVTIGFEDAQQLCAFNKEATVYYDSCLVSFSNEDFLSTTVNGNENEVTVLMDAQNFTESADYIRLLLFTLLNDTSESAINSIRRFTTARMDISSLPTIYCAVQCTPDLTADECAACLQDFPQVTLQYLDGQRGGRLLGVRCNMRYEIYKFYQGDPMLRIISLASAVPTIGKTPPGTPVTVYPQPPPAAPPAPQMITTPIAAQEETGRKGKLWIIGIAIPLVAILLCSTFTFLWLRRPKKGVLSSQDRAGANRIEENALVWTIEQKSSEFTLFDLSELLEATKSFAEENRLGQGGFGPVYKGQLSDGQDSXIAVKRLASHSGQGFTEFRNEVELIAKLQHTNLVRLLGCCIQAEEKILVYEYLPNKSLDFFIFDERQSSLLNWYKRRAIIEGVAQGLLYLHKHSRLRVVHRDLKASNILLDQDMDPKISDXFGLARICSSNDAEGNTKRVVGTYGYMSPEYASEGIYSVKSDVFSFGVLLLEILSAKRNSGFHQYGDFLNLLGYTWHLWEIGRWLDLVEASISKEMHEAEARRYINIALMCVQENADDRPTMSDVVAALNSESVVLPEPKHPAYFNLRVSKSVESAVVVEACSLNEMTITQDPQGR

SEQ ID NO: 7018 - protein, 63 aa, Zea mays
PAAAACFAAWTADGKYLLSGGEDDLVQVWSMDDRKIVAWGEGHNSWVTLSLQLSLLLSHSIFN

SEQ ID NO: 7019 - protein, 231 aa, Zea mays
  misc_feature (58)..(58): Xaa can be any naturally occurring amino acid
MEVPMNSTQSGPHFPVQHQSLSLDIKGNKTDIVISKYEDTFLLIVAQIGCMGTILAAXESVFSDPTYNVSVLFGKRNEPLLQACARQLIEHISGSGSARSCEISHPPPVLLPSSSSQRRRSLSRSLPYSRSAHRRRRSGSQRRRQRLTLAPSPPVLRTPAGDPACVPISLIPPPVDRQRHRPRQLRRARPDGCGSQQPLLHQGVRAALVALMPQSEALPVLLALQRAEACA

SEQ ID NO: 7020 - protein, 97 aa, Zea mays
  misc_feature (72)..(72): Xaa can be any naturally occurring amino acid
FVDVLGLEEESLGSVPAPACALLQLFPLTAQHENFRKKQIEELKGQEVSPKVYFMKQTIGNSCGTIGLIHAXANNQDKLGFEDGSVLKQFLSETEKM

SEQ ID NO: 7021 - protein, 346 aa, Zea mays
MPTAEATTPVPPELSSGQGRTVCVTGAGGFIASWLVKRLLEKGYTVRGTVRNPVDPKNDHLRALDGAVDRLVLLRADLLDPQSLAEAFSGCDGVFHAASPVTDDPEMMIEPAIRGTRYVMAAAADAGVKRVVFTSSIGTVYMNPYRDPSKPVDDTCWSDLEYCKNTQNWYCYAKTVAEQGAWEVARKRGLDLVVVNPVLVLGPLLQPTVNASTDHVMKYLTGSATTYVNAAQAYVHVRDVAEAHVRVYEAPHAHGRYICAESTLHRGDLCRVLAKLFPEYPVPTKCKDQVNPPVVGYKFTNQRLKDLGMDFVPVLQCLYETVTSLQEKGMLPVLPTKQDHDQLGKS

SEQ ID NO: 7022 - protein, 554 aa, Zea mays
MGNACGGALRSKHQHSFKHAASSQRHHASSEYSASAAADDSPRKPPPPPATTDAHAPPPPPATAMRRGGAGAPPDLGSVLGHPTPNLRDLYALGRKLGQGQFGTTFLCTELATGVDYACKSISKRKLITREDVDDVRREIQIMHHLSGHTNVVAIKGAYEDQLYVHIVMELCAGGELFDRIIQRGHYSERKAAELTRIIVGVVEACHSLGVMHRDLKPENFLLVNKDDDLSLKAIDFGLSVFFKPGQVFTDVVGSPYYVAPEVLLKNYGPAADVWTAGVILYILLSGVPPFWAETQQGIFDAVLKGVIDFDSDPWPVISDSAKDLIRRMLNPRSAERLTAHEVLCHPWIRDHGVAPDRPLDPAVLSRIKQFSAMNKLKKMALRVIAESLSEEEIAGLKEMFQTMDTDNSGAITYDELKEGLRKYGSTLKDTEIRDLMDAADIDNNGTIDYIEFIAATLHLNKLEREEHLVAAFSYFDKDGSGYITVDELQQACKEHNMPDAFLDDVINEADQDNDGRIDYGEFVAMMTKGNMGVGRRTMRNSLNISMRDAPGAF

SEQ ID NO: 7023 - protein, 618 aa, Zea mays
MGPLLRAAALSVALLALAAVGEAHSATEFLNIFKPRNEHDYFHNANQEEDVMPRASDQQNLITAPVTKSGLMKVPPRSAPTAVAQDTVVLPVDNAAGFPGAWSIISENAGVSAMHLVIMRSDKAIMFDTVTTGPSLLRLPKGNCRLDLRSKQVGAKDCAAHAVEFDYATGGVRALKVLTDVWCSSGALDAEGNLVQTGGYFEGEKVVRYLSPCGNCDWREFPGSLAEGRWYGTQQLLPDGRSIVLGGRRAFSYEFVPAEGQSNAQAIPLQILRDTTDDVENNLYPFVHLLPDGTLFIFANDRSILFDPRNGQVVREFPVLPGGGRNYPASGMSALLPLDLRRGDVLSPEVIVCGGSPKNAFTLGESNTFPPALKDCARINPLKPDARWALDQMPVARTMGDLLILPTGDLLILNGAAKGCSGWGFGRQPVLSPLLYSPRQARGSRFRALAPTTIPRMYHATSAVLPDATVLVAGSNTNSAYNFSGVDFQTEVRVERFTPPYLAPERAANRPAIDVATVPGDGMAYGAKFTFQFSTPVQAVAEPDLKVTMYAPPFTTHGYSMNQRLLVLSVTAFAANGQRYTITVDAPGKPELAPPGYYLLYVIAKGVPSKAAWVKVHK

SEQ ID NO: 7024 - protein, 485 aa, Zea mays
MASEKVETIVAGNYMEMEHEPGGGGDHDQQPSGGAASSTSSSSRGGGKKKALSSLFWHGGSVYDAWFSCASNQVAQVLLTLPYSFSQLGMASGVVFQLFYGLMGSWTAYLISILYVEYRTRKEREKVDFRNHVIQWFEVLDGLLGKHWRNVGLFFNCTFLLFGSVIQLIACASNIYYINDKYDKRTWTYIFGACCATTVFIPSFHNYRIWSFLGLLMTTYTAWYLTIAAIAHGQVEGVTHSGPSKMVLYFTGATNILYTFGGHAVTVEIMHAMWKPHKFKLIYLVATLYVLTLTLPSASAVYWAFGDMLLDHSNAFALLPRSGFRDAAVIFMLIHQFITFGFACTPLYFVWEKLIGVHETGSVALRAAARLPIVAPIWFLAVVFPFFGPINSTVGSLLVSFTVYIIPALAHMATFLPPAARENAVERPPRGLGGWAGMYAANFFVVAWVLVVGFGFGGWASTVNFVRQVNTFGLFTRCYQCPPRH

SEQ ID NO: 7025 - protein, 525 aa, Zea mays
  misc_feature (197)..(197): Xaa can be any naturally occurring amino acid
  misc_feature (204)..(204): Xaa can be any naturally occurring amino acid
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYITVRFLIGFSLATFVSCQYWMSTMFSSKIIGTVNGLAAGWGNMGXRRHAAHXMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCAQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 7026 - protein, 193 aa, Zea mays
  misc_feature (152)..(152): Xaa can be any naturally occurring amino acid
QSCVILGGTKVDRAAAGPRAPTGADAEDSGDGGGGGGGSIPESFYTNGGLKLRVVWTISSLIAAATRHYLLREIVKEHPTLEQVALTDANGQGTLSMGREQLKEFRDKPLAAAAAAANRTQVPACNMKLRYAPLLELSDGTRIHGATLVVIXPGGGGRKGLDEFAANAFDGPLREAVAALSKRRTYLLEMNGF

SEQ ID NO: 7027 - protein, 202 aa, Zea mays
QSCVILGGTKVDRAAAGPRAPTGADAEDSGDGGGGGGGSIPESFYTNGGLKLRVVWTISSLIAAATRHYLLREIVKEHPTLEQVALTDANGQGTLSMGREQLKEFRDKPLAAAAAAANRTQVPACNMKLRYAPLLELSDGTRIHGATLVVIRPVGEATAGTGGGGGRKGLDEFAANAFDGPLREAVAALSKRRTYLLEMNGF

SEQ ID NO: 7028 - protein, 199 aa, Zea mays
MALTRIGLAGLAVMGQNLALNIAEKGFPISVYNRTTSKVDETVQRAKVEGNLPVFGFHDPASFVSSIQKPRVVIMLVKAGAPVDQTIATLAAHLDQGDCIVDGGNEWYENTERREKAMEERGLLYLGMGVSGGEEGARNGPSLMPGGSFEAYKYIEDILLKVAAQVPDSGPCVTYIGKGGSGNFVKMVPNGIENGDMQL

SEQ ID NO: 7029 - protein, 245 aa, Zea mays
SVGFVETLENDLLELRGKGIDAQIASGGGRMYVTMDRYENDWDVVKRGWDAQVLGEAPYKFKSALEAVKTLRAQPNANDQYLPPFVIVDDSGKAVGPVLDGDAVVTINFRADRMYDGELKLPSRYLVSPPEIDRTSGEYLVKNGIRTFACRQGHLASGKIIETVKFGHVTFFWNGNRSGYFDETKEEYVEVPSDSGITFNVAPKMKALQIAEKARDALLSGKFDQVRVNLPNGDMVGHTGDIGAR

SEQ ID NO: 7030 - protein, 304 aa, Zea mays
  misc_feature (261)..(261): Xaa can be any naturally occurring amino acid
  misc_feature (291)..(291): Xaa can be any naturally occurring amino acid
MSGGTPAASSSLRAALSYCVRQVRAYDYHHYLCLLHLAPAVRKAAFTFRAFNIQTARAMDVVSDPRTGLMRLLWWKEAVDKVFGNKLVEHLVAHALSSVIADHKVSKHWLKRSVEARINDTNREEGTIPGTSAELERYAEDTQSTILYMTLQAGGIQSTVADHAASHIGKASGLLLLLKALPHHVNKQGTVHYIPASVAEECGLLITREGGRSEVRAGVRLPDVVFKVTSVAEAHLHKARELASSVPKEAIPVLLPALPAXVLLDTLRRCEFNVFDPRLSRGVHEVSPLWXQLKLNWNAWRSRY

SEQ ID NO: 7031 - protein, 323 aa, Zea mays
MSGGTPAASSSLRTSLSYYVRQVRAYDYHHYLCLLHLAPAVRKAAFTFRTFNIETARAMDVVFDPRAGLMRLLWWKEGVDKIFGNKLVEHPVGQALSSIIADHKVSKHWLKRSVEARINDANREEGTIPGTSAELERYAEDTQSTILYMTLQAGGIQSTVADHAASHIGKASGLLLDVGEGKEINLERCPRLKLLSQCIKYLGPKEREEYEVVIEDGKFMFKKSRQILDTSDGPRDSKWIFVLSTSKNLYVGQKKKGTFQHSSFLAGGATSAAGRLVVEDGILKAIWPHSGHYRPTEENFQEFQSFLKDNNVDLTDVKVRTLR

SEQ ID NO: 7032 - protein, 162 aa, Zea mays
MASAHEQARGDAAGGATSSVVADASELRQRGSKGHKKPGTDAEDGDKESGRGAGAAGGCEVTVTDSIERVFEAEPVPPWPQQVTPRALVTSLFLAVLFSVIVMKLSLTTGIIPSLNVSAGLLGFFLLRVWTAAVKDPRRPFTRQENTVVQTCVVAAYGIAFS

SEQ ID NO: 7033 - protein, 267 aa, Zea mays
  misc_feature (234)..(234): Xaa can be any naturally occurring amino acid
  misc_feature (241)..(241): Xaa can be any naturally occurring amino acid
  misc_feature (243)..(243): Xaa can be any naturally occurring amino acid
  misc_feature (256)..(256): Xaa can be any naturally occurring amino acid
MGALGDRLRAFSTNRWLVFVAAMWLQSMAGIGYLFGAISPVIKAALGYNQRQVAALGVAKDLGDCVGFLAGSLSAVLPSWAMLLIGSAQNFLGYGWLWLIVTRQAPALPLWMMCVLIYVGTNGETFFNTTALVTCIQNFPKSRGQTVGIMKGFAGLSSAILTQLYAVMHTPDHATLVFMVAVGPSLVALGLMFIIRPVGGHRQVRPSDKNSFLFIYTICLLLASYLVGVMLVQXFHALSDXVXGILTVLLLILSGXPIMIPVTLNYH

SEQ ID NO: 7034 - protein, 397 aa, Zea mays
MDDAGRPPPHAPVAVTASASASATAAPAPPQPSATAAVDRSSPDPDALYEEGMWQQMAMDSGATMQPGSYPERPGEPDCTYYLRTGLCRFGMSCRFNHPPDRNLAIASARMKGEYPERAGQPECQYYLKTGTCKFGPTCKFHHPREKAGIAGRVQLNTSGYPLRPNEKECAYYLKTGHCKYANTCKFHHPELFNVVPSSRGSPIYTSVHSSASAGPQSYTGTMPSWAFPRASFIPSPRWQSPSNYAPMIVPQGLVQVPSWNSYPGQLQSPGAQQTYGSSQQGEASAGNQGMLSPYRSSSFPVPQYALQRENVFPERPDEPECQYYMKTGDCKFGAVCKFHHPRVRSLPPPDCVLSPMGLPLRPGEELCKFYSRYGICKFGANCKFDHPTVVAPMVYA

SEQ ID NO: 7035 - protein, 319 aa, Zea mays
MSCRFNHPPDRNLAIASARMKGEYPERAGQPECQYYLKTGTCKFGPTCKFHHPREKAGIAGRVQLNTSGYPLRPNEKECAYYLKTGHCKYANTCKFHHPELFNVVPSSRGSPIYTSVHSSASAGPQSYTGTMPSWAFPRASFIPSPRWQSPSNYAPMIVPQGLVQMQSWNSYTGQLQSPGAQQTYGSSQQGEASTGNQGMLSPYRPSSFPVPQYALQRENVFPERPDEPECQYYMKTGDCKFGAVCKFHHPRGEELCKFYSRYGICKFGANCKFDHPTVVAPMVYAYGFSASASPASASTNVPMARRLLGSPPGSGYTS

SEQ ID NO: 7036 - protein, 322 aa, Zea mays
RMKGEYPERVGQPECQYYLKTGTCKFGPTCKFHHPREKAGIAGRVQLNTLGYPLRPNEKECAYYLKTGHCKYANTCKFHHPELFNAVPSSRGSPIYTSVHSSASAGPQSYTGTMPSWTFPRASFIPSPRWQSPSNYAPMIVPQGLVQVPSWNSYPGQLQSPGAQQTYGSSQQGEASAGNQGMLSPYRSSSFPVPQYALQRDNVFPERPDEPECQYYMKTGDCKFGAVCKFHHPRVRSQPPPDCVLSPMGLPIRPGEELCKFYSRYGICKFGANCKFDHPTMAAPMGVYAYGFSGSASVAPASTNAPMTRRLLGSPSGSGYMS

SEQ ID NO: 7037 - protein, 1077 aa, Zea mays
  misc_feature (514)..(514): Xaa can be any naturally occurring amino acid
  misc_feature (592)..(592): Xaa can be any naturally occurring amino acid
  misc_feature (814)..(814): Xaa can be any naturally occurring amino acid
METSISPPGTSKQSAVRKPSPGGSLKDLCLVSKQGSIAEVESALALLKKSGGNIDGRNAFGLSALHLATWRNHLPIVRRLLDAGADPDARDGESGWSSLHRALHFGHLCIAGVLLQFGASLALEDTKGRTPVDLISCPVSQANGDFPDAVATEVFSWGSGTNYQLGTGNAHIQKLPCKVEALHGSYIKTVAASKFHSVAVSSNGELYTWGFGRGGRLGHPDIHSGQTTAVITPRQVTVGLGRKRVNAVAAAKHHTVIATELGELFTWGSNREGQLGYPSVDTQPTPRRVGSLKQRIISVAAANKHSAAVADTGEVFTWGCNKEGQLGYGTSNSASNCIPRMVEYLKGKVLRGVSAAKYHTIVLGADGEVFTWGHRLVTPRRVVVARCLKKGGNTNLKFHRMERLQVISVAAGTTHNTALTADGALFYWVSSDPDLKCQQIFSMCGRNIVNISAGKYWTAVATSTGDVFMWDAKKRKDETPIFTRVHGVKRATFVCVGETHMLVLSSIYHPEEPXKGQRAQPVVQAGDRRPVLHPLHPDRGAGYEGLQALLQQREDRQAAGLVALEAAAGRPWRRVTDGTHTPPLGSLIPWKXLAEQASGGFVLFPLGSQCHTRSFFMTSSEILVNLEKLLDEKSSEPWSQHRLPTMTATYPAVIDSDVEEDEAREFPKTRKCGKSASRPSAMSSDDSFLQKDCTAEQAVSKQIRALRKKLQQIEILEAKQLAGHQLDSQQVAKLESRAALEGELAELGIPSEIYSTSSACPAEGRTNRKPEVSKKQKRKNKQSTQTPSVKNEPGQQIPITELQVLQVNVSAEKXEAYAADPIKPMEAAAFSNTKDTASPPEKKPSQPTPSKKKNRKGGLSLFLSGALDDTPKPSLPAPAVPATPKPEGPAWGGVKITKGPASLRDIQTEQSRTNEPASAKAKDRHENSPDSAGRATRLSSFIPDARSSPVAVVAPARAAAAPPSSEGDRSTPPWSSSATSPNVSQPSLRDIQQMQQKRHHGGVSHSPKTQTSGFCIPPHGGAPEAAGGGGVKDNVPNRWFRPETDAPSSIRSIQIEEQAMKDFRRFYSSVRIVKPQV

SEQ ID NO: 7038 - protein, 361 aa, Zea mays
MPAAKHHTVIATELGELFTWGSNREQNHLNDAEGQLGYPSVDTQPTPRRVGSLKQRIISVAAANKHSAAVADTGEVFTWGCNKEGQLGYGTSNSASNCIPRMVEYLKGKVLRGVSAAKYHTIVFTWGHRLVTPRRVVVARCLKKGGNTNLKFHRMERLQVISVAAGTTHNTALTADGALFYWVSSDPDLKCQQIFSMCGRNIVNISAGKYWTAVATSTGDVFMWDAKKRKDETPIFTRVHGVKRATFVCVGETHMLVLSSIYHPEYPPKPKSQGLKSMLEWNGGTEELGEDILFDDVQPNSGLSGSSGEMSKGVPSLKSLCEKVAVEYLLEPKNAIQLLEIADSLEAKELKKHCEVMGINL

SEQ ID NO: 7039 - protein, 219 aa, Zea mays
MSAGELRLELDELRRLESLAKHPRVQILLANEIRNVEAKLAKATEPSPEPLAAASAPAPAPAARPVLSYATLGSFSWEQDNEKIRIYVPLEGVEQGKVEATFKPTSVDVKFHDVKGKNYRCAIPKLNKETVPEKCKVVVKPTRVVVTLFKASKGNWLDLHFKEDKFKPSMDKEKDPMSGIMDLMKNMYEDGDEDMKRTIAKAWSDARSGKTTDSLSGLR

SEQ ID NO: 7040 - protein, 295 aa, Zea mays
  misc_feature (199)..(199): Xaa can be any naturally occurring amino acid
  misc_feature (220)..(220): Xaa can be any naturally occurring amino acid
  misc_feature (233)..(233): Xaa can be any naturally occurring amino acid
  misc_feature (246)..(246): Xaa can be any naturally occurring amino acid
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLXKSIIKKKYGQDATKRWGNERXGFAPNIQENKEGXLELLKAAIEKAGXYTGKVVIGMDVAASEFFGEKDKTYDLNFKEENNDGSNKISGDSLKDLYK

SEQ ID NO: 7041 - protein, 274 aa, Zea mays
  misc_feature (104)..(104): Xaa can be any naturally occurring amino acid
MDLASSDLAALGAAELVRVSASIPRAAPRTFALLTACLVFPLTFAVLAHSLFTHPILLRIQRATHSELAQWLRLFAYQFLYLIVLFTVASLYANKPASISSSLXALPPILPRLLRTFLWVSLLMLAYHLVFALTVLLLIVVFIPNASESESAPPSLAFVLFLVVVVFVFLGIHVYISALWHLASVISVLEPLCGLAHMAGGPTVWSIADPAPLPRLPSRPWSRSLLLTKQASPQSGSSTNMTPARCHSPKMYTWIPRKTKAPARRKRTKARHGG

SEQ ID NO: 7042 - protein, 116 aa, Zea mays
  misc_feature (25)..(25): Xaa can be any naturally occurring amino acid
  misc_feature (62)..(62): Xaa can be any naturally occurring amino acid
GGFGSYLFGMSQGIAKQAAEANDAXNIKDPQLEWMIGFMFLVSFVGLFVLVPLRKVMIVDYXKLTYPSGTTTTYLINGFHTLQGAERAKKQVRTLGKYFSLSFLWAFFQWFYTGGS

SEQ ID NO: 7043 - protein, 127 aa, Zea mays
FRPNLCVRISRETVTAMAAAGGVSTDDVPILQAENLTSNVKSVYYSRTFLSIIGGVVAGIWGFTGLMGFVFYFLIMMVASIGLLAKSKFSVQAYFDSWTRISIEGVFGGPMSFVLFWTFAYDIVHIF

SEQ ID NO: 7044 - protein, 523 aa, Zea mays
  misc_feature (147)..(147): Xaa can be any naturally occurring amino acid
  misc_feature (235)..(235): Xaa can be any naturally occurring amino acid
  misc_feature (243)..(243): Xaa can be any naturally occurring amino acid
  misc_feature (255)..(255): Xaa can be any naturally occurring amino acid
AISLQESSVQIHSLHSWAHPRAIREAKRAAGTGSPWEFSSSSGYHATRKTTSIVKSVLDPKTKTNLGTSSAHYWPPSHLFYLQNLKGADSNSTALSSGGGGWAPFNAAEDGTALLGEIDLAFLGAYAAGMFFAGHLGDRVDLRVLLXVGMVGTGLFTAAFGPGYWLDVHSFYYFLAVQMVAGLFQSSGWPSVVAVVGNWFGKSKRGLIMGVWNAHTSVGNISGSLVAAAMLRYGXWCWSFVVXPGVVIALVGLAXFLLSPVAPDVIGVQEDLCLKDAPLLERRRADVPRVAVGFIEAWRIPGVAPFALCLFFCKLVAYTFLYWLPFYISHTAIGGEYLSDSAAGVLSTLFDVGGVVGGILAGHISDHLDARALTAASFTFSAIPALFFYRVYGNVSLAWNIALMFVTGMLVNGPYALITTAVSADLGTHSSLNGNSRALATVTAIIDGTGSIGAAVGPLLTGYISARSWSAVFTMLMASALVAGLLLSRLVAAEVVAKMESRRTPAPAASDLLPVSSSSMDEP

SEQ ID NO: 7045 - protein, 171 aa, Zea mays
WDPRGRPGTGTGGEDLFSFFLSASTLRLASAASPASAVPLHPPRFRPNLCVRISRETVTAMAAAGGVSTDDVPILQAENLTSNVKSVYYSRTFLSIIGGVVAGIWGFTGLMGFVFYFLIMMVASIGLLAKSKFSVQAYFDSWTRISIEGVFGGLMSFVLFWTFAYDIVHIF

SEQ ID NO: 7046 - protein, 539 aa, Zea mays
  misc_feature (173)..(173): Xaa can be any naturally occurring amino acid
  misc_feature (401)..(401): Xaa can be any naturally occurring amino acid
MEPFFLFVGLALVLCFLTLYYRHLQSKKTSPLEPTEWPIVGHLPGLVANIHHFHDWATGVLAGAGYNFEARAGRTGVRYFITCDPSNVRHIFTSNFANYPKGEEYAAIFDVLGGGIFNADGESWRRQRVKAQMLMTGPRFRAFTARCSRDKVERSLLPFLAHHAADDGRTPPXDLHDVFLRLTFDMTCTLVFGVDPGCLAFGLPGVPFARAMDDALETLFLRHITPTACWKLMSVLGVGQEKKMAAARRTIDCFVATTVAKRRADMLREGEGEGVCSSFDLLSSFICHEDDSSENDDDDDVFLRDTTVNLLLAGRDTTGAALSWFFYLVSKNPRVEQKLLDELAPIVASRRRAGGAAADAASGMVTFDADELGSGLVYLHAALSECLRLYPSVPFEHKVAXAADVLPSGKELKAGDKVLVFNYSMGRMEGVWGKDCTEFRPERWLNEDGTKLRYEPSYKFISFNAGPRTCLGKEMAFVQMKAVAAAVLWNFAVEVVPGHVVEPKLSIILHMKNGLAVKVRRRDGTYGAAPPSSVTPLLF

SEQ ID NO: 7047 - protein, 270 aa, Zea mays
AANTLVSLAQLGGTGFYACKVGKDEAGAFYLQDLNDCGLDTNPHHETAGEGITGKCLVFVTPDADRTMNAFLGISGSLSVTEMDWSALKQSQYLYLEGYLVTSPSAKAACIEAKAIAEQSGVKTCLSLSDPNMAKFFQDGLKEMLGSGVDLLFANEAEALEMAGTSDLNQAIAYCKSIAKNFALTRGGAGSLIFDGENLLTIGTPKVQPIDTVGAGDMYAGGFLYGLTHGMDYEKAGQLASETAAKVVTCYGPRLDTEILQEILQSVQAV

SEQ ID NO: 7048 - protein, 164 aa, Zea mays
MDASGAGSKAKKGAAGRKAGGPRKKSVSRSVKAGLQFPVGRIGRYLKKGRYAQRVGTGAPVYLAAVLEYLAAEVLELAGNAAKDNKKTRIVPRHVLLAIRNDVELGKLLAGVTIAHGGVLPNINPVLLPKKVAEKASSGGSKESKSPKKAAKSPKKAAKSPKKA

SEQ ID NO: 7049 - protein, 379 aa, Zea mays
CTRSRDPPAGSSNPPPPGPPPPPAPRPAVGPGPPPSPSSAGPGPPPPPGRGGAGPPPPAMPGGPKARGPPPLKKAGNVAGPPVADNKTKLKPFFWDKVTANPDQAMVWDQIKAGSFQFNEEMIESLFGCHAADKKNADGKKDLAAKDTPQFVRILDAKKAQNLAISLKALSVSADEVRNAVMEGHELPIDLIQTLIRWTPSSDEELRLRLYTGELTQLGPAEQFLRTIIDIPYLYQRLDVLLFMSTLPEEAANAEQSFKTLEVACHELRNSRLFKKLLEAVLKTGNRMNDGTFRGGAQAFKLDTLLKLSNVKGVDGKKTVVHFGVQEINWSKGVGSVSAAKEQNHNRKIRVDFCDFPQEGKGGQEPFQQVRLGVGFKLG

SEQ ID NO: 7050 - protein, 101 aa, Zea mays
  misc_feature (41)..(41): Xaa can be any naturally occurring amino acid
  misc_feature (59)..(59): Xaa can be any naturally occurring amino acid
DFFFDFFSRRVARIIGESLSRLGLDYLDMLHAHDIEFTHLXQIVNETISSLQKVHGNGXARLIGITGLALKIYPYGLDRVEPSLVGGILSYWYYGIQDTFL

SEQ ID NO: 7051 - protein, 121 aa, Zea mays
LQFQSVIRHIETVSSFFEEGGDWERMNRLKVYEGLYYRATRNFKKAASLFLDTISTFTTYENFPYDTFIFYTVLTSVITLDSVPLKQKVVEAPEFLVVIGEVPLLSTSFYKLYQCNRSVKS

SEQ ID NO: 7052 - protein, 114 aa, Zea mays
MEAAKERQQRKAAGEGDSTTVQLPTETSPYVQYEGLEDYKMRGYGAQGHLPVSDVPHGGSGTEAPTVPGTAIPVAEPKRRDDVQPQRDLGGDGGGGVRRPGDTSTDAINRHGVP

SEQ ID NO: 7053 - protein, 331 aa, Zea mays
MVTSSKGKVCVTGASGFVASWLIKRLLESGYHVVGTVRDPGNHQKTAHLWKLPGAKERLQIVRANLLEEGSFDSAVMACEGVFHTASPVLAKPDSTSKEDTLVPAVNGTLNVLRSCKKNPFLKRVVLTSSSSAVRIRDDGGQSSNISLDETTWSSVPLCEKMHLWYALAKVFAEKAAWEFAKENGIDLVTVLPSFVIGPSLSHELCVTASDVLGLFQGDTARFSSYGRMGYVHIDDVASSHILVYEVPQAAGRYLCSSVVLDNDELVSSLAKRYPIFPIPRRLNSPYGKQSYQLNTSKLQGLGFKFRGVQEMFDDCVQSLKDQGHLLECPL

SEQ ID NO: 7054 - protein, 331 aa, Zea mays
MVTSSKGKVCVTGASGFVASWLIKRLLESGYHVVGTVRDPGNHQKTAHLWKLPGAKERLQIVRADLLEEGSFDSAVMACEGVFHTASPVLAKPDSTSKEETLVPAVNGTLNVLRSCKKNPFLKRVVLTSSSSAVRIRDDGQSSSNISLDETAWSSVPLCEKMHLWYALAKVFAEKAAWEFAKENGIDLVTVLPSFVIGPSLSHELCVTASDVLGLFQGDTARFSSYGRMGYVPIDDVASSPILVYEAPQAAGRYLCSSVVLDNDELVSPLAKRYPIFPIPRRLNSPYGKQSYQLNTSKLQGLGFKFRGVQEMFDDCVQSLKDQGHLLECPL

SEQ ID NO: 7055 - protein, 402 aa, Zea mays
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSTKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFDEALDTTKTVIWNGPMGVFEFQKFAAGTEAIAKKLAELTTTKGVTTIIGGGDSVAAVEKAGLADKMSHISTGGGASLELLEGKTLPGVLALDDA

SEQ ID NO: 7056 - protein, 308 aa, Zea mays
MRPPARGGRGGRGGRFDGGGRGGGGGGRGFGGGRGGRGDRGGRGGRTPRGGRGGGGRGGRGGGMKGGSKAVVVAHKHAGVFISKSKEDALCTKNMVPGESVYGEKRVSVQNEDGTKVEYRVWNPFRSKLAAAVLGGVDNIWIAPGTRVLYLGAASGTTVSHVSDIVGPDGLVYAVEFSHRSGRDLVNMAKKRTNVIPIIEDARHPARYRMLVGMVDVIFSDVAQPDQARILALNASYFLKNGGHFVISIKANCIDSTLPAEAVFAAEVEKLKADQFKPAEQVTLEPYERDHACVVGGYRVPKKQKATS

SEQ ID NO: 7057 - protein, 516 aa, Zea mays
  misc_feature (108)..(108): Xaa can be any naturally occurring amino acid
  misc_feature (159)..(159): Xaa can be any naturally occurring amino acid
  misc_feature (188)..(188): Xaa can be any naturally occurring amino acid
  misc_feature (267)..(267): Xaa can be any naturally occurring amino acid
  misc_feature (377)..(377): Xaa can be any naturally occurring amino acid
  misc_feature (486)..(486): Xaa can be any naturally occurring amino acid
MMIARRLLRSNAPAQASSLLKHVTGTASLQGHADSPLDASVRHFSSAPSAQSDTTEENGFKGHGMLAPFTAGWQSNDLHPLIIERSEGSYVYDINGNKYLDSLAGLWXTALGGSEPRLVKAATEQLNKLPFYHSFWNRTTRPSLDLAQEILSMFTAREXMGKVFFTNSGSEANDSQVKLVWYYDNALXGRPDKKKFIARSKAYHGSTLISASLTGLPALHQKFDLPAPFVLHTDCPHYWRYHLPGETEEEFATRLATNLENLILKEXLETIAAFIAEPVMGAGGVIPPPKTYFDKVQAVVKKYDILFIADEVITAFGRLGTMFGCDYYNIKPDLVSLAKALSNAYVPIGATLVSPEISEVIHSQSNKLGSFAHGFTXMVIPVACAVAIEALKLYRERDIPGHVKQIAPKFQDGIRALADSPIIGEIRGLGMIMGTEFTNNKSPADLFPAEWGVGAIFGEECQKRGMLVRVAGDAIMMSPTLIMTPXEVDELVSIYGEALRATEERVSDLKMKSEKN

SEQ ID NO: 7058 - protein, 360 aa, Zea mays
MEEHVPRGGGGGRPPIPAAAARKPALARHSSFVRSPANNTKPATERAFEGMDTEFIPIVRSGGWADIGSRHTMEDVFICFDNFMQDFGIESFEEGPSAFYGIFDGHGGKHAADFVCSNLPRFIVEDEDFPREIVKAMSSAFLQADASFADACSLNCSLSSGTTALAALVVGRSLLVANAGDCRAVLCRRGKAIEMSRDHKPSCNREKIRIEALGGYVDDGYLNGQLNVARAIGDWHMEGMKACGGLGPLTAEPEVMTMDLTDEDEFLIMGCDGIWDVFLSQNAVDFARRKLQEHNDPAACCKELVDEAIKRKSGDNLSVVVVCFNSRPPPVLTTPRPRVQRSISAEGLRELQSFLDSLAD

SEQ ID NO: 7059 - protein, 202 aa, Zea mays
MAQTVFTPSLEAMKHVKAENGVILTKPFLDVCKQILPVLDKFGAAMAIVKSDIGGNITRLENKYTSEPSKYEHLYSMIQEEVQNKTAKGSSSCTNGLLWLTRAMDFLVELFRNLLEHPDWAMSQSCTDSYTKTLKKFHGWLASSSFTVAMKLAPNREKFMEVISGTGDINADIEKFCTTFSPFLKENHNFLASVGLDDLKAS

SEQ ID NO: 7060 - protein, 426 aa, Zea mays
MADLTDIGCCSCFSFLRKPSVPVRQHQDADGMLSEDLLKRQSAEDPDGSFYTGDDPDVSFYNGDDLDRSFYNGDDPDRSFYDRDDTDYIEGSDDGPSKKSSEDIIQLRAQNGFACREVPVKETKKVFRSEDENGNKMVNQYVHLGKIGSGSYGKVVLYRNIKDGKLYAVKVLNKPYMMKVHVVHTKTAMTDVLREVSIMKMLNHPNIVNLVEVIDDPNMDKFYMVLEYVEGKMVCDNGLEEATARIFLRDIISGLLYLHSHNVIHGDIKPDNLLVTSTGNVKIGDFSVSQVFEDDDDMLWRSPGTPVFTAPECCQGSAYHGRASDTWAVGVTLYCMVSGHYPFLGDTLQETYDKIANDPVEIPGDVNPQLADLLLRLLCKDPGDRITLRAAAEHPWVAGDEGPVPEFICRCGFGRRKRNDVREEVQ

SEQ ID NO: 7061 - protein, 161 aa, Zea mays
TTDFFSCSELILDVIGLRLGAVGLFCMLFLFLPVARGSVLLRLIDIPFEHATRYHVWLGHLTMALFTLHGLFYVISWSMQGRLREELRQWKEIGVANLPGVISLAAGLLMWVTSLHPVRKRVFELFFYTHQLYVVFVVFLAFHVGDFIFSICAGAVFLFML

SEQ ID NO: 7062 - protein, 251 aa, Zea mays
QQGYQVRTTLRDAEREAEVRAHLLHAGVAAGEALQFVVADLTADAGWEDAVAGCRFVLHGASPTPTGNQVSEADWVNPAIEGNLRVLRAARDAGVKRVVLTSAFGAVGIGHPADYPRPFTERDWSDVSGDVWPYQKSKTLAERAAWQFIAEQGNGLELATVNPVSVLGPVLGADYSHSIRIVKELLEGQPGCPDINSCFVDVRDVASLHVLAMTHAAAQGQRFLASSGHSLPLIEVARTLKTHLAAEAEKV

SEQ ID NO: 7063 - protein, 229 aa, Zea mays
VPLVIMFLAVIRARGVAAPLNPAYTQEEFEFYLSDSEARLLVTNAEGNAAAQAAAAKLGLAHAAASLHDAAGPVHLAGLPVHAPENGSHGGGAAGSLSPNDPSDVALFLHTSGTTSRPKGVPLKQRNLAASVRNIRSVYRLAETDATVVVLPLFHVHGLLCALLSSLASGASVALPAAGRFSASTFWADMRASGATWYTAVPTIHQIILDRHASRPEAYPALRFIRRGI

SEQ ID NO: 7064 - protein, 355 aa, Zea mays
  misc_feature (163)..(163): Xaa can be any naturally occurring amino acid
MCVEGLDDAAGRLGFGDQDTDRRAGDAMERVCENTVAVDFKQTKLNNFVPFIRSGEWSDIGGRDYMEDAHVCISDLAKNFGYDSVDDEVISFYGVFDGHNGKDAAHYVRDNLPRVIVEDADFPLELEKVVKRSFVQTDSKFAEKFSHHRGLSSGTTALTAMIXFGRSLLVANAGDCRAVLSRRGTAIEMSKDHRPCCMNERKRVESLGGYVDDGYLNGQLAVTRALGDWHLDGMKEVGEPGGPLSAEPELKMVTLTKDDEFLIIGSDGIWDFFSSQNAVDFARRRLQDHNDLRLCCREIVDEAVRRGASDNLTAVMVSFHSDAPPPSRANKRTGRVTRSISAEGLHSLRVLLEGQ

SEQ ID NO: 7065 - protein, 149 aa, Zea mays
RTIAGFISMVQQNSKSMLPVSDNGSSMSSTEAVSFDDERRIENFLKDQIPKSVAYGGYVAVAAISIGTLPQIFPQLKWYYILVAYVVAPVLAFCNAYGSGLTDWSLASTYGKLAIFVYRNMAILGVDGFGSLPKNCLTLCYIFFAAAIT

SEQ ID NO: 7066 - protein, 189 aa, Zea mays
  misc_feature (36)..(36): Xaa can be any naturally occurring amino acid
SRPAGPGFVSQVIGTGMGCVIGPCVFWLFYKAFGDXESGTEYPAPYAIVYRNMAILGVDGFGSLPENCLTLCYIFFAAAIAINLARDLTPHRVSRFIPLPMAMAIPFYIGSYFAIDMFLGSMILFVWERLNKAKADAFGPAVASGLICGDGIWTLPQSILALAKVQPPICMKFLSRSTNAKVDSFLGLS

SEQ ID NO: 7067 - protein, 243 aa, Zea mays
  misc_feature (223)..(223): Xaa can be any naturally occurring amino acid
  misc_feature (225)..(225): Xaa can be any naturally occurring amino acid
NSARGQTPVFPRILGHEAGGIVESVGEGVTECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNINAMISAFECVHDGWXCXACWLGVPHRDDQFKTHPM

SEQ ID NO: 7068 - protein, 270 aa, Zea mays
RLPFYSEAKLMFFVYLWYPKTKGTTYVYGTFFKPYISQHENEIDRNLLELRARATDTVVLYFQKAASAGQSTFFDVLKYVAAQSPSQKSRQRLHQESQQPPQQQQPQVQVQQAQPQKQAAPVMRRASSIAARQAAMAHQSQETKPVSSSPKIKRQTSARSGSVASTKPPVAASAPKPGGSPKKGEVKPAADPVQTPTTGVDSPKPEPSAPSLPGAEGVDKMAIDEASGDAPEGAEELDPAIEEETPMEETIRVTRAKLRRRTATEDPAGN

SEQ ID NO: 7069 - protein, 388 aa, Zea mays
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILVEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 7070 - protein, 376 aa, Zea mays
MPAVAVIERDAPELLPNLTKSAGTGIGLEFRESGLNLNAKNDRRIKKGMVFNVSLGLHNIQAETTSEKTKQFSLLLADTVLVNERGHEVLTAPCSKAFKDVAYSFNEDDDAVAAEVKIKSKTIDVMPTKATLRSDNQEMSKEELRRQHQAELARQKNEETARRLAGVGTGSGDGRGPARASNELVAYKNVNDVPFVRDLVIQVDQKNEAVLLPIYGSMVPFHVSTVKSVTSHQDNRTCTIRIFFNVPGMPFSNDSKFNSQGAIYLKEITFRSKDPRHSSEVVQQIKTLRRQVASRESERAERATLVTQEKLQIGSNRMKMMRLSDVWIRPAFGGRGRKLTGNLEAHFNGFRYSTSRSDERVDIMFGNIKHAFFQPA

SEQ ID NO: 7071 - protein, 70 aa, Zea mays
MRFAGWYLKIAAVGASIGAAMELFMIHTGFYEKVTVLESEKRAWESSPEAQAMREALNPWRKHDEQDQQK

SEQ ID NO: 7072 - protein, 143 aa, Zea mays
MGARACGHSGRSVIGWKSNAMRACLLGSDFFGFHWAMALSLDNLIKAAAAVGSARSGRLCLPASEDLLGEGHMRFAGWYLKIAAVGASIGAAMELFMIHTGFYEKVTVLESEKRAWESSPEAQAMREALNPWHKHDEQEQQKK

SEQ ID NO: 7073 - protein, 124 aa, Zea mays
MDRETAEKTSTANSPGANISEPTLGRTMAFFFLVSFAGLLVIVPMRKTMIIRHRLTFPSGSATAHLINSFHSPHGFMQAKRQVSLIVRSCLGSLLWSVFQWFYTGGPNCGFTAFPTFGLTAYKH

SEQ ID NO: 7074 - protein, 109 aa, Zea mays
  misc_feature (74)..(74): Xaa can be any naturally occurring amino acid
AGFGSYLLGMDRETAEKTSTANSPGANISEPTLGRTMAFFFLVSFAGLLVIVPMRKVRRQALTNHQPSSGDASXRPTGEQTMIIRHRLTFPSGSATAHLINSFHSPHGF

SEQ ID NO: 7075 - protein, 51 aa, Zea mays
MPLSYHRRQVSLIVRSCLGSLLWSVFQWFYTGGPNCGFTAFPTFGLTAYKH

SEQ ID NO: 7076 - protein, 91 aa, Zea mays
MCAVGQHRPRTVQARDGHAEHLFLGGSIVKGGPVQVLEDEELKSQPEPLVVKGKRVAGGPQMIQLSLDGKRLYITTSLYSAWDKQFYPDLI

SEQ ID NO: 7077 - protein, 276 aa, Zea mays
MALILLPVCRNTITWIRNHTGVAACFHMVVAAGIAVGAGLHVVSHLTCDFPRLLRATDAAYAPLAQYFGVPRPRNYWWFVKGTEGWTGLAMLVLMAVAFTLAMPWFRRGELALTDLLKRLVGPLKRLTDTLKLTDPLKRLTGQLKRLTAGPRKRPTDPLKPTDPLKRLTGFNAFWYTHHCFVAVYALLLVHGHYLYLTHKWYKKSTWMYLAVPMVLYACERLTRALRSRVRAVRILKVAVYPGDVLSLHFSKPPGFSYKSGQYMFVNCADVSPFEW

SEQ ID NO: 7078 - protein, 280 aa, Zea mays
MAERMQTITQRASENKLSKITKQAEEYARLIMEELDPDKLGYIEVRNLERLLEDPSQSVSIGTGKDMSQMLRSQSLRPTPEPNPLRRTQYFLEDNWRRVWVVLLWLSICVGLFAWKFAQAAPRLKFNMALILLPVCRNTITWIRNHTAVGRVVPFDDNISFHMVVAAGIAVGAGLHVVSHLTCDFPRLLHATDAEYAPLGQYFGVPRPPNYWWFVRGTEGWTGLAMLVLMAVAFTLAMPWFRRGELALPGPLKRLTDTLKLTDPLKRLTDTLKRLTAGMQ

SEQ ID NO: 7079 - protein, 292 aa, Zea mays
  misc_feature (28)..(28): Xaa can be any naturally occurring amino acid
GAETLKFNMALILLPVCRNTITWIRNHXRRGRVVPFDDNISFHMVVAAGIAVGAGLHVVSHLTCDFPRLLRATDAAYAPLAQYFGVPRPRNYWWFVKGTEGWTGLAMLVLMAVAFTLAMPWFRRGELALTDLLKRLVGPLKRLTDTLKLTDPLKRLTGQLKRLTAGPRKRPTDPLKPTDPLKRLTGFNAFWYTHHCFVAVYALLLVHGHYLYLTHKWYKKSTWMYLAVPMVLYACERLTRALRSRVRAVRILKVAVYPGDVLSLHFSKPPGFSYKSGQYMFVNCADVSPFEW

SEQ ID NO: 7080 - protein, 460 aa, Zea mays
  misc_feature (10)..(10): Xaa can be any naturally occurring amino acid
STCRVDKDAXGRITEEEIREIITLSASTNKLSKITEQQAAEYALLIMEELDPGNLGYIDVHNLETLLLQAPSSQSVSIGTGAKDMSQMLSQSLRPTPEPNPLRRWRRRAQYFLEDNWRRVWVVLLWLCVCVGLFAWKFAQYRRRYVFQVMGYCVCVAKGGAETLKFNMALILLPVCRNTITWVRNHTGVGRVVPLDDNISFHMVVAAGITVGAGLHVVSHLTCDFPRLLRATDAAYAPLAQYFGVPRPRNYWWFVKGTEGWTGLAMLVLMAVAFTLAMPWFRRGELALPGPLKRLTGFNAFWYTHHCFVVVYALLLVHGHYLYLTHKWYKKSTWMYLAVPMVLYACERLTRALRSRVRAVKILKVGLHPGKVMSLCFSKPPGFRYRSGQYIFVNCAAVSPFEWHPFSITSAPQDEYLSVHIKNKGDWTGKLQEVFSRVRTYVYIRARHVLTAEANVLVCA

SEQ ID NO: 7081 - protein, 466 aa, Zea mays
MPLPLIPALTDVVYGEKKRMQIITLSASTNKLSKITEQQAAEYALLIMEELDPGNLGYIDVHNLETLLLQAPSSQSVSIGTGAKDMSQMLSQSLRPTPEPNPLRRWRRRAQYFLEDNWRRVWVVLLWLCVCVGLFAWKFAQYRRRYVFQVMGYCVCVAKGGAETLKFNMALILLPVCRNTITWVRNHTGVGRVVPLDDNISFHMVVAAGITVGAGLHVVSHLTCDFPRLLRATDAAYAPLAQYFGVPRPRNYWWFVKGTEGWTGLAMLVLMAVAFTLAMPWFRRGELALPGPLKRLTDKLKLTDPLKRLTGQLKRLTAGPLKRLTGFNAFWYTHHCFVVVYALLLVHGHYLYLTHKWYKKSTWMYLAVPMVLYACERLTRALRSRVRAVKILKVGLHPGKVMSLCFSKPPGFRYRSGQYIFVNCAAVSPFEWHPFSITSAPQDEYLSVHIKNKGDWTGKLQEVFSR

SEQ ID NO: 7082 - protein, 432 aa, Zea mays
MVFDASGSRSAAAASGNPLRVILTRGFARQVLVGRWLTVFASLLIMASSGATYIFGSYSGTLKSSLGYDQRTLNTVSFFKDLGANLGVFSGLINEVTPPWVVLAMGAAMNLSGYLMVYLAVSGRTAPPPLWLVCLYFFVGANSQSFANTGALVTCVKNFPDSRGVVLGILKGFVGLSGAVYTQLYLALYGGDDAESLILLVAWLPAAVSVVFVHTIRYMPYPRRRGGGQETSSSDSDPFFCFLYLSIALACFLLVMIVVQKQVPFSRAAYGLAATPLLILLLMPLGVVVKQEYKIYRERQLDAADPPPPTIVSASATDAIKKTEQQPAPTPTTSTSSFCGCVRTMFRPPARGEDYTILQALVSVDMLVLFVATICGVGGTLTAIDNMGQIGESLGYPARSVNTFVSLISIWNYAGRVTAGYASEAALARYRV

SEQ ID NO: 7083 - protein, 467 aa, Zea mays
  misc_feature (132)..(132): Xaa can be any naturally occurring amino acid
  misc_feature (167)..(167): Xaa can be any naturally occurring amino acid
  misc_feature (191)..(191): Xaa can be any naturally occurring amino acid
  misc_feature (212)..(212): Xaa can be any naturally occurring amino acid
  misc_feature (227)..(227): Xaa can be any naturally occurring amino acid
  misc_feature (252)..(252): Xaa can be any naturally occurring amino acid
MAASPSLHAVAHRGPSLTALLFLVAAMVLVPPAAAEIRETAIRADPRSIIPLDEFGFSHSGVLELNVSGIAFDPQASAELDLSQLGFFLSTLDAWVHVLRQLQDLDVTCALQSELVKLAFSFDRLRPPSNPXPGVEVARSSSFSTAFRVSEPGQYTLVFANCLGGGXLKVDMDVRSAMYNVDPGNPGSASXLRGGPPALPSFYFLFCLAYAXLAAAWVAILLRKRAXAVFRIHYFMLAVLVLKALNLLAEAXEDKSCIERTGTAHGWDVLFYIFSFLKGISLFTLIVLIGTGWSFLKPYLADREKKVLMVVIPLQVVANIAQVVIDESGPYARDWVTWKQIFLLVDVVCCCAVLFPIVWSIKNLREAARLDGKAAVNLMKLTLFRQYYVVVICYIYFTRVVVYALQTITSYRYLWTSVVAGELVTLAFYVFTGYKFRPEVHNPYFAIDDEEEEAAAETLKLNDEFEL

SEQ ID NO: 7084 - protein, 283 aa, Zea mays
RLGIATALVERAEEWCRERGAAHATMATTTSNAASLALFTGRFGYAPFRRPEFLGRPVHAHCLPIPSAHRVFQLPPPLAAAAYARLSPPQATEFLPADMPALLAHKLTLGTFAAIESGPDPSAPPSFAVLSVWDSTRSMRLRVRGAPALLRASLAALRALDRGAPWMRVPSVPDIFRPFGTYLLYGLRMSGPEGPALLRSLCQHAHNVARKNPACAVLAADLGPGDPAKAVVPHWPKFSCDEDVWCIKKLGASAASDNAGNDDDDDWTTSPPPSVLFVDPREF

SEQ ID NO: 7085 - protein, 240 aa, Zea mays
  misc_feature (47)..(47): Xaa can be any naturally occurring amino acid
VLVMVMKCTDVYVMNVGDSRAVLARRPEPDLKNVLGKASQDLQQFKXEIMRELEAHDMDGLQAVQLTPEHSTAVQEEVTRIKGQHLNDRNAIVNGRVKGKINVTRAFGVAYLKQPKWNSRLLEAFKINYVGTDPYVTCAPSLCPHRIGSQDKFLVLSSDGLYQFFTNKEVVDQVEALTAAEPDGDPAQHLVGELVNRAARKAGMETRQLLDIPRGARRHYHDDVSIIVISFEGRIWRSSV

SEQ ID NO: 7086 - protein, 531 aa, Zea mays
  misc_feature (160)..(160): Xaa can be any naturally occurring amino acid
  misc_feature (185)..(185): Xaa can be any naturally occurring amino acid
  misc_feature (196)..(196): Xaa can be any naturally occurring amino acid
  misc_feature (216)..(216): Xaa can be any naturally occurring amino acid
  misc_feature (323)..(323): Xaa can be any naturally occurring amino acid
  misc_feature (411)..(411): Xaa can be any naturally occurring amino acid
  misc_feature (502)..(502): Xaa can be any naturally occurring amino acid
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPADELKVSKAEFIDLARKSGKFDEDSLXFQSRLLAKSGIGDESYMPALRVRAXASCATMKEGRXEASTAMFAALDELFDKCRVXPRDVGVLVVNCSLFNPTPSLSAMIVNHYKMRGNILSYNLGGMGCSAGVIAIDLARDMLQASGAGLAVVVSTEAVSFTWYPGKRRSMLIPNAFFRAGCAAVLLSNRRXDFHRAKYQLEHVVRTHKGADDRAFRSVYQEEDEQRIKGLSISRDLLEVGGHALKTNITTLGPLVLPFSEQLLFFAGVLFRHLFPGRLXAAPYIPDFKRAFEHFCMHAASRDVLEHLQSNLGLRDADLEASRAALHRFGNTSSSSIWYELAYLEAKGRVRRGDRVWQLAFGSGFKCNSAXVGAPVRRVRRPARSPWLDCVDQYPARMDA

SEQ ID NO: 7087 - protein, 377 aa, Zea mays
  misc_feature (254)..(254): Xaa can be any naturally occurring amino acid
MAAVAIHQFAECITCHAWSPDQSMIAFCPNNHEVHIYKFFTDKWEKLHVLSKHDQMVSGIDWSKSSNKIVTVSHDRNSYVWTQEGSDWVPTLVILKLNRAALCVQWSPKENKFAVGSGAKSVCICYYEQENNWWISKVIRKKHESSVTSLAWHPNNIYLATSSTDGKCRVFSTFIKGVDTRGSKSSTSTDSKFGEQIAQLDLSSTWVFGVRWSPSGKTLAYAGHNSMIYFIDEVESSPVAQNLALRDLPLRDVXVLFVSERTLIGVGFDCNPMIFAADDTGLWTFIRFLDERKAAPSASKASQLSEALGKLYGQSKQGTSSDTVEPSKPRGGAHENCITCIVPLRKGSDGSIKRFSTSGLDGKIVVWDLENHVSIAK

SEQ ID NO: 7088 - protein, 119 aa, Zea mays
FLNMEASDSETEDTEESDQGYVPSDAEPESESEDDDSDSESLVESDDDDEESDEDSEEEKGKTWEELEREASNADREHGAESDSEEERRRRKAKTFGKSRAPERSSFKGAPPSKKPKFR

SEQ ID NO: 7089 - protein, 120 aa, Zea mays
MGTLFAVEGSYFEKFYKQTADMDPAQRAAFLEEDDEMEDAHSVAASAGDTDANLDVNVHFVCFSCVDGELYELDGLKSQPTPHGPSSPETLLQDAAEVIKARIAENPNSMNFNVMALSKK

SEQ ID NO: 7090 - protein, 168 aa, Zea mays
PLEAGAHGETKCWSFQLELHRHPPTVVRLFVVEEVVDTSPQRQCHLCRHVVNSGLELHSDDLICRKKTITIEQLGWGRHLICSKRFHFVLPKRELSVEADGLHYGINHGPEKPSKGTATSRGHLLHGVVHLNGFGHLVALHGFEGGSEFVAGEQIMDLWDRICSSLNV

SEQ ID NO: 7091 - protein, 200 aa, Zea mays
MAANNKTTMVVSLGSSRRRKRGEMLFRFESFCQPGYPAPLAGGGAFRDNVRALLGLAHLEAGAHGETKCWSFQLELHRHPPTVVRLFVVEEVVDTSPQRQCHLCRHVGWGRHLICSKRFHFVLPKRELSVEADGLHYGINHSPEKPSKGTATSRGHLLHGVVHLNGFGHLVALHGFEGGSEFVAGEQIMDLWDRICSSLN

SEQ ID NO: 7092 - protein, 137 aa, Zea mays
VPLEQAATMEDVLREADVISLHPVLDKTTYHLINPERLAIMKKEAVLVNASRGPVIDEAALVEHLKANPMFRVGLDVFEDEPYMKPGLADMKNAVVVPHIASASKGKIKGYPVWGNPNQVEPFLQENLTPPPACPSI

SEQ ID NO: 7093 - protein, 482 aa, Zea mays
  misc_feature (131)..(131): Xaa can be any naturally occurring amino acid
  misc_feature (376)..(376): Xaa can be any naturally occurring amino acid
MGEEANVPLLVPANNGDDDHLRLTVIHGDQGKAAAGDTGLLPAASSASAWPWAEVKGQLAFAAPMVATSMAYYAIPLVSVMFAGRLGDLQLAAATLGNSWGTVTGIALMTGLSGSLETLCGQGYGAKAYRXTMGVHLQASLLTSALASAVVSLLWIYSEPLLVFLRQDPETSRLAADFLRHSVPALFAYGFIQCALRFLQAQSVVAPLVAFSLLPLAAHVGVAHALVNVLGMGFAGAAVATSASLWLSFIMLAAYVMLSARFRETWPGLTTEAFRHVLPGMKLAIPSAVMVCFEYWSFEILVLFAGLMPDSQLSTSIIAMCQNTEAISYMITYGFAAVISTRVSNELGARNIANAKKALTVSLALSLMLGVAFLLXPLGLGHDLWVHLFTTSEAVVSAFASMTPMLIGSVVLDSTQGVLCGVARGCRWQHLAAWTNLVAFYVIGLPLAILFGFTLAFQTKGLWMGQICSLLCQNYVLFFITL

SEQ ID NO: 7094 - protein, 353 aa, Zea mays
  misc_feature (3)..(3): Xaa can be any naturally occurring amino acid
DEXAKLRLYTGELTQLGPAEQFLRTIIDIPYLYQRLDVLLFMSTFPRVRANAEQSFKTLEVACHELRNSRLFKKLLEAVLKTGNRMNDGTFRGGAQAFKLDTLLKLSDVKGVDGKTTLLHFVVQEIIRSEGVRAVRAAKEQSNSSISSVTSDDLTEDVSDDTEHYKQLGLGVVSSLGDDLQNVRKAAILDADALTISVASLGHKLVKANEFLNTGMKSLDEDSGFHRKLGEFIEQSQVRVTQLLEEEKKLRALVRTTVDYFHGSTGKDEGLRLFVVVRDFLGILDKVCREVKEAAAKAAANNKKPSAAGSGSKGRQPSQSSSSFRDPRQQLVPAIKDRRSAAARSSSSSSDSD

SEQ ID NO: 7095 - protein, 194 aa, Zea mays
  misc_feature (51)..(51): Xaa can be any naturally occurring amino acid
VKVNDYLQTTSPQIYAAGDICMDWKFTHAADAAARIVIKNTLFSPFGLGRXKLSSLTMPWVTYTDPEIAHVGLNETMAEALDIGYKIIKIPFSQVDRAIAADETEGFLKIIHVANSDEILGATIVASHAGEMISEITTAIVNKIGLSKLAGVIHPYPTQAEAIKKAADTYRRTLLTNNTKNLLKLLTKFPSKLF

SEQ ID NO: 7096 - protein, 464 aa, Zea mays
MSKEDVLKVQTLMLRVNIHCDGCEKKVKKTLHKIDGVYQSSIDAEQGKVTVSGLLDPDTIIRKLNKAGKPAQLWGSKPGVPQNGHGGGKGQPKDAGGGKGHSKDAGGGKAQKGGAGGGGHKGAGGAGGGGGGAKDPKMVMPQPTPQQLQQLQQQLQMKGLKLPPHLLGGNMPAFPAAAPLKDHPKSVKFALPEDSFDDDGGSEFDDDFDDDDFDDDEDYDDEGFDDDVYDEPKMMKPMAVPPPAGGGDKKGGGGKKGGGGSEIPVQIKGNNQGGGQPHNAKGGPPGGGNPLAQGKKGGAVGGPMGGMLPQQAMMRPNMLGGAGAGFPGTAQMGGGPMGMPMGHPHMGIMQQGGGGGGGGVPGLGFYQGNANGGGGGMHSGAEMLQAAAASGNPMAQQQYMALLQHQQQQQMMLQHGNGGGAGYPAMGYGYGRPPMMHYPMPPHSHPEPYNIFSDENPNSTCSLM

SEQ ID NO: 7097 - protein, 345 aa, Zea mays
MAVERDIFGISGPTYLKSIDWNCEHNRRSVAASLVQAVYVLERDRQLNHQSFEALAPAWWEFLHFELIRKLIDDADMSIFGAIFEFNPPKEEASGANAPRFVIAFRGTITEKDTISRDLSLDLHLVQNGLHRTSRFNIAMQAVQNVASVFPGSTIWLAGHSLGAGLAILTGRNMVKKGVLLESFLFNPPFVAAPVERIRDERVKHGFRIARSVITAGLTIAMKAKTEGSSQRSVAEESFSILSSWTPYLFVNPGDHICSEYIGYFQHRKNMEDLGAGFIEKLATQNSIGDLFFKALGWESEPLHLLPSADLIVNVSPSSDFKYAHGISQWWQPELNLQCSKYRYS

SEQ ID NO: 7098 - protein, 449 aa, Zea mays
  misc_feature (107)..(107): Xaa can be any naturally occurring amino acid
  misc_feature (194)..(194): Xaa can be any naturally occurring amino acid
  misc_feature (286)..(286): Xaa can be any naturally occurring amino acid
  misc_feature (310)..(310): Xaa can be any naturally occurring amino acid
  misc_feature (340)..(340): Xaa can be any naturally occurring amino acid
  misc_feature (350)..(350): Xaa can be any naturally occurring amino acid
  misc_feature (413)..(413): Xaa can be any naturally occurring amino acid
  misc_feature (444)..(444): Xaa can be any naturally occurring amino acid
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGXWCKQKLGANAILAVSLAVCKAGAMVKKIPLYQHIANLAGNKTLVLPVPAFNVINGGSHAGNKLAMQEFMILPTGASSFKEAMKMGSXEVYHNLKSIIKKKYGQDATNVGGIEGGFAPNIQENKEGLELLKAAIEKAGYTGKVVIGMDVAASEFFGEKDKTYDLNFKEENNDGSNKISGXSLKDLYKSFVSEYPIESIEDPFDXDDWSTYAKLTDEIGQKVQIVGDDLLVTNPXRVAKAINEKXCNALLLKVNQIGSVTESIEAVRMSKRAGWGVMASHRSGETEDTFIADLSVGLSTGQIKTGAPXRSERLAKYNQLLRIEEELGDAAVYAGAKFRXPVEPY

SEQ ID NO: 7099 - protein, 165 aa, Zea mays
SCVLLLLRIAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQEIATRPFQLVTGRVWK

SEQ ID NO: 7100 - protein, 77 aa, Zea mays
  misc_feature (72)..(72): Xaa can be any naturally occurring amino acid
HAYGHASAHASVHACAHAYVHACCACNESKAFAFCKNNSIKKLTASMKNYSPDSTRTLAINATIEKTKHRFXNYGKF

SEQ ID NO: 7101 - protein, 187 aa, Zea mays
  misc_feature (51)..(51): Xaa can be any naturally occurring amino acid
  misc_feature (57)..(57): Xaa can be any naturally occurring amino acid
  misc_feature (83)..(83): Xaa can be any naturally occurring amino acid
  misc_feature (97)..(97): Xaa can be any naturally occurring amino acid
  misc_feature (143)..(143): Xaa can be any naturally occurring amino acid
MDMPVASHIHYHPSWQATIRSSPSNREAAMATRRSRATRLEADLTGKNVYXRADLNXPLDDAQDITGDTRIRSSVPTIRLLLXKGAKVILARHLGRXNGVPPRTDLKPLDPRLCDLLGVRFQMLDDCLGQEQVNCADALPQRXSSVPIESTWLPEDENNQSVCAPKLSSVADLDATEAIGTMHRAHT

SEQ ID NO: 7102 - protein, 232 aa, Zea mays
MAALAASSTAAFAAKPRLPRARLTVACSATGGDGNGSSSSVSLASSVKTFSAALALSSVLLSSAATSPPPAAADIAGLTPCKESKAFAKREKNSIKKLTASLKKYAPDSAPALAINATIEKTKRRFENYGKFGLLCGADGLPHLIVSGDQRHWGEFVTPGLLFLYIAGWIGWVGRSYLIAVSGEKKPAMREIIIDVELATRLLPRGFIWPVAAYRELINGDLVVDDKDIGYY

SEQ ID NO: 7103 - protein, 601 aa, Zea mays
VTPNRSLSLQTVQGIHCVPRAARGFGFFLSPYALSAPLSLSRSRPRLSRAARRSHRRLGAGKTLRGRFLQGGGRCRAPATCSWEEPFRLASVLSPAKPKVFPSLTKIVGTLGPNSHSVEIIQECLTAGMSVARFDFSWMDAAYHQETLDNLRKAAQNVKKLCPVMLDTLGPEIQVHNSTGEPIELKAGNHVIITPDISKALSAEILPIKFGDLAKAVKKGDTLFMGQYLFTGSETTSVWLEVVETSGENVNCLVKNAATLAGPIFTLHASQVHINLPTLSEYDKHVISTWGSCNSVDIISLSHTRSAEDVRELRAFLQAHALPDTQIYAKIENSEGLDHFDDILNAADGIIISRGDLGIDLPPENVFMFQKTAIHKCNLEGKPVIITRVVDSMIDNLRPTRAEATDVANAVLDGTDGILLGAETLRGLYPVDAVSTVGRICAEAETVYNQPLQFKKVMWHVGDPMPHEESVASAAVGSAIKVKAAAIVVFTFSGRAARLVAKYRPTMPILAVIFPREGSDPSKWRSYGTTQARQCFAVRGVYPLMGSTDEAETGGLTKEEYGIKLAMSYGRSVGIVKPFDRLIIFEKIGDSSVVKIIECEG

SEQ ID NO: 7104 - protein, 511 aa, Zea mays
MDPPGRGDQGEAPQPQPLEWRFAQVFGERAAGEDVQEVDIISAIEFDKSGDHLATGDKGGRVVLFERTDVRDNASQRELERQDVPVTRHPEFRYKTEFQSHEPEFDYLKSLEIEEKINRIKWCQTANNALSLLSTNDKTIKYWKVQEKKVKRFAVMNLDSSQSAGSSTTAIASTSSSKAPLPNGGCSDMLGCLNNDLTFPPGGYPSLRLPVVTSLEANPVARCRRVFAHAHDYHINSISNNSDGETFISADDLRINLWNLEINSQSFNIVDVKPTNMEDLTEVITCAEFHPSHCNTLAYSSSKGSIRLIDLRQSALCDNHSKIFEEHEAPGSRSFFTEIIASISDIKFSRNGKYILSRDYMTLKLWDLNMNSGPVSTFQVHEHLRPKLCDLYENDSIFDKFECCLSGDGLRVATGSYGNIFRVFGRPPGSIEATTLEASRNPMRRQIANPARPTRTLTSFARGVRRGGENQGVDANGNSLDFSTKLLHLAWHPTENSIACAAANSLYMYYA

SEQ ID NO: 7105 - protein, 153 aa, Zea mays
IYDCFEGNKYSHASSFARIMEGGYARRLLQVGIRSINQEGREQGKRFGVEQYEMRTFSKDRPMLENLKLGEGVKGVYISIDVDCLDPAFAPGVSHIEPGGLSFRDVLNILHNLQADVVGADVVEFNPQRDTVDGMTAMVAAKLVRELAAKISK

SEQ ID NO: 7106 - protein, 667 aa, Zea mays
MATPNGLARIETTGKKKQDNGVWYDDSSAPVRAQTIDELHSLQRKRSAPSTPKRSAPTTPIKGGAHSPFAVAISEEERHTQQMQSISASLASLTRETGPKVVKGDPAAKGEAAAQGAPSTPRAHQQHRHPAAPAIAVSDSSLKFTHVLNNLSPAELYEQAIKYEKGSFITSTGALATLSGAKTVRSPRDKRVVKDEVTAQDLWWGKGSPNIEMDEKTFLINRERAVDYLNSLEKVFVNDQYLNWDPENRIKVRIISARAYHSLFMHNMCIRPTDEELEDFGTPDFTIYNAGQFPCNRYTHYMTSSTSIDLNLARREMVIMGTQYAGEMKKGLFGVMHYLMPKRGILSLHSGCNMGKDGDVALFFGLSGTGKTTLSTDHNRLLIGDDEHCWSDNGVSNIEGGCYAKCIDLAQEKEPDIWNAIKFGTVLENVVFDEHTREVDYADNSVTENTRAAYPIEYIPNAKIPCVGPHPKNVILLACDAFGVLPPVSKLNLAQTMYHFISGYTALVAGTEDGIKEPQATFSACFGAAFIMLHPTKYAAMLAEKMQKYGATGWLVNTGWSGGRYGVGKRIRLPYTRKIIDAIHSGELLTANYQKTEVFGLEIPTEINGVPSEILDPINTWTDKAAYKENLLRLGGLFKKNFEVFASYKIGDDSSLTDEILAAGPNF

SEQ ID NO: 7107 - protein, 203 aa, Zea mays
CRRSSSATVRAAAAATAAAPAAVELQNKGVSLPTWAEFELGRAPVYWKTSSGLPPSPVSQSVGRNGEGLTLFYNPAATKMAPNEVFGVAFNGGFNQPIMCGGEPRQMTLQERGKADPPIYTIRIRVPQHAVSLIFSFTNGAEWDGPYTLKFRVPKPWQNKPLSFFNEACSELSTGLLQGLADELNREGACDLAIYPDENIAIT

SEQ ID NO: 7108 - protein, 97 aa, Zea mays
  misc_feature (62)..(62): Xaa can be any naturally occurring amino acid
RVCWTPGRERTASDRPPTPSRVSVSLPTWAEFELGRAPVYWKTSNGLPSSPGEGLTLFYNPXASKMAPNDVFGVAFNGGFNQPIMCGGEPRQMTLQA

SEQ ID NO: 7109 - protein, 101 aa, Zea mays
MDLRPLTLLVVMGSLPTTLVGRLEMGPTCDLFDPRDASGFTNLLAALTVVIIAVTASSPVGFIVLRFVAGLSLANFVANQHWMSGIFAPSVIGLANAVTTG

SEQ ID NO: 7110 - protein, 229 aa, Zea mays
GNAVVLKPSEIAPATSSLLAKLLPEYVDNSCIKVVEGGVAETTSLLEQRWDKIFYTGNGTVGRIVMAAAAKHLTPVALELGGKSPVVVDSNVDLHVAVKRIVVGKWGCNNGQACIAPDYIITTKSFAPELVASLKRVLERFYGEDPLQSADLSRIVNSKHFRRLTELIEEKSVADKIVYGGEVDEKQLKIAPTLLLDVPQDSAIMTGEIFGPLLPIVTVCLPCSWNNLQ

SEQ ID NO: 7111 - protein, 229 aa, Zea mays
LYLAVKPLPLVLVLVLVLVHHSRPAPSSALRLPRRTASAWLPRFPSCSTSAPPPFAAVASMDAPPQGYRTNVGICLADPSLTKIFSASRIDIPSAWQMPQGGIDAGEEPRAAAFRELREETGVTSAEIVAEAPVWLTYDFPTDVRTKLNARWGTDWKGQAQKWFLFRLTGNDDEINLNGDGSEKPEFGEWTWMTPQEVIEKAVDFKKPVYEEALKHFAPYLQSDPAASS

SEQ ID NO: 7112 - protein, 659 aa, Zea mays
  misc_feature (185)..(185): Xaa can be any naturally occurring amino acid
MPLIRYYVDHVHVAVEARALLGRLEFQKGNVEVALRVFDGIDLQAAIQQFQPSLSDKTPSKKGRTKSEIPSSVPQNNPASLVLEAIYLKSLSLQKLGKSTEAANQCKSVLDSVESIFQNGAPDIEQKLQETVNKSVELLPEAWKHAGSNQEALASYRRALLSPWNLDDECRTRVQKRFASFLLYXTNIDWSPPSMAQQVEGCFVPKNSVEEAVLLLMVVLRSWYQGKTHWDPSVMEHLTYALSLCGEPLVLAKQLEEVLPGVYPRTERWATLALCYYVAGQKDVALNFLRKSLNKLENPNDVLALLLAAKICSKERHLASEGVEYARRVIACAESSDPHLKSVGLHFLGSCLGNKSKVVSSDYQRSLLQTETLKSFAESIGLNRYNADLIFDMGVEYAEQRNMNAALRCAKEFIEATGGSVSKGWRLLALILSAQQRFSEAEVATDAALDETAKLDQGSLLRVKAKLKVAQSSPMEAVEAYRALLALVQAQKNSPGGSCKSATEDADGSVSEFEIWQGLANLYSSLSYWRDAEICLNKARALKLYSAATLHAEGYMHEARDQTTDALAAYVNAFSTELEHVPSKVAIGAMLSKQGPRFLPAARCFLSDALRVEPTNRMAWLYLGKVHRSDGRISDAADCFQAAVMLEESDPVESFSSLS

SEQ ID NO: 7113 - protein, 109 aa, Zea mays
LEKYKNYDFGRCPRVYCCGQPCLPVGQSDIHRSSTVKIYCPKCEDIYYPRSKYQGNIDGAYFGTTFPHLFLMTYEHLKPQKLSQRYVPRCGSLGENPEFCEIKVLEDYI

SEQ ID NO: 7114 - protein, 257 aa, Zea mays
  misc_feature (165)..(165): Xaa can be any naturally occurring amino acid
MSLCRRRHQWTRRGDDRTRVVSGKPTGSTAGCRSPHPPRSISSPPPPIEPLTPAPSGGMEAGGEEFAIGVVLSAKTTLGEEFEGQIVAFDRPSNLLVIQEGVGRAESGERRNVRVLKANYIREFSVLSKGDDPLDPAGCMLDLNSIYAREDAALRIFSGFLGSHXKNDIWNMQAEIEAERIGVGVTPEAQNIFDALSKTLPVQWDKTDIVVMKEVRVRSPYLPENVSGGTAAANERVKKVIDFERKRLHSRAPGQFS

SEQ ID NO: 7115 - protein, 448 aa, Zea mays
  misc_feature (401)..(401): Xaa can be any naturally occurring amino acid
MSAAATKVKRRVGKYELGRTIGEGTFAKVRFAKNTETGEPVAVKILDKEKVLRHKMAEQIKREISTMKLIKHPNVVRIYEVMGSKTKVYIVLEYVTGGELFDTIANQGRMREGEARSYFQQLINAVDYCHSRGVYHRDLKPENLLLDSYGNLNVSDFGLSALSQQIKDDGLLHTTCGTPNYVAPEVLEDQGYDGAMADLWSCGVILFVLLAGYLPFEDSNLMTLYKKISNAEYTFPPWTSFPAKRLLTRILDPNPMTENSCDFRITIPEILEDEWFKKGYKRPEFDEKYDTPLDDVDAVFNDSEEHHVTEKKEEEPVALNAFELISRSAGLNLGNLFDSEQEFKRETRFTSKCPPKEIIRKIEEAAKPLGFGVQKKNYKLRLEKVKAGRKGNLNVATEILXVAPSLHMVQVRKAKGDTLEFQKFYKNLSKTLKDVVWKSEDLQMRAAS

SEQ ID NO: 7116 - protein, 335 aa, Zea mays
MADLIKAVDIRGGKGERDALFINPQTPKPSPTEGQALVRVKAFGINRMDIVQRRGFYPLPPQAPATLGVEFSGTIESLGPGDHGAFKQGDEVFGLAYGGAYAEYLAVSTRMLLHKPSSMDFVTCAGIPETWITATQALHLVLGFTKGKSILWHAGASGVSIAGIQLSKIAGASQVFATAGSQEKCDFITSKLGATAAFNYKTQDWAEEIKKHTDGNGVDYIVDFVGASYFQQNQTAAARDGRIVLLGTLGGVKIPEADISQILYKRLRIEGSTLRSRDEEYQGKLRDRLEEYLPDFESGKLKILVDKVLPWEEIQEAHKHMEEAKNLGKIICTIS

SEQ ID NO: 7117 - protein, 679 aa, Zea mays
MQDSNPFTSVDCQSSGSGTPSPAPSSSSSSNLNNSAFWSNVVALLDALPSAAAPSRFASISSGNGTTRAFVRGICRGDTLPADCAKYLQNATLTIQSRCNRSSRRAGIWYDKCFVSYADTNASTSEEQSFRSILYNTGEVGDKDAFETTYYALMRQLTARVVNGSGTATSPSSTSSSLRSVSPMFATGEAVYDAAAPNGTMYGLLQCMRDRTQAECEQCLKDSVGQLPSCCYGHQGGVVLGYNCNLRVEIYTYYDLAIDAPPPSGSGFIGQSQVKKRVHTRTILAVALPVGTVFAAAAILGVFMQRRKTNRKKTQRLGNDIKEENISFVAPGKLSIAVLRTATNNFSEENKLGEGGFGEVFKGTLEDGEEIAVKRLSHTSSQGFNELKNELVLAAKLKHRNLVQLLGVCLQEEKLLAYEYMPNRSLDTFLFSGNPGTRRQLDWSKRFGIICGIARGLVYLHEESRLKVVHRDLKPSNVLLDADMNPKISDFGLARAFSNDQSVDITRRPVGTLGYMSPEYAYWGNVSTKSDMFSFGVIVIETVTGRRNNSPYDQSAGSVSVLSHVWDKWRTGATTDVVDPTLGAEHYSESEVVTCIEVGLLCVQENPADRPDASAVVLMLSSPTSTPGDRRVPSRPAFVFSTASAWSSGGVQIGNNKHTSTSMVSVSDNEVTITELQPR

SEQ ID NO: 7118 - protein, 353 aa, Zea mays
  misc_feature (25)..(25): Xaa can be any naturally occurring amino acid
  misc_feature (93)..(93): Xaa can be any naturally occurring amino acid
  misc_feature (109)..(109): Xaa can be any naturally occurring amino acid
  misc_feature (122)..(122): Xaa can be any naturally occurring amino acid
  misc_feature (137)..(137): Xaa can be any naturally occurring amino acid
  misc_feature (147)..(147): Xaa can be any naturally occurring amino acid
  misc_feature (185)..(185): Xaa can be any naturally occurring amino acid
  misc_feature (198)..(198): Xaa can be any naturally occurring amino acid
  misc_feature (208)..(208): Xaa can be any naturally occurring amino acid
  misc_feature (262)..(262): Xaa can be any naturally occurring amino acid
  misc_feature (290)..(290): Xaa can be any naturally occurring amino acid
  misc_feature (316)..(316): Xaa can be any naturally occurring amino acid
  misc_feature (331)..(331): Xaa can be any naturally occurring amino acid
MAPLGDGGSCCRGGRPTTWWVSFGXEMLIDFVPDVAALSLAESGGFVKAPGGAPANVACAIAKLGGSSAFVGKFGDDEFGHMLVNILKQNNVXNSEGCLFDKHARTALXAFVTLKHDGERGXVCYRNPSADMLLTEXAELVLGLVRXPPGVFHYGSISLISEPCRSAHMAAMRAAQGPRGVLCSXYDPQRAASPLWPXSPDAAREGIXLSIWKEADFIKVSDDEVAFLTRGDANDEKNVLSAVGLTGLKLLVVTDGDKGCRXLHPRTSKGSVPRLQGSTPVDTHPGAGDXRFVGSLLVNVAKDDSIFHNEEKLPRXALKFSNACGAICTTXKKGAIPALPTVATAQDLIAKAN

SEQ ID NO: 7119 - protein, 367 aa, Zea mays
ASKYCFMGGFDATSNVLAGNLFGIPLRGTHSHAFVSSYMSLDEIPNKALRNKDGSRVCEDFVSLVQEWLQKFQAADSLGGVFGDTNKSELAAFASYALAFPSNFLALVDTYDVIRSGIPNFCAVALALHDLGYKASGIRLDSGDLAYLSIEARKVFRAVEKEFNLPGFAKMVITASNDLNEETIDALNKQGHEVDAFGIGTYLVTCYSQAALGCVFKLVEINNRPRIKLSEDVAKVSIPCKKRCFRLYGKEGYPLVDIMIRESEPSPKAGERILCRHPFIESKRAYVVPQHVEELLQYYWPGTSDKPRAELPSLEKIRSRCMQQLEKLRPDHIRRLNPTPYKVSVSAKLYDFIHCLWLNEAPVGELQ

SEQ ID NO: 7120 - protein, 300 aa, Zea mays
  misc_feature (105)..(105): Xaa can be any naturally occurring amino acid
  misc_feature (126)..(126): Xaa can be any naturally occurring amino acid
LQDPTAQTEIDNFMVQQLDGTKNEWGWCKQKLGANAILAVSLAVCKAGASIKRIPLYQHIANLAGNKQLVLPVPAFNEFMILPTGAASFKEAMKMGVEVYHHLKXICLNVGQDAANVGDEGGYENXEGLELLKTAIEKAGYTGKAHHILVVIGMDVAASEFYSDKDQTYDLNFKEENNDGSQKISGDSLKNDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTLLRIEEELGAIAVYA

SEQ ID NO: 7121 - protein, 103 aa, Zea mays
GNQEVVSVFGVDRDNMSNFKAGYGHFSTNVKGVFAAGDCRRGQSLVVWAISEGRQAAAQVDNYLVKEDKDHRNQDGLVKRQQGLYKKQHGSSKHTVMTYRWLL

SEQ ID NO: 7122 - protein, 315 aa, Zea mays
MGSGNLIVKKVVKHSSFDLDIQLDKSWMEDVTCPICLDYPHNAVLLRCTSYEKGCRPFVCDTDQTRSNCLERFKSAYELPSNAKVSSFAMPPLDSIIHIVPSNANNRPSCPLCRGDVIGWIVIGEARQHLNQKKRCCEEDCCSFVGNFNELQKHTQQKHPDSRPSEIDPARQVDWENFQQSSDIVDVLSTIHAQVPNGIVLGDYVIEYGDDDTGEDYEVFRGVRTHWWSCIFCKAFSRSSRSRRRARERRGSGRRIGNQANLENFNIEVPAQSVELREIRFDEIDDEYIVTGAIPSMATPGRMASFHYRDTRYGR

SEQ ID NO: 7123 - protein, 500 aa, Zea mays
  misc_feature (239)..(239): Xaa can be any naturally occurring amino acid
MGSSSSHQRSKTRSRNRKPLGIQLLERVRGSPISFRSCQALVLVLTFLSYASYHATRKTTSVVKSVLDPKTKTNLGTSSAHYWPPSHLFYLHNLKDADNNSSSGGGWAPFNAAEDGTALLGEIDLAFLGAYAAGMFFAGHLGDRVDLRVLLTVGMVGTGLFTAAFGAGYWLDVHSFYYFLAVQMVAGLFQSSGWPSVVAVVGNWFGKSKRGLIMGVWNAHTSVGNISGSLIAAAMLRRXDLCLEDDEKKPSDMDAPLLERERRRADVEEMAVGFIEAWRIPGVAPFALCLFFCKLVAYTFLYWLPFYISHTAIGGEYLSDSAAGVLSTLFDVGGVVGGILAGHISDHLDARALTAASFTFSAIPALFFYRVYGNVSLAWNIALMFVTGMLVNGPYALITTAVSADLGTHSSLNGNSRALATVTAIIDGTGSIGAAVGPLLTGYISARSWSAVFTMLMASALVAGLLLSRLVAAEVVAKMESRRTPAPADSDLPVSSMDEP

SEQ ID NO: 7124 - protein, 943 aa, Zea mays
  misc_feature (731)..(732): Xaa can be any naturally occurring amino acid
  misc_feature (747)..(747): Xaa can be any naturally occurring amino acid
MHLKLWKPLSHCAALLLDKKNRPPRTPPAGAGAGSGGGRRLQESKLREALEEASEDGSLAKSRDAALLDGGDGGAEEGSVGRSRSLARLHAQRDFLRATALAAERAFQSPDALPVLEEALAKFLVMYPNYASASDVDRLRADEYPHLDKVCLDYCGFGLFSYLQSCNPADSSAAFTLSEITANLSNHALYGAAEKGTAEHDIKNRIMDYLNIPESEYCLVFTVSRGSAFRLLAECYPFGTNKRLLTMFDHESQSVNWMTQVARDKGAKAYSAWFKWPTLKICTTELRKLISTKKRRRKDSATGLFVFPVQSRVTGAKYSYQWMALAQQNHWHVLLDAGALGPKDMDSLGLSLFRPDFIITSFYRVFGADPTGFGCLLIKKSVMACLQSPSGGTGAGLVRIVPVFPQYLSDSVDGFDGVLDGLEDDNIIPIEEGSASNSHHAPHLPAFSGAYSSAQVREVIESEMDQDSSDRDGASTIYEESESVSVGEVMKSPVFSEDESSENSFWVDLGQSPPGSDHSEQSSKGKLGSPLPASWFSGRKKASPKVPSKLSRSPVHDKHVLSFDAAVRSVSQEPGPVEVVPEEDHSRNGIKNIHISEIEEDNRDGKVNKRFVKFSCANGPAEGEGSATSVFGTCTARENGSTSEICSETQAETKESAIRRENEGDFRLLGRREAHNGRFNGGGRFFGVEEPERVPSMGRKVSFTLDDSRLCRNADAGETARFATADHDDDXXYSDYDEAQDGRKEPXEIVCRHLDHVNMLGLSKTTLRLRYLINWLVTSLLQLRLPDSGDGEGAAAAAAPPLVYIYGPKIKYDRGAAVAFNVKDCGSGTSLINPETVQKLAEKEGLSLGVGFLSHIRLTDSQRHGAADVGLSSSSSPAAASGRREKKSTRKNAVVGTEVVTASLGFLTNFEDVYRLWAFVAKFLDSSFLEQERLSSIPEDAER

SEQ ID NO: 7125 - protein, 448 aa, Zea mays
VFIAISIILGDGLYNLVKIFIVVGRGLCSMQSKQHELPVQALEAADDGSCEQLADEKLQTEIFLKDSISPWFAASGYIVLAAISTASVPAIFPQLKWYLVLLCYFFAPVVAFCNSYGMGLTNLNLAPTYGKIALFAFASLVGSDGGGVIAGLAACGIVMSVACSTADLMQDLKSGYLTLSSPRSMFTAQLIGIALGCVIAPLTLWLFWTAFDIGDPDGEYKAPFAIMFREMAILGMEGFSALPLHCLDICYAAFFLALATSLLKDVAPANVSRFIPIPIAMAAPFYVGAYFGVDMFIGTAILYAWQKLNREQADGYAVAVASGLICGDGIWSIPSALLSILGAVPPICMSFEASSAPSAGNWAVPGRPGPSPSCFVPNGFGPRKPKQFLGRAVPARSVKTVAQPGPKPRRAFVGPCRPKPGPLGLIGPCRPKPGPSMRAVLGARRVGI

SEQ ID NO: 7126 - protein, 618 aa, Zea mays
MRPPSSGKKTEVSHNVEKCGVSDQACHGKCQSCGIDAKPFCAGVNEVSLLTGSHTGVEASKENCGACSFNNDRADALEEEAKVSTARIGHVESADPGGSVGVEKEIFMAVNEESEGEQAGATLEDLFFFNGEEDDDSDWEPASRLVVNRWFCLNCTMPNVDKITYCMNCRELPGSVVDGYDVFKKQIAQTALLSADTGLLPVSTAIGFDERMLLHSELEVKPNPHPERPDRLRAIAASLAAAGIFPSKCALVPPREITKEELLMVHSPDHIESVEQTKNMLYSYFTSDTYANGHSACAAKLAAGLCADLASLIVSGHVRNGFALVRPPGHHAGVKQAMGFCLHNNAAVAALAAKRAGAKKVLIVDWDVHHGNGTQEIFDRDKTVLYISLHRHEDGNFYPGTGAAHEVGVLDGQGFSVNIPWSRGGVGDDDYIFAFQTVVLPIASEFAADITIISAGFDAARGDPLGCCDVTPTGYSWMTSLLAGSSNGRLLVILEGGYNLRSISSSATEVVKVLLGEGPNRASFVVSPSKEALRTVSQVLKIQQQFWPVLGPTYASLQAQQGSVSSNHSNELKKRKRSGGGPGPFWWKMGSKRLLYEALIEPRSRPRKLKGSTGSAAP

SEQ ID NO: 7127 - protein, 394 aa, Zea mays
  misc_feature (85)..(85): Xaa can be any naturally occurring amino acid
MLPSRRKSAVLGVVALSSSVLVLLHAFSLPAASALSVGLARRHRHDATPGLAAGGCDVFSGSWVLDGGSSASAAYTGYNCPLIRXEFNCQLYGRPDSDYLRYLWKPAGCELPRFDGADFLTRMKGKTVMFVGDSLGRNQWESLVCLLHAAAPQSPAQLVSADPLYTYKFLEYQVTVSFHRAPYLVDIDVVQGKRVLMLDDISENAESWRDADVLSFNSGHWWTHIGSMQGYGRWDYMGESGRYYEDMDRTVAFQRGLTTWASWVDLNLDQAKTRVFFQSMSPTHYSSKEWPNPVSKNCYGETAPATGLNSTGQASGQDQVIQAVLRGMKSPVRLLDITALSAMRKDAHPSAYSGDFSPAQRANPGAGSVDCSHWCLPGLPDTWNQLFYTLLFYK

SEQ ID NO: 7128 - protein, 387 aa, Zea mays
MRARKAKTATSSFWRSLLGGCLGGGGGGGRAAGDRQRKVRPGGGGGRLSFTDLSGAADQDLSASLVGSNLHVFSVAELREATRGFVSGNFLGEGGFGPVYRGFVADGVKKGLKAQAIAVKLWDPEGAQGHKEWLAEVIFLGQLRHPNLVKLVGYCCEDEHRLLVYEYMEHGSLENHLFKQIPAVLPWSTRLNIAVGAAKGLAFLHDAEKPVIYRDFKASNILLDSDYKAKLSDFGLAKDGPEGDDTHVSTRVMGTHGYAAPEYIMTGHLTAKSDVYSFGVVLLEILTGRRSVDKTRPSREQNLVDYARPCLKDPLRLGRIMDPAMEGQYSPRAAQSAALVAYRCLSGSPKNRPDMSAVVRALEPLLDLHDDVPVAPLGHAGPVVLFV

SEQ ID NO: 7129 - protein, 112 aa, Zea mays
  misc_feature (44)..(44): Xaa can be any naturally occurring amino acid
NPPKSFFRQMAAMAAQVPDWSKVVVAYEPVWAIGTGKTATPDQXAQEVHQQLREWFSKNVSPQVAESVRIIYGGSVTGANSQELARKPDIDGFLVGGASLKPEFVQIAKARD

SEQ ID NO: 7130 - protein, 187 aa, Zea mays
  misc_feature (41)..(41): Xaa can be any naturally occurring amino acid
AALGGAFRDNVRWLLKQWRCVPGSVSAWRALLSDERTGALXPVIAVEELAASSPLPLCDLCRCAGWSHHWVSKRKYHFIIPAVVDWDRPFRADGLLGHSEHLLHGLIHSNGFGHLLTLRGRVGGSTFLSGCQIMDIWDQLCTALRVRAVSVVDLTQKYSVDLRLLLGVAQSKTWFTRWGYCLAKGCF

SEQ ID NO: 7131 - protein, 593 aa, Zea mays
MAFWWPLLVLAAAYALCRLLLFLIPPTVPSIDVDASDVLAKEDSFIYIPRRGKSTQTDKVQCYEPATMKYLGYFPVVTPDEVKEHVAQSRKAQRIWAKSSFKQRRQFLRILLKYILEHQDLICEVSSRDTGKTMVDASLGEIMTTCEKITWLLDEGEKWLKPEYRSTGRSMLHKRAKVEFYPLGVIGAIVSWNYPFHNVFNPVLAAVFSGNAAVIKVSEHATWSGCFYFRIIQAALSAVGAPENLVHIITGFAETGQALVSSVDKIIFVGSPGVGKMIMKRASETLIPVTLELGGKDSFIVCEDVDLPSVVQVATRAALQSSGQNCAGAERFYVHDDIYSAFVSQIVKTVKSISVGPPLSGRYDMGAICMIEHSEKLQNLVNDALDKGAEIAVRGSFGNLGEDAVDQFFPPTVLVNVDHTMKIMQEETFGPIIPIMKFSSDEEAIKLANDSKYGLGCAVFSGNQKRAIRIASQLHCGVAAINDFASSYMCQSLPFGGVKDSGFGRFAGVEGLRACCLVKSVVEDRLWPYIRTVIPKPIQYPVSEHGFEFQQLLVETLYGYSVWDRLRSLVNLIKMVTEQNFAPTSNATTKKRR

SEQ ID NO: 7132 - protein, 612 aa, Zea mays
MVFASGSAAGGPQVLTARFVRQVVQGRWFMVFACLLILSASGATYIFSIYSKVLKSTLGYDQRTLNTLSFFKDLGANVGVISGLINEVTPPWVVLAMGAAMNLAGYLMIYLAIDGRTARPPVWLMCIYICVGANSQSFANTGALVTCVKNFPESRGVVLGLLKGFVGLSGAIFTQLYLAIYGDDAKSLVLLIAWLPAAVTILFVHTVRIMPYPRASRRRGPSAAATSNDAFFCFLYISIALATYLLVMIVVQKQVNFSHAAFAVSAAALLLILFLPLAVVVKQEYKIQKELEESLREDPTVTVEKPATAASLQLVAAAAAAPEPAVAQSMTTGTEAKPSSCLGSCLRHMFSPPAQGEDYTILQALVSVDMLVLFLATICGVGGTLTAIDNMGQIGQSLGYPAKSINTFVSLISIWNYAGRVTAGFASEVFLARYKFPRPLMLTLVLLLSCVGHLLIAFGVPQSLYVASVVIGFCFGAQWPLLFAIISEVFGLKYYSTLYNFGSVASPIGAYVLNVRVAGALYDVEAAKQHGGSLAGGADKTCIGVQCFRKAFLIITAATVAGALVSLVLVWRTRNFYRGDIYAKFRDSADADAAEERAEAEIGSTEVNGRKQ

SEQ ID NO: 7133 - protein, 377 aa, Zea mays
CTYDLELLCIYLDRAPTVSEEESSSTGYPSKMLADARYISQTLKLGALGIPSYRAFSLVELEAATNNFENSHLLGQDSHGEMYRGRLGNGTPVTIRTLKMKRSQTAQSFNRHIETISRLRHQNLVSALGHCFEYNLDESTVTQLYIVFEYVQNGNLRSRISQGTEGCRLTWSQRISAAIGVAKGIQFLHGGIIPGLVGNDLRITNVLVDQNHVAKIGSYNIPILAEAMRSEQGGAGNKLQADSRVKSDKTDIFDFGVILLEVVSGKTITSMYEVEILKELLAWAIADEDRVRRRSFADPAVSKGCSDESLRTVMEICQRCLAKEASQRPSVEDVLWNLQFAAQVQDDWETDAWSSGGGSPVSSSSRATRPSRLHLSR

SEQ ID NO: 7134 - protein, 509 aa, Zea mays
MMIARRLLRPNAPAQASSLLKHVTGTASLQGYADSLLDATVRHFGSAPSAQPEENGFKGHGMLAPFTAGWQSNDLHPLIIERSEGSYVYDINGNKYLDSLAGLWCTALGGSEPRLVKAATEQLNKLPFYHSFWNRTTKPSLDLAQEILSMFTAREMGKVFFTNSGSEANDSQVKLVWYYNNALGRPNKKKFIARSKAYHGSTLVSASLTGLPALHQKFDLPAPFVLHTDCPHYWRYHLPGETEEDFATRLATNLENLILKEGPETIAAFIAEPVMGAGGVIPPPKTYFDKVQAVVKKYDILFIADEVITAFGRLGTMFGCDYYNIKPDLVSLAKALSNAYVPIGATLVSPEISDVIHSQSNKLGSFAHGFTYSGHPVACAVAIEALKLYRERDIPGHVKQIAPKFQDGIRALADSPIIGEIRGLGMIMGTEFTNNKSPTDLFPAEWGVGAIFGEECQKRGMLVRVAGDAIMMSPTLIMTPGEVDELVRIYGEALKATEERVAALQSKKN

SEQ ID NO: 7135 - protein, 88 aa, Zea mays
  misc_feature (68)..(68): Xaa can be any naturally occurring amino acid
HEALFRLHLALGLGSIRPPIPSRKINENKLLSKKNRWTPYGNTKCIICKQQVHQDAKYCHTCAYSNGXVCAMCGKQVLDTKLYKQSNV

SEQ ID NO: 7136 - protein, 103 aa, Zea mays
AEMLYGLIHARYILTSKGLAAMLEKFKNYDFGRCPRVYCCGQPCLPAGQSDVPRSSTVKIYYIDGSYFGTTFPHLFLMTYSHLKPQKPSQQYTPRVFGFKLHK

SEQ ID NO: 7137 - protein, 260 aa, Zea mays
MDRKRIKDALEKHLERSSPSTSRGVVSKERERLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAMLEKFKNYYDFGRCPRVYCCGQPCLPAGQSDVPRSSTVKIYCPKCEELNYPRSKYQGNIDGSYFGTTFPHLFLMTYPHLKPQKPSQQYTPRVFGFKLHKPS

SEQ ID NO: 7138 - protein, 243 aa, Zea mays
  misc_feature (160)..(160): Xaa can be any naturally occurring amino acid
MDRKRIKDALEKHLERSSPSTSRGVVSKERERLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAXLLGLHQLPPGQSDVPRSSTVKIYCPKCEELNYPRSKYQGNIDGSYFGTTFPHLFLMTYSHLKPQKPSQQYTPRVFGFKLHKPS

SEQ ID NO: 7139 - protein, 617 aa, Zea mays
MASISGAAAAPSSAACRLRLRRHLLLRPSHLRLRAPHSIADLSRSSSSSNSAPTRAQPLGSRPENGGGVRAVEKDPIKLWERYVEWLYQHKELGLFVDVSRMGFTEDFLRQMEPRMQRAFAAMRELEKGAIANPDEARMVGHYWLRDPALAPNSFLRSKIETTLDRILAFSQDVVSGKIQSPSGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLAGAALMDEETRNTVVKENPAALLALCWYWASEGIGNKDMVVLPYKDSLLLLSRYLQQLVMESLGKEFDLDGNRVNQGLSVYGNKGSTDQHAYIQQLREGVHNFFVTFIEVLRDRPAGHDWELEPGVTCGDYLFGMLQGTRSALYANDRESISVTVQEVTPRAVGALVALYERAVGLYASLVNINAYHQPGVEAGKKAAGEVLALQKRVLTVLNEATCKDPCEPLTIDEIADRCHCPEDIEMIYKIVQHMAANDRAIIAEGSCGSPRSVKVYLGECNVDEDLQAA

SEQ ID NO: 7140 - protein, 344 aa, Zea mays
MEQAAMPQVPRVKLGIQGLEVSKLGFGCMGLTGTYNAPLGDEAVAAVVAHAFRRGITFFDTSDAYGPRTNETLLGKALKQLPREQVQVATKFGIGQGAAGMTVCGTPEYVRACCEASLRRLDAGYIDLYYQHRVDTTVPIEDTIGELKKLVEEGKVKYIGLSEASPDTIRRAHAVHPITAVQMEWSLWSRDIEPEIVPLCRELGIGIVAYSPIGRGFFGGRGVIQQVSSESSLQRHPRFTTESLEKNKQIYLKIEDLAKKYQCSPAQLALAWVLRQGDDVVPIPGTTKIKNLDSNIDSLKVKLTDEDLKEMGSQIREEDVAGGRQFTSFAHTTWKYADTPKKQS

SEQ ID NO: 7141 - protein, 89 aa, Zea mays
  misc_feature (66)..(66): Xaa can be any naturally occurring amino acid
RTPLAMAMAIPFYLGPYFGSLVRLVWDRLDPARAKAFASHVASGVICGDGIWTLPQSVLALAGVKXRPPICTKFLSRSTNAKVDAFFRS

SEQ ID NO: 7142 - protein, 466 aa, Zea mays
  misc_feature (306)..(306): Xaa can be any naturally occurring amino acid
MHPSIQIYAVVLCIVPSFFSCNAEDARPPQTQSSLVLGLSHVRSLYTPSLTLVNSTGYDFLDIVEPVTAYTDGYLLSLNLGTPPQVFQVYLDTGSDLTWVPCGSSGYQCTECGGSSSVTPPPTTTFLPSESSSNGGDLCGSRFCVDVHSADNRFDPCAAAGCAIPAFTGGLCPRPCPPFSYTYGGGALVLGSLSRDSVTLHGSSGAGGPLPVAFPGLCFGCVGSSVREPIGIAGFGRGALSLPSQLGFLGKGFSHCFLGFRFARNPNFTSPLVMGDLALASSATDGFVFTPMLTSATYPNFYYVGXEGVDLGGGGVDAQGNGGVLVDTGTTYTHLPDPFYASVLSSVGAAAPYERSRELEARTGFDLCFRVPCARAPCADDELPALSLRLRGGGRLALPKQSSYYPVTAIRDSVVVKCLLFQRMEDGDGGPAAVLGSFQMQNVEVVYDLAAGRVGFRPRDCALHAA

SEQ ID NO: 7143 - protein, 618 aa, Zea mays
  misc_feature (138)..(138): Xaa can be any naturally occurring amino acid
  misc_feature (159)..(159): Xaa can be any naturally occurring amino acid
  misc_feature (231)..(231): Xaa can be any naturally occurring amino acid
  misc_feature (248)..(248): Xaa can be any naturally occurring amino acid
  misc_feature (258)..(258): Xaa can be any naturally occurring amino acid
MGPLLRAAALSVALLALAAVGEAHSATEFLNIFKPRNEHDYFHNANQEEDVMPRASDQQNLITAPVTKSGLMKVPPRSAPTAVAQDTVVLPVDSAAGFPGAWSIISENAGVSAMHMVIMRSDKFIMFDTFTTRPSLLXLPVGSAAGVESGTITDAQPAXAQATGYAASTAVPTWQKAWTDEMCSSGSLNDNASGVETIACRVWQENAKVFTRLGSSLTTEWSEDVPEGRWXWMQQPLPDGRAIVLRGXRGVRVVVAPXCGLSNAQAIPLQILRDTTDDVENNLYPFVHLLPDGTLFIFANDRSILFDPRNGQVVREFPVLPGGGRNYPASGMSALLPLDLRRGDVLSPEVIVCGGSPKNAFTLGESNTFPPALKDCARINPLKPDARWALDQMPVARTMGDLLILPTGDLLILNGAAKGCSGWGFGRQPVLSPLLYSPRQARGSRFRALAPTTIPRMYHATSAVLPDATVLVAGSNTNSAYNFSGVDFQTEVRVERFTPPYLAPERAANRPAIDVATVPGDGMAYGAKFTFQFSTPVQAVAEPDLKVTMYAPPFTTHGYSMNQRLLVLSVTAFAANGQRYTITVDAPGKPELAPPGYYLLYVIAKGVPSKAAWVKVHK

SEQ ID NO: 7144 - protein, 384 aa, Zea mays
MARLLLLGAAVLLLASAATAQDCLSATFSGGRTFGRCNNLPSLSASLHWTYHPENGTADVAFRAPSDASGWVAWGINPDRGGSMGGSSVLVASPSQDGSGAVSILMTHLESTSPSLTNNTLKFKVPVGPAAEYSNGAYTIFATVELPGNSTQQFTVWQAGATSNGAISPHPTAPANLASTQRLDFLSGSSTAASNSRLHRRNIHGMLNAIAWGVLIPTGAIIARYLRVFESADPAWFYLHIACQCSGYVLGVAGWGLGLKLGSESAGVTYQPHRSIGIAIFCLATLQVLALLLRPDKKNKYRLYWNIYHHSVGYAVIVLSAVNIFKGLHILEPASGYKTAYIVILATLAGIALCLEAITWPIAIRKRRRNADKASGGNGWQQGA

SEQ ID NO: 7145 - protein, 387 aa, Zea mays
MARLLLLGAAVLLLASAATAQDCLSATFSGGRTFGRCNNLPSLSASLHWTYHPENGTADVAFRAPSDASGWVAWGINPDRGGSMGGSSVFVASPSQDGSGAVSILMTHLESTSPSLTNNTLKFKVPVGPAAEYSNGAYTIFATVELPGNSTQQFTVWQAGATSNGAISPHPTAPANLASTQRLDFLSGSSTAASNSRLHRRNIHGMLNAIAWGVLIPVGAIIARYLRVFESADPAWFYLHIACQCSGYILGVAGWGLGLKLGSESAGLTYQPHRSIGIAIFCLATLQVFALLLRPDKKNRYRLYWNIYHHSVGYSVIVLGAVNIFKGLDILKPASGYKTAYIVVLATLGGVALCLEAITWPIAIRKRRRNAADKASNGNGNGWQQGA

SEQ ID NO: 7146 - protein, 369 aa, Zea mays
MTDGSDEYKRDESVILLVIVSLAALSLLSLIAAFAYYCYITRKVSRRLQSLHLPKRSSSPPPTPPPRALPPPQQQGKDSPFSSSASDGAAAAAAAMSVVVAGERGVQVFSYRQLHAAMGGFGRAHMVGQGSFGTVYRGVLPDGRKVAVKLMDRPGKQGEEEFEMEVELLSRLRSPYLLGLIGHCSEGGHRLLVYEFMANGGLHEHLYPTRGSCGGISKLDWDTRMRIALEAATHASAHASGVNPPVIHRDFKSSNILLDKDFHARVSDFGLAKLGSDRAGGHVSTRVLGTQGYVAPEYALTGHLTTKSDVYSYGVVLLELLTGRVPVDMKRPPGEGVLVNWALPMLTDREKVVRILDPALEGQYSLKDA

SEQ ID NO: 7147 - protein, 155 aa, Zea mays
PPARLLGTGNGSRTLSFGSNGTSRAVSGSSRMGGGIGVSTSASGSQGMANYDGKGSYIIFNTADTLFISDLNSHDKDPIKSIHFSSSNPLCHAFDPEAKDGHDLLIGVFSGDVYSMSLKHQLQDPGKKPVSYQHFVNKDKDKDKDPSQGGAARVP

SEQ ID NO: 7148 - protein, 392 aa, Zea mays
PASATRPVAGEEAAASAAASPSASASPTRAAGHASADAWERRLWVKDRSRAWWDRCNSADYPEEEFRRAFRMGRGTFDMICDALGSSVAKEDTMLRAAIPVRQRVAVCVWRLATGEPLRLVSKRFGLGISTCHKLVLEVCAAIKSVLMPRFLQWPDADAAARFKEGFERASGVPGVIGAMYTTHIPIIAPKISVAAYFNRRHTERNQKTSYSITLQGVVGPDGAFTDVCIGWPGSMPDDQVLEKSMLHQRAAAGMMHDSWLVAGASYPLMDWVLVPYTHPNLTWTQHAFNEKVAELRRVAVEAFARLKARWACLQKRTEVKLQDLPVVLGACCVLHNICEIRGEEVDPAIRCELVDDETTPENPVRSETASRARDNIAHNLLHRGLGGNTFF

SEQ ID NO: 7149 - protein, 571 aa, Zea mays
MGCVHGRPATSSPAPAATSSSRRDHPTASQTHKDGVDSAAAAPPVDAEAPEQQAAEKPQKVKRERRSRSSRSAAFAAHTEVRLGGSFANKARGEQVAAGWPAWLSAVAGEAIEGWTPRRADGFEKIDKIGQGTYSNVYKARDSLSGKIVALKKVRFDNLEPESVRFMAREILILRRLDHPNVVKLDGLVTSRMSCSLYLVFDYMVHDLAGLAASPDIKFTLPQVKCYVHQLLSGLEHCHNRGVLHRDIKGSNLLLDNNGVLKIADFGLASFFDPNHKQPMTSRVVTLWYRPPELLLGATDYGVGVDLWSAGCILAELLAGKPIMPGRTEVEQLHKIFKLCGSPTEEYWKKSKLPHATIFKPQQPYKRRIADTFKDFPQSALRLIETLLAIDPADRLTATSALNSDFFATEPYACEPSSLPQYPPSKEMDAKRRDEEARRLRAAGGRGNGDGTRKTRTRDRPRAVPAPEANAELQANIDKRRLITHANAKSKSEKFPPPHQDGALGFPLGCSNHMEPSFEPPDPSSFSTVFPFEKSAVPTWSGPLADSAAGNQKRKHKSARSSKQPATARAR

SEQ ID NO: 7150 - protein, 686 aa, Zea mays
  misc_feature (634)..(634): Xaa can be any naturally occurring amino acid
QSSQTWSLLKIQQLLSYPPVLRTWGNGTDFCYGGDYKTASAFVECYGDSVTQLHIMGPGGAPPLPKTFSLDALFTTLTRLPDLRVLTLTGLGLWGPLPGKVSRLASLEIVNVSGNYLYGQLPEGLSRLGGLQTFIADDNMLSGELPGWLGRLASLAVLSLRNNSLQGAVPESVRDMGSLRSLALACNNLSGQVPDLSALTNLQAVDLSNNSLGPAFPRLGRKVASVVLSGNRFGNGVPAEEVASLYLLERLDVSRNRFVGPLPPALLALPSIEYLSVAGNRFTGLLAANMSCGENLRFVDVSSNLLTGTLPSCLKTLPSSSNSKQVTVLAASNCLSGGAGSTQHPALFCQNQALAVGIVPVQARGGGKAKGKAGAVAGAVAAALAAALLAGVAAFLFARRAAVRRAKARPPRRLVEHAASSMSVGGGGAYPSQLFADARYILQTVNLGALGVPAYRSFSLVELEAATNDFEVSRLMGQDAHGQMYRGTLGNGTVVTIRSLWVRRSQTSHAFNRHVEMISRLRHRHLESAVGHCFHCIPDDTTEARLALLFEYVHNGNLRSRISQGTEGRKLPWVQRISAAIGVAKGIQFLHGGIMPGLFANNLKITNILLDQNLVAKIGSYNIPILAETAKSEXNHDARSRRQPFLLHSQSQRDKIDIYDFGVILLEVVTGRPITSIHEVEVMKEQ

SEQ ID NO: 7151 - protein, 670 aa, Zea mays
YPPVLRTWGNGTDFCYGGDYKTASAFVECYGDSVTQLHIMGPGGAPPLPKTFSLDALFTTLTRLPDLRVLTLTGLGLWGPLPGKVSRLASLEIVNVSGNYLYGQLPEGLSRLGGLQTFIADDNMLSGELPGWLGRLASLAVLSLRNNSLQGAVPESVRDMGSLRSLALACNNLSGQVPDLSALTNLQAVDLSNNSLGPAFPRLGRKVASVVLSGNRFGNGVPAEEVASLYLLERLDVSRNRFVGPLPPALLALPSIEYLSVAGNRFTGLLAANMSCGENLRFVDVSSNLLTGTLPSCLKTLPSSSNSKQVTVLAASNCLSGGAGSTQHPALFCQNQALAVGIVPVQARGGGKAKGKAGAVAGAVAAALAAALLAGVAAFLFARRAAVRRAKARPPRRLVEHAASSMSVGGGGAYPSQLFADARYILQTVNLGALGVPAYRSFSLVELEAATNDFEVSRLMGQDAHGQMYRGTLGNGTVVTIRSLWVRRSQTSHAFNRHVEMISRLRHRHLESAVGHCFHCIPDDTTEARLALLFEYVHNGNLRSRISQGTEGRKLPWVQRISAAIGVAKGIQFLHGGIMPGLFANNLKITNILLDQNLVAKIGSYNIPILAETAKSEGGGGGGGSKYPSDSRVPPNGDKIDIYDFGVILLEVVTGRPITSIHEVEVMKEQ

SEQ ID NO: 7152 - protein, 84 aa, Zea mays
IIPQLVAGKHVMVAAHGNSLRSIIMHLDKLTSQKVISLELSTGIPMLYIFKEGKFIRRGTPVGPSEASVYAYTRVRFFPPHVLP

SEQ ID NO: 7153 - protein, 381 aa, Zea mays
  misc_feature (295)..(295): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNINAMISAFECVHDGWGVAVXLLGVPHKDDQFKTHPMNFPSEKPLKGTFFGNYKPRTDLPNVVEMYMKKELELEKFITHSVPFSEINTAFDLMLKGESLRCIMRMED

SEQ ID NO: 7154 - protein, 434 aa, Zea mays
MLRAAASRCARGAVRRLSSSAVMEASPVAVGSRWQSLLDEGDWSYHREWWGEEDGPGEGVQTVFRRHSECGNGVVSVSAYPASLPASEHWPAMERWLQESNSRLYPESASSDQFKVLGYQWRVMRFNDHTRQSTAKVMTCYRTSGQRSLFLMQQPHVLAVPYVKSMVSAGLTALSCSSYDLPQAASGQNTMKILCIGHGGGSLPLFLASKFRGATIHIVEIDPVVVSASVESMGFPASPVKGLSPESMLPSDADDLLWGGIHDRIFLHTADAEDFIGSDGNEYDIVFIDAYDGDDVFPRKLWDVDGAFMKSLEKRVHPVHGTVVVNLHSDSDSEAAEGNADFQSALPMGRHVSQVCRAYMQHFGVAFTAAVPWLCNITLVACRAGGMASGARRGLSRRDLVLGKLLSKSDTVERALGLPFPCLPYIKNGFTMVH

SEQ ID NO: 7155 - protein, 580 aa, Zea mays
MEQRNVLALDEHVLKATVWKRKHKTAMEHPEGNDVMVFSQHDQRKHPVIFDDRAKCKKSKLISCGSGVILESYWNFKTSGLPVRVLFYQHGDWSDFPEDVVNLAQQDFQLKKPITTAVFQNKHILLDFIHMICIDYEMTIDKPLAWVDDNGKRFFPDLSAGLYTSKPSQHENGEADECDGTPTSVAESSSSVSVGEVVSHGKRINDIAEDNMRAHNRLYEAVGENISGPSFHLNEYSSGTIQATGKPNNCRRIDSAVRNLLLKGLGQPFSEEDIIGIYRTPLLDQRGQVRCGLFQKEIEETRSRRGNANVRYAWLPCSRYTMEQMAMRGALEIAKPHKGSICGVGTCLAPANCTNSCARYSDFHEDGIIRMMLCRVIMGNVEVVLPGSKQFQPSNGSFDNGVDDLQNPQNYIVWDANVHKHIYAEYAVIVQAPLVTNECSGLKDSVPNISEIISSGSRDNLTKEDRFAPCGVEQEAPKLGRAPRAPSSPWMPFSMLFAAISTKVPRSDMELVIRYYEEFKRKRMSRSDLVVRMRQIVGDKILVSTIMRLHHQKKPPSMAAAAAGLARALARGEEGGGVAE

SEQ ID NO: 7156 - protein, 524 aa, Zea mays
MEMELDPFLGVVLATAVLLVAVLRRKRGSSRKYKMPPGPRPWPVIGNLNLIGALPHRSIHALSARHGAFMSLRFGSVPVVVGSSVETARFFLRTSDTSFIDRPRMAAGKYTAYDYSDIVWSPCGAYWRQARKLWKAHLFSDRQLRSQEHVRSEELRVLLHALSSSSSAGVAGRGRRAIALKEHLLMYSLNVISRMALGGKYVGEGGTTGSPISPAEFSWMVDELFLLNGVFCVGDFIPWLGWLDLQGYVGRMKRLGKMFDRFLEHVVDEHDQRRRREGGGFVPADMVDLLLELADDPKLEVPIERDGVKGFALDLIAGGTDSSAVTIEWAMSELLRKPEVLAKVTEELDGVIGHGRLVTEQDIPDLPYLEAVVKETLRLHPVTPLLAPRLCREDACTGTYDIPRGTLVFVNVWAIGRDPAVWGHDAEEFRPERFVGSAVDVKGHDLELLPFGSGRRMCPGYVLGLKMVQVTLANLLHAFSWRLPDSVAPEKLNMQEKFGLAVPRLVPLEAVAVPRLPPHLYAGP

SEQ ID NO: 7157 - protein, 64 aa, Zea mays
  misc_feature (29)..(29): Xaa can be any naturally occurring amino acid
MAGGRVAHATLKGPSVVKEIFIEMTLGTXFAGGMWKMHHWNEQRKTRSFYDMLDKGQISVVVEE

SEQ ID NO: 7158 - protein, 402 aa, Zea mays
  misc_feature (336)..(336): Xaa can be any naturally occurring amino acid
MEQGGKMAHGWAARDASGLLSPYSFSRRVQGDDDVTIKVLFCGICHTDLHIIKNEWGNAMYPVVPGHEVVGVVTDVGHGVSKFKAGDTVGVGYFVDSCRSCESCSTGHENYCPDLVLSSNGVDHHHHDGGASASATTKGGFSDVLVVSQDFVVRVPESLPPDGAAPLLCAGVTVYSPMVQYALNGPGKHLGVVGLGGLGHLAVKFGKAFGMTVTVISSSPAKREEALGRLGADAFLVSHDASQMKAAAATMDGIIDTVSAGHQIVPLLALLKPMGQMVVVGAPSTPLELPAYAIITGGKRVAGNGVGSVADCQAMLDFAAEHGVTADTEVVPMDYXQHRHRAAGEERCQVPLRRRRRGQPDGYRCLEAWMRSSIESCSSRRCAWCEIVCSCRLFVGGCGSIN

SEQ ID NO: 7159 - protein, 346 aa, Zea mays
MAAVVCVTGAGGFIGSWIVKILLARGYAVRGTSRREAADPKNAHLWALDGAAERLTMLQVDLLDRASLRAAFRGCDGVIHTASPMHDNPEEIIEPIIAGTRNVVEAAADAGVRRLVLSSTIGTMYMDPRRDPDAPLGDSSWSDLEYCKSTENWYCYAKTVAEQGAWEAARARGLDLAVVIPVVVLGELLQPSMNTSTLHILKYLTGQTKEYVNESHAYVHVRDAAEAHVRVLEAPGAGGRRYVCAERTLHRGELCRILAGLFPEYPIPTRCKDQVNPPKKGYKFTNQPLKDLGVKFTPVHGYLYEAVKSLQDKGFLPKTSGAKVPERRSYLPQTTSQPPPEIVSKL

SEQ ID NO: 7160 - protein, 74 aa, Zea mays
MAMGSLAFATALVFVFVFAIAVPAVAAAAQAPAPAPTSDGTSIDQGIAYLLMIMALVLTYLIHPLDASAPYKLF

SEQ ID NO: 7161 - protein, 513 aa, Zea mays
FEDLPRSPESLATRDFSANCSSSKMASRETTPDDSQVNEVESDLKETLSLNYEEARALLGRLEHQRGNFDAALQVLQGIDIRSLRPRMTTAIAESVKPRMPPRSSRRKSSQVNGMLMHMSMHSVSLLLEAILLKAKSLDTLGRAADAAEECRTIIDIIESAWPYGVPDGTSEECKLIDIFHSALEYLPKLWMRSGCFDEAIIAYRRALAKPWNLGSQRSAKLQKELAVSLLYCGVEVTPGNNLEEAILLLLMLTRKLFLREIQWDPDLVNHLVYALSLSGHYEVLASHLEMLLPGTYTRSERWYILALCYSAAGMDDSALNIIRNGFSVLERKGKPHVPSLLLGAKLCCKNPKHASEGIKFANKAMKSFRSRDLHFISTTKHFLGVCYGPFSRSSTSYLDKSRLQDNALRLLQDAATTAKYNPEIMYSLAWENAMQRKLNAAVESATECLEMVMGGSVSAWKLLILVLSAQQNLQEAEAVADFAMDEAEKNDQLDILRLKAQIQASRGQFKSA

SEQ ID NO: 7162 - protein, 523 aa, Zea mays
MAGGGIVNTGGGKDYPGKLTLFVLLTCIVAATGGLIFGYDIGISGGVTSMNPFLEKFFPEVYRKKQEAKTNQYCKYDNQLLQTFTSSLYLAALVASFFAATVTRAVGRKWSMLVGGLTFLVGAALNGAAQNIAMLIVGRILLGVGVGFANQSVPVYLSEMAPARLRGMLNIGFQLMITIGILAAELINYGTNKIKAGYGWRVSLALAAVPAAIITLGSLFLPDTPNSLLERGHPEEARRMLRRIRGTDDIGEEYADLVAASEEARQVRHPWRNILRRRYRAQLTMAVAIPFFQQLTGINVIMFYAPVLFDTLGFKNDASLMSSVITGLVNVFATVVSIVTVDRVGRRKLFLQGGAQMIVCQLIVGTLIAAKFGTSGTGDIAKGYAAVVVVFICAYVAGFAWSWGPLGWLVPSEIFPLEIRPAGQSINVSVNMFFTFCIAQAFLTMLCHFKFGLFYFFAGWVVIMTVFIAFFLPETKNVPIEEMVLVWKSHWFWKRFIADEDVHVGIGNNHPAKNGSDTKGADA

SEQ ID NO: 7163 - protein, 357 aa, Zea mays
MVCIGSLLRALVLSAAASAGRRRGPRILCGHEADVRVTPRHGHGWRRFRAVTGRMMLDSSDCASAAAAAETGQVQPQRRAVGAVPLAHDGGYASGGWEREDGKLSCGYSSFRGKRATMEDFYDVKLTEIDGQAVSLFGVFDGHGGSRAAEYLREHLFDNLLKHPDFLTDTKLAISETYQKTDTDFLESEASAFRDDGSTASTALLVGDHLYVANVGDSRAVISKAGKAMALSEDHKPNRIDERKRIENAGGIVIWAGTWRVGGVLAMSRAFGNRLLKPYVVAEPEIQEEQVSGGLECLVLASDGLWDVVENEEAVFLGRSEDTPESAARKLTEIAYSRGSADNITCIVVQFHHDKTG

SEQ ID NO: 7164 - protein, 446 aa, Zea mays
  misc_feature (62)..(62): Xaa can be any naturally occurring amino acid
MAVPMSAQIAAAVTPARSMLQRRPLTVSVVHNEAFEKVKRTPKANQLYQNSRRSGLPRIGSXLRFTWCARNPTEHHKKKHRSLESRGADFDAERRLYSHAFKKSSSLLSRLMKHKFGWVFNKPVDPVTLGLHDYFTIIKHPMDLGTIRGRLSRGQYRNPKEFAEDVRLTFHNAMTYNPKGQDVHFMAEQLLGIFEAQWPEIEAEVNYLASCPPLPKKFPPPPIDLRFLERSDSMRHHVALDTNSRPISHTPTYTRTPSMKKPRAKDPNKRDMTIDEKRKLSENLQNLPPVKLDAVVQVIKNKNLSVKQHDDEIEVEIDSMDAETLWELDRFVSNYKKNLSKQKRKAERAMLARQDAELRAQHPIQQPQPTPVPQEPFGEKSPKQVVKDSLEGEQLPASAPEQNGENRQNASSSSNSSSSSSGSGSSSSGSDSDSSSSDGSDAGNSS

SEQ ID NO: 7165 - protein, 121 aa, Zea mays
AIANSRRKTKIVCTIGPSTNTREMIWKLAETGMNVARLNMSHGDHQSHQKVIDLVKEYNAQNTDGNVIAIMLDTKGPEVRSGDVPEPLSSVVYTICVYKRGTSEATAGTLPGGHPYSHAVL

SEQ ID NO: 7166 - protein, 389 aa, Zea mays
  misc_feature (237)..(237): Xaa can be any naturally occurring amino acid
MNGGGEDGKQQPHLVLAHKLFLLSHPDVDDLAKVDLRADVFAAVKSDDMAALYESLAADGVLETDAALLAEMRARIDEEIRKLDEKIADAEENLGESEVREAHLAKSLYFIRVGEKEKALEQLKVTEGKTVAVGQKMDLVFYTLQIGLFYMDFDLISKSIDKAKNLFEEGGDWERKNRLKVYEGLYCMATRNFKKAASLFLDSISTFTTYELFTYDTFIFYTVLTSVISLDRVSLKXKVVDAPEILAVIGKVPHLSEFLNSLYNCQYKSFFVAFFSGLTEQIKLDRYLQPHFRYYMREVRTVVYSQFLESYKSVTMEAMATAFGVTVDFIDQELSRFIAAGKLHCKIDKVAGVLETNRPDERNAFYQATIKQGDFLLNRIQKLSRVIDL

SEQ ID NO: 7167 - protein, 204 aa, Zea mays
MAPTGDAAAAQAPAPKKQSAKSRRISIEGLQRAMSDLALELARDSKKQAATSADAAKLQQLPAIAEQQQQQQQTAEEEEEELARCECCGMQEECTPQYVRRVRDRYCGRWVCGLCAAAVSAEAEGGRATTEAALAAHMAVCGRFNRVGRANPVLLQTEAMRQILRKRGARCDSPRVRDRGARPAAAAALARSSSCIPAITKDFN

SEQ ID NO: 7168 - protein, 187 aa, Zea mays
MANDSLTRGHIIGDVLDPFTSSVSLSVLYDGRPVFDGMEFRASAVSVKPRVEIGGDDFRVAYTLVMVDPDAPNPSNPSLREYLHWMVTDIPASTDDSFGRELIPYESPSPTMGIHRLVLVLYQQLGRGTVFAPQVRQNFNLRNFARRFNLGKPVAATYFNCQRQTGTGGRRFTCVFDHVVQGEGRQA

SEQ ID NO: 7169 - protein, 85 aa, Zea mays
GSLALRAYVASSLLAVMFSVIVMKLNLTTGIIPSLNISAGLLGFFFVRLWTKAIESVGLLRQPFTRQENTVIQTCVVASYGLSFS

SEQ ID NO: 7170 - protein, 79 aa, Zea mays
EGKRILVPNSLFTRGEDQFFGDVFVKKGSPMFQIDVAPKKGGLAVNPNFFFDFGPQPDGPPLAPKIKYPGGGCPSYIWI

SEQ ID NO: 7171 - protein, 131 aa, Zea mays
GFGSYLFGMSETIASQAAEENNAGNVKEPRLAWMIGFLFLVSFVGLFALVPLRKVMIIDYRLTYPSGTATAHLINGFHTPDGSERAKSQVLTLIKSSVASFLWGFFQWFYTAGDGCGFGQFPALGLAAYQN

SEQ ID NO: 7172 - protein, 159 aa, Zea mays
MSETIASQAAEENNAGNVKEPRLAWMIGFLFLVSFVGLFALVPLRKVSLPLNHIAPGSSFASQTEKSEKSETDKKALGFAFQVMIIDYRLTYPSGTATAHLINGFHTPDGSERAKSQVLTLIKSSVASFFWGFFQWFYTAGDGCGFGQFPALGLAAYQN

SEQ ID NO: 7173 - protein, 175 aa, Zea mays
MAGGGGRGAAAAAASALALAALVCSLSCGLAQGRVARKSLGIGLGGGGGGGGDGLGLGLGLGLGVGAGTGGVSVSGSGSGSGSAPVVGSTSGSRSGSISVGGASSSAGSSAGSSAGSTGSAAGSSAGSGGGQGYGQGGGSGSGSVYGEGSGSGNGLVGIGTGQGYGHGSNFGGNP

SEQ ID NO: 7174 - protein, 495 aa, Zea mays
MCAYHMRLTGGAAFVLLMVLLLLLYAVHRWRNPRCSGRLPPGSMGLPLVGETLQFFSPEASLDVPRFVRHRLQRYGPIFKTSLVGHPVVVSADEELNYMVFQQEGQLFQSWYPDSFVEILGRDNVGEQQGAMFKYLKNMVLRYFGPESLRESMLRDVEHAVSSSLCTWSTLPSVELKEAVSTMVFDLSANKLLSLEPSRSKILRRSFFDFVRGLISFPLYLPGTAYYSCMKGRQSAMEVLQEVLAERKRLVQVPGAGGGAMETIRRHGGDFLDLVIQEVTKEKPLVTDRMALDLMFVLLFASFHTTSLALTLAVKLLADHPRVLEELTVEHEAILNERNARHGSDGITWMEYKSMTFTSQVINETVRLANIAPGIFRKALKDIQFRGFTIPAGWGVMVCPPAVHLNPVIYPDPLIFNPTRFKDKPEINRGSRHFMAFGGGLRSCVGADFSKLQMSIFLHFLVTRYRWRSLGGGKVVRNPGLEFPDGYHIQIRHWN

SEQ ID NO: 7175 - protein, 484 aa, Zea mays
FGSRGEVPASLQNLTQLTVLNLQDNSFSGSIPDLKLHSLKLLNLSNNELKGSIPRSLQKFPKGSFSGNHGLCGLPLAECSHPSLARSPESSPSPQSPPLTHHDKKLGTGFIVAVAVGGFALLMLVVVVCFSKRKGKDEIDVESKGKGTATRSEKPKQEFSSGGQIAEKNKLVFLEGCTYSFDLEDLLRASAEVLGKGSYGTAYKAILEDGTVVVVKRLKDVVAGKREFEQQMELIERLGKHANLLPLRAYYYSKDEKLIVYDYIDTGSVSAMLHGIRGVTAKTPLDWNSRMKVILGTAYGIAHIHSEGGAKLTHGNVKSTNVLVDQDHNPSVSDYGLSALTSVPVNASRVVVGYRAPEIVENRKITQKSDVYSFGVLLMEMLTGKAPLQTQGNDDVVDLPRWVHSVVREEWTAEVFDVELMKHQNIEEELVQMLQIAMVCTAKSPDRRPTMEEVIRMIEGLRQSTSESRASSDEKSKESNPPSV

SEQ ID NO: 7176 - protein, 354 aa, Zea mays
MHPKARIHADPVREVDHFDCLPDSLVLLILNKVEDVRSLGRCYAVSKRLCGLVPLVHDVYVKIDRVVAVDGDAEDALNLSSPKPRNIFSHFLKLMLFTIIKPFHNMRNPNGTGRSLFPQLSHHSPAQVLRNFTHIRNLRIELPSGDVGTEEGVLLKWRAEYGSTLQSCVILGGTRVDRKPVGGEHEQSLEDNGSMPESFYTNGGLKLRVVWTISSLIAASTRHYLLRSIINDHPTLLSLVLTDADGQGTLCMGAEQLKEFRENQLSASACSNRTQVPACNMKLKYAPYLELPGGMALQGATLVAIKPSPDGSNGSHPNRKEADAFVFGAFDGPFKAAVKALMKRRTYLLEMNGF

SEQ ID NO: 7177 - protein, 356 aa, Zea mays
  misc_feature (189)..(189): Xaa can be any naturally occurring amino acid
  misc_feature (197)..(197): Xaa can be any naturally occurring amino acid
MAAAAEHGNCDAWAARDPSGVLSPYKFNRRAVQSSDVSLKIIYCGVCYGDVMWIQNKHNDSVYPLVPGHEIAGVVTEVGADVKAFKVGDHAGVGTYVNSCRHCENCNSSLENYCPETVFTYNTTDADGTITKGGYSTHIVVHERYCFKIPDGYPLAQAAPLLCAGITVYTPMARHNMKQPGKSLGVIGXLGGLGHMXAVKFGKAFGLKVTVFSTSESKREEAINLLGADNFVISSDTQQMEALKNSLHFIVDTASGDHPFDPYLSLLKVGGVMTIVCFPSEIKMHPASLNRGGRTLSGSIVGGTKDIQEMVNFCAENKIYPEIEIIKMDYINEALARLVNRDVKYRFVIDIKNSFE

SEQ ID NO: 7178 - protein, 568 aa, Zea mays
MAATSAPPASAHANGNGSLVGVAAPVGAPTNPMATALLTDQYQFSMAYAYWKAGKHADRAVFDLYFRKNPFGGEFTVFAGLEECIKFIANFKFTEHDISFLQSVMPMCEGAFFNYLREVDCSDVEVYSIPEGSVVFPKVPLMRVEGPVAVVQLLETPFVNLINYASLVTTNAARHRHVAGKSKVLLEFGLRRAQGPDGAISASKYCFMGGFDATSNVLAGNLFGIPLRGTHSHAFVSSYMSLDEIPDKALKSKDGSRLCQDFVSLVQEWLQKIQAANSLGGVFGDTNKSELAAFASYALAFPSNFLALVDTYDVMRSGIPNFCAVALALHDLGYKASGIRLDSGDLAYLSIEARKVFSAVEKEYNVPGFAKMLITASNDLNEETIDALNKQGHEVDAFGIGTYLVTCYSQAALGCVFKLVEINNKPRIKLSEDVAKVSIPCKKRCFRLYGKEGYPLVDIMIRESEPSPKAGERILCRHPFIESKRAYVVPQHVEELLQCYWPGTSDKPRAELPSLEKIRSRCMQQLEMLRPDHIRRLNPTPYKVSVSTKLYDFIHRLWLNEAPVGELQ

SEQ ID NO: 7179 - protein, 255 aa, Zea mays
MATAGKVIKCRAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQGITKLINAILGLIFLHQSSSD

SEQ ID NO: 7180 - protein, 826 aa, Zea mays
  misc_feature (91)..(91): Xaa can be any naturally occurring amino acid
  misc_feature (121)..(121): Xaa can be any naturally occurring amino acid
  misc_feature (152)..(152): Xaa can be any naturally occurring amino acid
  misc_feature (432)..(432): Xaa can be any naturally occurring amino acid
  misc_feature (691)..(691): Xaa can be any naturally occurring amino acid
MATPSHLLLVVFTALLALLPGTTQLQPSQVWTLIKIQQLLNAPPMLSHWRRSTDFCGGGGGAMGPAGSAAVLCYGDTVTQLHIAGAGAPPXCPGTSPSGPVVTTLSRLPDLKVLTLSGLGXLWGPLPGKLGRLASLEIVNMSGNYLFGEVPXGVSRLAGLQTLVLDDNMLGGEVPAWIGALPSLAVLSLRNNTFQGAVPESLGSAPSLRSLVLASNNLSGNLPDMSRQANLQVLDVGGNSLGPAFPKLGRKVVTVVLGRNRFGGGLPAELSSFYLLERLDVSWNRFVGPFAPALLSLPSIRYLNIAGNRFTGTLSDKAPCGDNLRFVDLSLNLLMGSVPTCLRSPGRKPDTVVLVSTNCLDDSDGSQHPSPFCQNQALAVGIVPGKERKSVAGQAGFVAGVVVAILVAISAVGLIAFFAVRKAAMKRWEARXPPTVSEEESSSTGYPSKMLADARYISQTLKLGALGIPSYRAFSLVELEAATNNFENSHLLGQDSHGEMYRGRLGNGTPVTIRTLKMKRSQTAQSFNRHIETISRLRHQNLVSALGHCFEYNLDESTVTQLYIVFEYVQNGNLRSRISQGTEGCRLTWSQRISAAIGVAKGIQFLHGGIIPGLVGNDLRITNVLVDQNHVAKIGSYNIPILAEAMRSEQGGAGNKFQADRYVVGMAVFTLSSSRFQSIDQCDAAVFFSPXSRVKSDKTDIFDFGVILLEVVSGKTITSMYEVEILKELLAWAIADEDRVRRRSFADPAVSKGCSDESLRTVMEICQRCLAKEASQRPSVEDVLWNLQFAAQVQDDWETDAWSSGGGSPVSSSSRATRPSRLHLSR

SEQ ID NO: 7181 - protein, 516 aa, Zea mays
  misc_feature (72)..(72): Xaa can be any naturally occurring amino acid
  misc_feature (208)..(208): Xaa can be any naturally occurring amino acid
PRVRPLGTIGNLTALRTLSLRLNALSGGIPADIGSCTELRHLYLQGNQLDGQVPEGFFDLGLLQRLDLSNNXRIAGGVSPEFNRLQRLATLYLENNSLNGTLPSNLDLPKLQLFNVSRNNLTGPVPKSLARMPASAFDGTGLCGDPLAPCPTPPPPPQPPVPAAANGSISAKLSTGAIAGIAAGAAVAFLVLIAVILFLCFRCQRTMXKKSAETAGDADLDGSPVSVTVASMDMKNATRRSSQATAGNSDKKLVFLGAAPDAPYDLESLLHASAEVIGKGWLGTTYRATLEGGATTVAVKRLRAAPIPEREFRDKVIALGALRHENLVPVRAYFYSREEKLIVYDFVGGGSLCSLLHGGSPERLDFEARARIALAAARGVAFIHGAGPRSCHGNIKSSNVLVADARDGAYVTDHGILRLVGAHVPLKRVTGYRAPEVTDPRRASQETDTYSFGVLLLEALTGKPPVNSVPGSTGGVELPLWVRTVVQEEWTAEVFDASIAVEERVEEEMVRLLQAC

SEQ ID NO: 7182 - protein, 167 aa, Zea mays
SVDPRLFHLGQAARHDGLVVGEEHHGLIVPDLPYVAAHSLWSEAKNNNLELVLLTTPAIPEDRMKEITKASEGFVYLVSVNGVTGPRANVNPRVESLIQEVKKVTNKPVAVGFGISKPEHVKQIAQWGADGVIIGSAMVRQLGEAASPKQGLRRLEEYARGMKNALP

SEQ ID NO: 7183 - protein, 145 aa, Zea mays
APNAVVFRSMAVLGVDGFSSLPENCLTLCYVFFAAAIVINLIRDLVPKKVSRFIPIPMAMAIPFYIGAYFAVDMFVGTVILFVWQRLDRAKADTFAPAIASGMICGDGIWVLPQSVLALAKVKPPICMKFLSRAMNDKVDVFLGS

SEQ ID NO: 7184 - protein, 647 aa, Zea mays
MATMKLGSKPEIFVLQDLTWRCTIELESDVVVEVGEMSFYLHKFPLLSRSGVLQRMISEYQAPADGGGMCTLQLDDIPGGAKAFELAAKFCYDVKIELNALNVVCLRCAAEYLRMTDDYAEGNLITQAECFLVDVLANWKDSIKALETCEGVLPTAEDLHLVSRCITALASKACGSDAAAPVVRNASVDKDALWNGIRSGDTTSSAAAAAAAAGMDWWYEDVSFLSLPMFKRLIQAMEAKGMRDESIAGAIMFYAGRFLPGLKRNTSFSNALASYGADGSGGAGGGMSSRNITPRAASVSAPSEGDQRYFLEEIVALLPTKKGVASTKFLLGMLRTAMLLHASPLCRENLERRIGAQLEDASLDDLLVPNLGYHVETLYDIDCVQRILDYFMSSTDGIGTGYTSPALAEEGGGSLGIPQGATPSSSLSPITMVAKLMDGFLAEVAPDTNLKLPKFQALAAVVPDYARPVDDGIYRAIDIYLKSHPWLSESEREQLCRLLNCQKLSLEACTHAAQNERLPLRVVVQVLFFEQLRLRTSIAGWFFVSDNAAGGDGARPHAGGAIVPKGTAAIAGCPQADADSDVEGDAPDGKETITDVKARVSDLEKECKSMKQEIRRLGKPRRSWSLLTRKCGFGAKVQQAQTAMSGK

SEQ ID NO: 7185 - protein, 517 aa, Zea mays
  misc_feature (47)..(47): Xaa can be any naturally occurring amino acid
  misc_feature (198)..(198): Xaa can be any naturally occurring amino acid
  misc_feature (207)..(207): Xaa can be any naturally occurring amino acid
  misc_feature (238)..(239): Xaa can be any naturally occurring amino acid
  misc_feature (246)..(246): Xaa can be any naturally occurring amino acid
  misc_feature (271)..(271): Xaa can be any naturally occurring amino acid
  misc_feature (275)..(276): Xaa can be any naturally occurring amino acid
  misc_feature (278)..(278): Xaa can be any naturally occurring amino acid
  misc_feature (290)..(292): Xaa can be any naturally occurring amino acid
  misc_feature (299)..(299): Xaa can be any naturally occurring amino acid
MVSESNRGGADRTTAAGEERGQLLFDVPEIRFTKLFINGSFVDAVSXRTFETRDPRTGGVIASVAEADKEDVDLAVRAARAAFDHGEWPRMSGSERGRIMARLADLVEERADELAALESLDAGKHPAVTRAVDVGNAAGSLRYFAGAADKIHGETLKMPGQFQGHTLREPLGVAGVIIPWNFPSTMFAVKVAPALAAXGCALVVKPXEQTPLSALYLAQLAKQAGVPDGVINVVPGFXXTAGAALXSHMDVDMVSFTGSTEVGRLIMKASXESNXXPXYLELGGKSPLIXXXDADLDMXVELAVGASFFNKGEACVAASRVYVQERVYDRFEERLPERMRSWVVGDPFSDPSADQGPQVDKAQYERVLSYIDHGKREGATLLTGGRPCGPEGKGYYIEPTVFTNVKEDMIIAKEEIFGPVMCLMKFKTVEEAIARANDTRYGLGAGVVTRDLDVANRVVRSVRAGVVWVNCYFAMGSDCPFGGRKMSGFGKDEGMHALDKYLAVKSVVTPLRASPWI

SEQ ID NO: 7186 - protein, 112 aa, Zea mays
  misc_feature (28)..(28): Xaa can be any naturally occurring amino acid
MCPWAFHGGNDGAQIALSGCYAGPLFNXVIGLGVPLVISSLAEYPGVYIIPSDNSLLEPLGFLMVGLLWALVIMPKKKMRLDKLVGGGLLAIYLCFLSLRLARVFGVLDTDR

SEQ ID NO: 7187 - protein, 139 aa, Zea mays
  misc_feature (72)..(72): Xaa can be any naturally occurring amino acid
MSAAEEAKVPAVEKPVEEVKAPKLAKEKKPKAPKEKKPKQAKTASHPPYLQMIKDALIALNEKGGSSPYAIXKYMEEKHKAVLPANFKKILGLQLKNQAARGKLVKIKASYKLAEAAKKVKESTAKATKESRPKRNKIA

SEQ ID NO: 7188 - protein, 115 aa, Zea mays
MAARCSLSSSSLSVHGPLRHNKPSKRLAPCLPSAPRPGAAALRARAAKLPPGVEAPRVQPKLSEPFLGFTQTAEIWNSRACMIGLIGTFIVELVLNKGILQMIGVEVGKGLDLPL

SEQ ID NO: 7189 - protein, 375 aa, Zea mays
MQPQHNRLAFPSPPAPVSLSLSLSLSRSRVHLAAASKRDQMAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 7190 - protein, 248 aa, Zea mays
  misc_feature (40)..(40): Xaa can be any naturally occurring amino acid
MAANLEDVPSLDLMHELLRRMKCSSKPDKHLILIGCVLPXGPPGSGKGTQSPLIKDEYCLCHLATGDMLRAAVAAKTTLGIKAKEAMDKGELVSDNLVVGIIDEAMKKPSCQKGFILDGFPRTVTQAQKLDEMLAKQGANVDKVLNFAIDDAILEERITGRWIHPPSGRTYHTKFAPPKSPGVDDVVTGEPLIQRRDDTAEVLKSRLEAFHKQTEPVIDYYSKKGLVVNLPAEKPPKEVTAEVLKALS

SEQ ID NO: 7191 - protein, 144 aa, Zea mays
LEQQQQPWREQLTARGLVAAALIGSMYTVVVMKLNLTTGFVPTMNVSAALLAFLALRGWTGALSRLGVAGARPFTRQENTVVQTCAVACYSLALCGTCQTPDSFARSLALRGLPSAVPLLPCHGLAAGRHLDARRLVALPCDVS

SEQ ID NO: 7192 - protein, 97 aa, Zea mays
MYTVVVMKLNLTTGFVPTMNVSAALLAFLALRGWTGALSRLGVAGARPFTRQENTVVQTCAVACYSLALCGGFGSFMLGLNRRTYEAAGVDTPGNVP

SEQ ID NO: 7193 - protein, 620 aa, Zea mays
MKFMKLGSKPDAFQSDGADVRYVVSDLATDVVVHVGEVKFYLHKFPLLSKSGKLQRLVLKAAEDETDEVRIDDLPGGAKSFEICAKFCYGMVVTLSPHNVVAARCAAQYLEMTEDMEKGNLIFKIEVFINSSILRSWKDSIIVLQSTKALSPWSEELKVVGRCIDAIASKTSADPANVTWSYSHNNSKKGGGCAEIVESAGKPSIAPKDWWVEDLCELDVDLYKRVMVAIKSKGRMSPELIGEALKAYAVRWLPDSYDALVAEDYMRRNQCLVETIIWLLPSDKSSGCSCRFLLKLLKVAILVGGGEHVKEELIRRISFQLHKATVKDLLLPATSPNDGTYDVRLVHNLVQRFVARTALSHNGGFIEKSDEKMIELNFEQESILSVGELVDGYLSEVASDQDLSLSMFVELATAVPEVARPVHDNLYYAVDAYLKEHPDINKSEKKKICSLVDVKKLSADASVHATQNDRLPLRLVVQVLFFQQLRAGPSKELALIDNGEHACTRPTQDQCDRGERRIPKHPNSLNKQVTSLSARESQQHRISEHRGGRNSFKDQLGGLLLQSRSRRIFDKLWSSKGQGEHGGKGSETSGSSQSPPLSAKPAEVKPSPLPPLRGRRYSVS

SEQ ID NO: 7194 - protein, 202 aa, Zea mays
MAQTVFTPSLEAMKHVKAENGVILTKPFLDVCKQILPVLDKFGGAMAIVKSDIGGNITRLENKYTSEPSKYEHLYSMVQEEVQNKTAKGSSSCTNGLLWLTRAMDFLVELFRNLLEHPDWTMGQSCTDSYTKTLKKFHGWLASSSFTVAMKLAPNREKFMEVISGTGDINADIEKFCTTFSPFLKENHNFLASVGLDDLKAS

SEQ ID NO: 7195 - protein, 405 aa, Zea mays
MPPVKKSKKGKRKSKDGKLKIVRARGAPPALPPELRALDTEWWYAFLNKQVELEHAVPPDEGEAFRHFFRTSRKTFDYICSIVREDLISRPPSGLINIEGRLLSVEKQVAIAMRRLASGDSQVSVGTAFGVGQSTVSQVTWRFIESMEDRARYHLAWPSQERLEQIKAVLEDAYGLPNCCGGVDATHVIMTLPAVESSADWCDHAKNYSMFLQGIVDDQMRFIDIVTGWPGSMTFSRLMKCSGFFKLCEAGERLNGSVKVSAEGAEIREYIAGDSCYPLLPWLMTPFEGKHLPAPLQNFNARQKAARLLGTNALARLKGSWRILHKVMWRPDKNKLPSIILVCCLLHNILIDCHDELLPSVQLPEHHDTGYNRENCEQVDPNGKVMRENITAHLQHCEASKFLCN

SEQ ID NO: 7196 - protein, 137 aa, Zea mays
PTRPPTRPPTRPGPSTNTREMIWKLAETGMNVARLNMSHGDHQSHQKVIDLVKEYNAQNTDGNVIAIMLDTKGPEVRSGDVPEPIMLKEGQEFNFTIKRGVSTEDTVSVNYDDFINDVEAGDILLVDGRMMSLAVKS

SEQ ID NO: 7197 - protein, 443 aa, Zea mays
MAAPSGGGGGGAGEGSSSAAAAMTIGAHGVDQVTEAMWQMNLGDAMELGPYPERVGDPDCSYYMRTGMCRFGMTCKFNHPADRKLAVAAARMKGEYPQRIGQPECQYYLKTGTCKFGATCKFHHPREKAAMATRVQLNELGYPLRPNEKECAYYLRTGQCKFGSTCKFHHSQPSTMMVAVRGSVYSPGQSATSPGQHAYQGAVTSWPLSRSASFIASPRWPGHSSYAQVIVPPGLVQVPGWSPYTAQIGSSSSEDQQRTPGAAQYYTGSRQSGTSIGDQGMFSSYQAGSVPVGLYAVQRENLFPERPDQPECQFYMKTGDCKFGAVCKFHHPRERIIPTPNCALSPLGLPLRPGEPICSFYNRYGMCKFGPNCKFDHPMGNAMYGQAPSPASEAPAPRRMLAHVPPSHPEASPDGGSGRSRRIAHSDSQQIPSGERSAEREAS

SEQ ID NO: 7198 - protein, 246 aa, Zea mays
GTLVLISADLMHDFKTAHLTLEAPRSMLAAQAVGAAMGCVVTPLTFLLFYRAFDVGNPDGYWKAPFALIYRNMALLGAQGFSALPTHCLPLSAGFFALAVLANVMKDVLPPRYARYVPLPTAMAVPFLVGASFAIDMVVGTGVVFAWHWIDGNETTLLVPAVASGLICGDGVWTFPSSLLSLAKIKPPICLKFTLLQIQRYQICDPLAPGHMTPTVLMEFGQQRPMKRGYEEMVFRAASSRGYAET

SEQ ID NO: 7199 - protein, 406 aa, Zea mays
MGNCWGAKISSDSPSRGASSPSGTASKLASRNGAAAALSGCSSHASSASMLPTPRSEDEILESANVRAFSFNELRTATRNFRPDSVLGEGGFGSVFKGWVDEKTLAPARPGTGMVIAVKKLNQDGYQGHKEWLTEVNYLGTLSHPYLVKLVGYCLEDEQRLLVYEFMPRGSLENHLFRRSSYFQPLSWNLRMKIALGAAKGLAYLHSDEAKVIYRDFKTSNVLLDANFNAKLSDFGLAKDGPTGDKSHVSTRVMGTHGYAAPEYLATGHLTTKSDVYSFGVVLLEMLSGRRALDKNRPNGEHNLVEWARPYLRSKRRIFRILDPRLGGQYSLARAQKAAALALQCLSVESRHRPSMDEVVTALEQLQDTKEGGNHHLQKRPGSRSLDNNGGKAAGKGKPAPHVKPV

SEQ ID NO: 7200 - protein, 342 aa, Zea mays
  misc_feature (54)..(54): Xaa can be any naturally occurring amino acid
MVGLGWRVGSKVQRWGRSCLRGFSSAAVPSQLENVGFIGLGNMGSHMARNLSRXGYKVTVHDINENSMKKFSEDGIPTKQSPLEVSESSDVIITMLPSSTHVLEVYNGPNGLLCRGERLGPWLYIDSSTVDPQTSRKISTAISRCLLKEKKGYAESPKILDAPVSGGVPAAEAGKLTFMVGGLEEAYLAAKPLLQAMGEKTIYCGGAGNGSAAKICNNMAMAISMLGVSEAFALGQNLGIKATTLTDIFNCSSARCWSSDTYNPVPGVMEGVPSSRNYSGGFTSKLMAKDLDLAMASASGVGFKCPMGSNALEIYRKLCEDGCELKDFSCAFRHYYSGKNEE

SEQ ID NO: 7201 - protein, 403 aa, Zea mays
MYVVKDIGGAIGLMAVALVLLGTWPVVLAVLERRGRLPQHTFLDFSATNFMAAVLIALTFGQIGPASSTPNFLTQLTQFKNNWASVLFAMAGGVTLSLGTLATQYGWAFVGLSVTEVMASSLKVVIGTTLNYFLDGRMNKAEILFPGVGCFLIAAILGSLVHASNAADNQEKLANNNASNAAAAADEEKDLTKHLLELEIQSQEAEPDAGTAGFLVGLEEKRSIKVLGSHTLLGLGIVVFAGIFYALFAPAFNLATNDRWHTLPGRVPHLAVYTAYFYFLLACLAVSAALNVWLLYRPMVGVPSSTLAAYVLDGDGRGLAMLAGMLCGLGNALTFMAGQAAGYAAADSVQALPLVSTFWAVALFGEYRRSSRRTYTLLASMLLMFTVAMVLLMASSGSRSIIH

SEQ ID NO: 7202 - protein, 47 aa, Zea mays
FEQHEAPGSRSFFTEIIASISDIKFSKDGRHLLSRDYMTLKVCTCNF

SEQ ID NO: 7203 - protein, 209 aa, Zea mays
  misc_feature (173)..(173): Xaa can be any naturally occurring amino acid
  misc_feature (185)..(185): Xaa can be any naturally occurring amino acid
SSTQQEGRRRQHQHQHHRPPPRLELAMAHARGGGGHGHGHEEEAEAAVCLDGDSEAGEARSAGRAPPWRDQLTARGMVASLAVGAMYSVIVMKLGLTTGLVPTLNVSAALIAFVILRGWTQALARFGVATRPFTRQENTVVQTCAVACYSIAVGGGFGSFLLALNKRTYEMAXEDTEGNLPGSYXEPGIGWMTGFLFAVSFVGIVALIP

SEQ ID NO: 7204 - protein, 157 aa, Zea mays
  misc_feature (28)..(28): Xaa can be any naturally occurring amino acid
LADARSLGRCSAVSRRFSALVPLVDDAXLAVLKSVLLAVLKPFAHCDAKSASPQKHAQQHHSPAQVLRNFSSIRSLRMELPVSDVGTDDGVVLRWKAVFGSTLQSCVILGGTRVDRAAAAGPSHAPYYDPPAGDDYGGSIPESLYTNGGLKLRVVWT

SEQ ID NO: 7205 - protein, 359 aa, Zea mays
MQSKHRVFAEDLLLAAAAEGEDHFDRVPDSLVLLIFNKLADARSLGRCSAVSRRFSALVPLVDDACLRIDRVIPADAADAGAPRPRAALSHLLKSVLLAVLKPFAHCDAKSASPQKHAQQQQQQHHSPAQVLRNFSSIRSLRMELPVSDVGTDDGVVLRWKAVFGSTLQSCVILGGTRVDRAGPPHAPSSGSAPPAGDDDGGSIPESLYTNGGLKLRVVWTISSLIAAATRHYLLREIVKEHPTLERVALTDAGGQGTLSMGRDQLREFRDRPLAAAPAAAANRTQVPACNMKLRYAPLLELSDGTRIHGATLVVIKPVGDAGGKDLDELGAGAFDGPLREAVAALGKRRAYLLEMNGF

SEQ ID NO: 7206 - protein, 536 aa, Zea mays
  misc_feature (91)..(91): Xaa can be any naturally occurring amino acid
MPMPMPRARTRWSALAASALIQCCAGSSYCFGVYSQTLKASQRYDQSALDAVAFFKDVGANAGVLSGFLVAWAPGGRRRPWIVLLAGLPAXAPRGYLPMWLAVAGVAPAPLPLVCLYMLLAAQAQTFFNTADVVSAVENFPDRRGTVIGIMKGFLGLSGAILVEIYRTLGIDPSSFILMLAVLPTSVTLVLMYFVDVHNPHERYEKKFLDAFSLIAVTVAGYLMILIIYGQVFPISSAVQSVCFVVLLLLVMSPIAVAAKAQTPESIAHQGSISEQRAGLLRKEVTEDSENASSSTTALGGSNQDLSSGKENLNVLQAMCKLNFWLLFLAMACGMGSGLATVNNISQIGGSLGYTTKETSTLVSLWSIWNFSGRFGAGFISDHFLRLRGVGRPFFISITLLVMSVGHAIISSGLPASLYIGSVLIGMCYGCQWALMPSITSEIFGLSHFGTIFNMVAVASPVGSYILSVRIVGYIYDIESPPDEHSCVGKQCFALSFMIMAGVCMFGSAVAFVLFIRTRTFYRRVVYARLQSFLDK

SEQ ID NO: 7207 - protein, 276 aa, Zea mays
IFAYPFRCPIPAALLALCWYWASEGIGKKDMVVLPYKDSLLLLSRYLQQLVMESLGKEFDLDGNRVNQGLTVYGNKGSTDQHAYIQQLREGVHNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAICENPTEPLTLDEIADRCHCPEDIEMIYKIIQHMAANDRALIAEGSCGSPRSVKVYLGECSVDEDMQAA

SEQ ID NO: 7208 - protein, 362 aa, Zea mays
  misc_feature (96)..(96): Xaa can be any naturally occurring amino acid
VESPRVRAIASARMKGEYPERVGQPECQYYLKTGTCKFGPTCKFHHPREKAGIAGRVQLNTLGYPLLPVCFFLPVTCPLLHMSVCFAEKESTLLLXNEKECAYYLKTGQCKYANTCKFHHPELFNVVPSSRGSPIYTSVHSSASAGPQSYTGTMSSWTFPRASFIPSPRWQSPSNYAPMVVPHGLVQVPSWNSYPGQLQSPGAQQTYGSSQQGEASAGNQGMLSPYRSSSFPVPQYALQRDNVFPERPDEPECQYYMKTGDCKFGAVCKFHHPRVRSQPPPDCVLSPMGLPIRPGEELCKFYSRYGICKFGANCKFDHPTMAAPMGVYAYGFSGSASVAPASTNAPMTRHLLGSPSGSGYMS

SEQ ID NO: 7209 - protein, 128 aa, Zea mays
  misc_feature (5)..(5): Xaa can be any naturally occurring amino acid
  misc_feature (13)..(13): Xaa can be any naturally occurring amino acid
  misc_feature (78)..(78): Xaa can be any naturally occurring amino acid
  misc_feature (93)..(93): Xaa can be any naturally occurring amino acid
  misc_feature (99)..(99): Xaa can be any naturally occurring amino acid
MDKPXGEGATKQXMIDCYIQTLVKVLGSEEEAKKKIYNVSCERYFGFRCEIDDETSNKLEVLPGVLFVLPDWYVHPPXKDYGVEMIVNGEIVXEEIKEXRRVETEPQRVGDRPRHNDRTRYARRRENQ

SEQ ID NO: 7210 - protein, 181 aa, Zea mays
  misc_feature (40)..(40): Xaa can be any naturally occurring amino acid
MASSMLSNAAVATTVVNRNAGAQASMVGLKSVAAFPLTKXKSTNDLSSLPTNGGRVQCMKVWPTQNMKRYETLSYLPPLTTDQLARQVDYLLNNKWVPCLEFETEHGFVYREHHNSPGYYDGRYWTMWKLPMFGCTDPAQVLNELEECKKEYPNAFIRIIGFDSNRQVQCVSFIAYKPEGY

SEQ ID NO: 7211 - protein, 142 aa, Zea mays
KKARQGGSYSRSPVKSRSPRRRRSPNRNRSYSRGCSYSRSRSPVRREKSVEDRSRSPKAMERSVSPKGRDQSLSPDRKVIDASPKRGSDYDGSPKENGNGRNSASPIVGGGESPVGLNGQDRSPIDDEAELSRPSPKGSESP

SEQ ID NO: 7212 - protein, 259 aa, Zea mays
MWRRAGAGPLLHHLAAAASAAAAGRCINGRPLPPMPTASWSPLFQHNLGISWGSASVGAPFRSLSNQSSGGGACWSCGATGAFLSCGSCGSVQPVDPAVDYFQIFGLKREYNITDNNLEGKYKDWQKKLHPDLVHSKSEKERGYAAEQSALVIDAYRTLSKPLSRALYLLKLEGIHVDEEKTINDPELLMEMMDIREAVSDASDSQTLEKIQSQIKAKLETWSDSFQEAFDRKDFDRAVEATQRMRYYERAVEETVKKL

SEQ ID NO: 7213 - protein, 225 aa, Zea mays
MDSEHWISRLAAAKRFYAAQLGHSDRAGMEELDMDEEVRPEFACPYCYEDHDVGSLCAHLEEEHPFEPQAAACPVCSEMVTKDMVNHITMQHGYLFKNRRRLRRFIIPGSQALSLLSRDLREAHLQVLLGGGHRSSNNNSTTNISADPLLSSFGLSFPTSDAEQTSKSTLSIPDDATMIKETPAQARKLSIDSSLTSEEREQKRKQASVRATFVQDLLLSTLFGD

SEQ ID NO: 7214 - protein, 440 aa, Zea mays
MSPGFFGHGHTASQFTRRGAQPPRAPARSHKKTRLRTAPPSHRPTWPRQPPSTLSPGHRRPGRPRMDRLVLFSRRRRRWILLAAAGAAAAVGAYKIYHHPAVAERRHRLVRLAAAIAAIADAATSSADAAALVVSDLADFVRSDADEVPRSVKQLAKLAASPEVSATVSTLSEAVTSGMLRGAGSSSSGPGSGGTVALSDRLVDKLFSDSGERLASAVAGSFARHLVLAYYSAPSPQGEASSSPTVWVNVVATGKCRKAISTWVEVFVGTAVREFIDKTIHINTYEQIFEGLTNPKHDAKVKELLVSVCNSAVETLVKTTHHALYNTNDNLDANDSCSGSGNGNGVGEGWVERVSSTLAVPSNRKFVLDVTGRVTFETVRSFLEFVLWKLQDGARKGGDSMVDSGLRVVRYMSDKSMVIATICITLCLHVLNGTRLLVAA

SEQ ID NO: 7215 - protein, 310 aa, Zea mays
MASAIKAASTSSQWSSSPAAVHSSPLSKRLPAAVAMPGRRRSVATVRAVAAVAPGAPAKLTAGAGGRCLPVSQTMSRLRAQGKTAFIPYITAGDPDLATTAEALRLLDACGADVIELGVPFSDPYADGPVIQASAARALASGTTPDGVLAMLKEVTPELSCPVVLFSYFNPIVRWGLADFAAAVKEAGVHGLIVPDLPYGNSCALTLRTEAIKNSLELVLLTTPSTPADRMGEITRASRGFVYLATVNGVTGPRANVNTRVQSLIQEVKQVIIRHVKGKGEKRGRERRCHFYSFLLLPITITELAELACG

SEQ ID NO: 7216 - protein, 382 aa, Zea mays
MENQGPKPIRCKAAVCRAAGEPLAIEEVVVDTPKAHEVRIRIICTSLCHSDVTFWRMKDLPDNIPRIFGHEAFGVVESVGEQVDEFAAGDAVVPTFLGQCSECVDCRSARSNMCSKYRFAVRPGMPRDGTTRFTDGQGRPLHHFFGVSSFAEYTVVDVNQVVKLNPAVPPALACLLSCGASTGVGAAWKQAKVEPGSSVAIFGLGAVGLAVAEGARICGASKIIGVDINPDKCELGKKFGVTHFINPKELGEEKPVHQAIAEMTDGGADYCFECIGLAALMNDAFRSSRDGWGKTIILGVEMHGAPLCISPHEILHGKSVIGSMFGGVKPKQDIPILADKYMNKELELDKFITHEVGLKDINQAFDLLLQGKSLRCTIWMDK

SEQ ID NO: 7217 - protein, 197 aa, Zea mays
MVKSTTTMGAASCGGGVLPLASLNHISIVCRSVEASLRFYTDVLGFVPIRRPGSFDFGGAWLFNYGIGIHLLQSEDPGSLPPEKGEINPKDNHISFQCESMVAVERRLKEIGIPYVQRCVEEGGINVDQIFFHDPDGFMIEICNCDNLPVVPLAGDQQRAPAACRRAPAAVSTVKQQQQGSVVPASSAPVTTAAAAL

SEQ ID NO: 7218 - protein, 420 aa, Zea mays
MQIISLSASTNRLSKITAKQAAEYALLIMEELDRGNLGYIDVYDLKTLLLQAPSSSQSVRIGTATNDGRNMSQILSRQDLRPRPEPNPLRRWHRRAQYFLEDNWRRVWVMLLWLCVCAGLFAWKFAQYRRRYVFQVMGYCVCVAKGGAETLKFNMALILLPVCRNTITWVRNHTGVGRVVPFDDNISFHMVVAAGITVGAGLHVVSHLTCDFPRLLRATDAAYAPLAQYFGVPRPRNYWWFVKGTEGWTGLAMLVLMAVAFTLAMPWFRRGELALPGPLKRLLAGPLKRLTDKLKLTDPLKRLTCQLKRLTAGPLKRLTGFNAFWYTHHCFVAVYALVLVHGHYLYLTHKWYKKSTWMYLAVPMVLYACERLTRALRSRVRAVKILKAEMHQAGKDMVMSLHFSKPQGFRYKSGQYIFVK

SEQ ID NO: 7219 - protein, 409 aa, Zea mays
LESTCRVDKDADGRITEEEIREIISLSASTNRLSKITAKQAAEYALLIMEELDRGNLGYIDVYDLKTLLLQAPSSSQSVRIGTATNDGRNMSQILSRQDLRPRPEPNPLRRWHRRAQYFLEDNWRRVWVMLLWLCVCAGLFAWKFAQYRRRYVFQVMGYCVCVAKGGAETLKFNMALILLPVCRNTITWVRNHTGVGRVVPFDDNISFHMVVAAGITVGAGLHVVSHLTCDFPRLLRATDAAYAPLAQYFGVPRPRNYWWFVKGTEGWTGLAMLVLMAVAFTLAMPWFRRGELRLTAGPLKRLTGFNAFWYTHHCFVAVYALVLVHGHYLYLTHKWYKKSTWMYLAVPMVLYACERLTRALRSRVRAVKILKAEMHQAGKDMVMSLHFSKPQGFRYKSGQYIFVKGTEL

SEQ ID NO: 7220 - protein, 375 aa, Zea mays
MGAEAAHGHPQQQPPSSLRPGREAAAPPAVVGLQLSALIDHVARVDWSLLDRVPGDRGGSQQVSIDELNHILDEVNAHILPSRNDLTPVTTIAGGSVANTIRGLSAGFGISTGIIGACGDDNQGLLFVNNMSFSGVDLTRLRAKKGHTAQCVCLVDASGNRTMRPCLSSAVKIQANEFRKEDFKGSKWLIVRYAQQNMEQIVEAIRIAKQEGLSVSLDLASFEMVRDSRSKLVNLLETGNIDLCFANEDEAREVIGGSLESDPEEALAFLGKYCKWAVVTLASKGCMAKHGKQVVRVPAIGESNAVDTTGAGDLFASGFLYGLVKGLPLEECCKVGACSGGSVTRALGGEVRPENWQWMYKQMHARGLLLPELKN

SEQ ID NO: 7221 - protein, 187 aa, Zea mays
ACLQSCVILGGTRVDRAAAAGPPHAPSSAPPAGDDDGGSIPESLYTNGGLKLRVVWTISSLIAAATRHYLLREIVKEHPTLERVALTDAGGQGTLSMGRDQLREFRDSPLAAAPAAAANRTQVPACNMKLRYAPLLELSDGTRIHGATLVVIKPIGDAGGKDLDELGAGAFDGPMKEAVAALGKRRA

SEQ ID NO: 7222 - protein, 224 aa, Zea mays
DLQGNIDWNEAHFAYDLLHEDKDLTLDTRDSAPFTPKCRVIDTNAFDWQDHNRPSIPWSSTVIYETHVKGFTQLNPAIPAEMRGTYDGMSHKSTVDYIKSLGVTSVELLPVHWFPDDQHLLDRGLKNFWGYNSLAFFAPASRYFGPRGIQGFRDMVRAFHDAGIEVILDVVYNHTAEGNELGPTLSFKGIDNFSYYRTLPDQHRYYINDTGTGNTVNTFHSRVL

SEQ ID NO: 7223 - protein, 509 aa, Zea mays
MTIDMSIPGSSGLLNAAGKRDMKFFSNPYVLALTGAAGIGGFLFGYDTGVISGALLYIRDDFPAVKDNYFLQETIVSMALVGAMIGAAGGGWINDAYGRKKSTLLADLMFALGSLVMCAAAGPYILIIGRLLVGLGVGVASVTAPVYIAEAAPSEIRGGLVSTNVLMITGGQFFSYLINLGFTEVPGTWRWMLGVAAVPAIIQFVLMLFLPESPRWLYWKDEKAKAIAVLERIYESDRLEEEVELLATSSMHEFQSNNTGSYLDVFKSKELRLAFFAGAGLQAFQQFTGINTVMYYSPTIVQMAGFSSNRLALLLSLIVAAMNAAGTIVGIYLIDRCGRRRLALTSLAGVVVSLAILATAFILQSSSGLCASAASGTCQGALGWFAVAGLALYIAFFSPGMGPVPWAVNSEIYPEAYRGTCGGMSATVNWVSNLVVAQTFLSIVGLVGTGPTFLIVAGIAVLAFVFVATYVPETKGLTFEQVEQMWRERAWGNSGGNCESLLAGTAAAP

SEQ ID NO: 7224 - protein, 672 aa, Zea mays
MAGDRGRGAAERVDAAVGAVGSGGWEFRNAYRRQLLALSRRIRLLGPFAEELREARRGSAEQEEQERALAPLADALEEALDLLQLGRDGSRIFLVLPTAPATVRFHESIAQLEQALCDFPYDKLDISDEAREQVELVHAQLKRAKERVDMPDDEFYNELCSLYNKSHDPSAELDILGRLSEKLHLTTIADLTQESLALHEMVASGGGNDPGEHIEKMSMLLKKIKDFVQTQNPETGPLVTAKPMGSNGKPRPVNVPDEFRCPISLELMKDPVIVATGQTYERALIEKWLASGHHTCPSTQQRMPNTTLTPNYVLRSLITQWCEANGIDPPKRPTQQPDRPTSSCSSSERASIDALLSKLCSADPEEQRSAAAELRLLAKRNANNRICIAEAGAIPLLLSLLSSSDLQTQEHAVTALLNLSIHEDNKASIILSGAVPGIVHVLKNGSMEARENAAATLFSLSVVDEYKVTIGGTGAIPALVVLLSEGRQRGKKDAAAALFNLCIYQGNKGRAIRAGLVPLVMGLVTNPTGALLDEAMAILSILSSHPEGKAAIGAAEPVPVLVEMIAGGSPRNRENAAAVMLHLSASVRQSAHLARAQECGIMAPLRELALNGTGRGKRKAVQLLERMSRFLVQQQEDAVDPRVQELEEIERQLAAFGPGVTEADVLQQLGAL

SEQ ID NO: 7225 - protein, 225 aa, Zea mays
  misc_feature (141)..(141): Xaa can be any naturally occurring amino acid
PPPPPRTPVARPLGGGSGADALRPAARMPRERRTGAVAARGRRESQVVSVISRAPRPDAGVLPVSPDDDAAVKEEANFQHLKAIQQLATAANGVWSKPNVRRKTKIVCTIGPSTNTRDMIWKLAETGMNVARLNMSHGDHXASHQKVIDLVKEYNASHADNVIAIMLDTKGPEVRSGDLPQPIFLESGQEFTFTIKRGVGTDTCVSVNYDDFVNDVEVGDMLLVD

SEQ ID NO: 7226 - protein, 195 aa, Zea mays
ADQLNKMGHYVVVFERDDRIGGLMMYGVPNMKADKATIVQRRVDLMDKEGVKFIVNAHVGTDPRYSIERLQSENDAVILACGATRPSNLVNLELLPEPSRERAPDNPWPQWPRIFRIDYGHQEAASKFGKDPRTYQILTKRFIGDENGKVRALEVVRVEWSKVDGRFQSKEIEGSQEIIEADLVLLAMGFLGPET

SEQ ID NO: 7227 - protein, 348 aa, Zea mays
ADQLNKMGHYVVVFERDDRIGGLMMYGVPNMKADKATIVQRRVDLMDKEGVKFIVNAHVGTDPRYSIERLQSENDAVILACGATRPRDLSIPGRELSGIHYAMDFLHANTKSLLDSNLEDGKYISAKGKKVVVIGGGDTGTDCIGTAIRHDCSNLVNLELLPEPSRERAPDNPWPQWPRIFRIDYGHQEAASKFGKDPRTYQILTKRFIGDENGKVRALEVVRVEWSKVDGRFQSKEIEGSQEIIEADLVLLAMGFLGPEADIAKKLGLEQDSRSNFKAEFGNFATNVEGVFAAGDCRRGQSLVVWAIAEGREAAAAVDKYLTREKTNADEDVAGPSSSGCLVQPVAA

SEQ ID NO: 7228 - protein, 219 aa, Zea mays
  misc_feature (173)..(173): Xaa can be any naturally occurring amino acid
DLPFLACFRSMFALISLFVFLYGCNLLAWKSSRISHNFIFDFSPSTALTHRDAFLLSASIMCTVVAALVVNLFLSNAGATYANALPGALLLLSAAALFCPFNVFYRSTRYCFMRVMRNIMLSPFYKVLMADFFMADQLTSQIALLRHLEFTGCYFMAGTFTTHAYGSCTSSSXYKNLAYVLSFLPYYWRAMQCLRRYLEEGHDIDQLANAGKYISAMVA

SEQ ID NO: 7229 - protein, 198 aa, Zea mays
AFGGARWLGAAALALWLLLLFYLLGDTASQYFCAALQGLSAALRLPPAIAGVTLLSLGNGAPDVLSSVVAFAAADADAGDVGLSSVLGGALFVSTVVAGVVAIVASSSGTRGGPVEIERAGFVRDVCFLLVALCYLLAVLLTGSVTVWAAASFLSLYAAYVLLVWTSHFSSKHAEAAAPPRRGRSSLARHALHALQAC

SEQ ID NO: 7230 - protein, 370 aa, Zea mays
MAPVEAEQHRRRALALAAHDASGAVSPIRISRRDTGDDDVAIQILYCGICHSDLHTIKNEWKNANYPVVPGHEIVGLITEVGKNVKRFNVGDKVGVGCMVNTCQSCESCEGGHENYCSKIIFTYNSHDRDGTVTYGGYSDMVVVNERFVIRFPDGMPLDRGAPLLCAGITVYNPMKHHGLNEAGKHIGVVGLGGLGHVAVKFAKAFGMRVTVISTSPGKREEAMETLGADAFVVSGDANQMKAAKGTMDGIMNTASASMSMYAYLALLKPQGKMILLGLPEKPLQISAFSLVTGGKTLAGSCMGSIRDTQEMMDFAAKHGLAADIELIGTEEVNEAMERLAKGEVRYRFVIDIGNTLNAASLGSSPVPAL

SEQ ID NO: 7231 - protein, 332 aa, Zea mays
  misc_feature (140)..(140): Xaa can be any naturally occurring amino acid
MRAVVITRGGGGPEVLEAQEVEDPAPLGDGEVLLQVVAAGVNRADTLQRHGRHPPPAGAPPPYPGLECSGTILALGPNAPPRWAVGDKVCALLSGGGYAEKVVVPAGQLLPVPVGVSLAVAAGFPEVACTVWSTVFMKSXTSHLSPGESFLIHGGSSGIGTFAIQIAKHLGIMVFVTAGTEEKLAACKGLGADVCINYKTEDFVERVKQETNGKGVDVILDNIGGPYLQRNLNSLGVDGRLFIIGFQGGAVAEVNLQAVFVRHLTIQAAGLRGRSAASKAQIVSEVEKNVWPAVAAGKVNPVIYKTFPLSEAADAHRLIESSMHIGKILLLP

SEQ ID NO: 7232 - protein, 274 aa, Zea mays
  misc_feature (156)..(156): Xaa can be any naturally occurring amino acid
  misc_feature (167)..(167): Xaa can be any naturally occurring amino acid
MSEANTTQLDLEKGFSQVSNDNDSSSPATMHKMKVETEDGGSEIESPTPEKRESRSKRVVVSSLARNLLAERYRDRFSNQLVEDEGQTDDEDYNGSVSPSGSQSLFSESIELLDKHKDLLSLFNRMESSIRLLHLRKKMATFNNIATQVEILTKRXNDDDIYMDYYXYLVQMIVFFPEPIQFKRVLLHPEKSLCMYADMEIILVMDVVEYTSPDPSPSMAICDAFYSKLLTFLDAHHKVPAKEQVDALLKELFALSTVTGILSPLLATCVIVDQ

SEQ ID NO: 7233 - protein, 124 aa, Zea mays
GVIVSSTGATIYQLYWDFVMDWGFLDLRSKNRWLRDQLILKNKPIYYASMMLNLVLRLAWAESVMKLRLGMVESRLLDFSLASLEIIRRGHWNFYRLENEHLNNAGKFRAVKTVPLPFRELETD

SEQ ID NO: 7234 - protein, 174 aa, Zea mays
MSRDPLVVGHVVGDILDPFIKTASLKVLYNNKELTNGSDLKPSQVASEPRVEIGGRDMRNLYTLVMVDPDSPSPSNPTNREYLRWLVTDIPESANASYRNEIVSYENPKPSAGIHRFVFVLFRQSVQQTVYAPGWRQNFNTRDFSALYNLGPPVAAVFFNCQRENGCGGRRYIR

SEQ ID NO: 7235 - protein, 529 aa, Zea mays
MLVLFETPAGFALFKVLDEGKLDKVEDLWKEFTTSDSARKVVELKAFNKFENTSDALSAATLIIDSKPSKGLRKFLQKHCEGETLAVADSKLGNAIKEKLKIDCLHNSAVMELMRGLRNQLTELITGLGAQDLGPMSLGLSHSLSRYKLKFSPEKVDTMIIQAIGLLDDLDKELNTYAMRVREWYGWHFPELTKIVTDNIQYAKVVKMMGNRANAVNLDFSEILSDEELETQLKEAAVISMGTEVSDLDLSNIRELCDQVLALSEYRAQLYDYLRSRMNTIAPNLTALVGELVGARLIAHGGSLLNLAKQPGSTIQILGAEKALFRALKTKHSTPKYGLIYHASLIGKASQKHKGKISRSLAAKTALAIRYDALGDGEDNSIGTESRLKLETRLQVLEGRELGKSAGSTKGKPKIEVYEKDRKQGAGALTTPAKTYNPAADLVLTEETPKKSELASKKRKHNEVETEPLAEPAEEAIQEDGDQEDRKKKKKKNKESKEAPAGEGDGEKKKKKKSKEVEEVACCGCCFRS

SEQ ID NO: 7236 - protein, 150 aa, Zea mays
MVCAKCEEKLGKVIVPDGGKEGDTSFSVSSSSRSRSRFHPASDPQQQESAAAAAMVCAKCEKKLGKVIVPDKWKEGASNTNESGGRKINENKLLSKKNRWTPYGNTKCIICKQQVHQDAKYCHTCAYSKGVCAMCGKQVLDTKLYKQSNV

SEQ ID NO: 7237 - protein, 549 aa, Zea mays
HLSTLSSTPFMPPGPCSRPASYIGYLEAGRGCRRRAGLDTFPGSRRRRARHAAGSDEMEDGVSTYTVDEALVSMGFGKFHAFVLAYSGMAKISEAMEMMLLSFVGQSVQAEWGLSAHEESLITSVVFVGMLVGAYAWGIVSDNYGRRVGFNFTAIVTGGAGLLSAFAPNYLSLIVLRFMVGVGLGGGPVLGSWFLEFIPAPNRGTWMVMFSAFWTVGTIMEASLAWAVMPAFGWRWLLALSSLPSFALLLFYPVTLESPRYLCMKGRIAEAVHVLETMSRVNCVSLPSGRLVSGHRVELHDIGDSSETAQLVTSNKNNTADRGSKSEIGGLSAILKLLSPNLIRSTLLLWTVFLGHAFLYYGLVLLTSELNHGNRICGSEEGAEVTTTAHIHDENLYRNVFITSFGEVPGLLLSAAIVDMIGRKLSMSSMLYISCLCISPLMFAQTESLTTVFLFCARVCISASFTVLHIYAPEIYPTAVRATGVGFASSIARFGGILCPLVAVGLVHACHQMAAILIFITVMLASGIAVSYFPLETSGRKLSDHVAAA

SEQ ID NO: 7238 - protein, 131 aa, Zea mays
MANGGAAAAAAAAAAAAATGAGSPCGACKFLRRRCVPECVFAPYFSSDQGAARFAAIHKVFGASNASKLLSHLPVADRCEAVVTITYEAQARLRDPVYGCVAQIFALQQQVIMHSQIITSSHDPDRCHPTI

SEQ ID NO: 7239 - protein, 272 aa, Zea mays
PLRVYSFLVSVFRLSLSLMLGHVHNVLPYSYMGLFSDANCNISLLFIQMCVLIYVGTNGETFFNTTALVTCIQNFPKSRGQTVGIMKGFAGLSSAILTQLYAVMHTPDHATLVFMVAVGPSLVAIGLMFIIRPVGGHRQVRPSDKNSFLFIYTICLLLASYLVGVMLVQDFMQLSDNVVNFLTVILLILLVLPIVIPVTLTLSSKTQHPIEEALLSDPSKGETSTSQEKEDQPEVILSEVEEEKPKDIDSLPPSERRKRIEELQTKLVQAAG

SEQ ID NO: 7240 - protein, 291 aa, Zea mays
  misc_feature (124)..(124): Xaa can be any naturally occurring amino acid
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARXKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 7241 - protein, 491 aa, Zea mays
  misc_feature (385)..(385): Xaa can be any naturally occurring amino acid
MDAEAAAAAAATAVEERERLRRSFASGRTRPAAWREAQLRGLLRMATEREDDICAALHADLAKPLTECYVHEISLVISSCKFALKNLKKWMKPRKVPGGLLTFPSAASVAAEPLGVVLVISAWNYPFLLAIDPVVGAFAAGNAVALKPSEVAPATSLLLADLLPRYVDPSCVRVVQGGIPETTALLELQWDKIFYTGNSRVGRIVMSYAAKHLTPVVLELGGKCPVVVDSDVNLHVAAKRIAAGKWGCNSGQACVSPDYVVTTKSFAPKLLESLKRVLFEFYGEEPLRSPDLSRVVNSNHFNRLMALMDDYSVSGNVAFGGQIDERRLRIAPTLLLDVPLDSAMMKEEIFGPLLPIITVDKIGESFAVINSMPKPLAAYLFSNDXRLKQQFERTVSAGGIMFNDTGIHLTNPNLPFGGVGESGMGAYHGAFSFDAFSHRKAVLDRSFLGEARARYPPYTPAKLAILRGVLNGSPLATVQAAAGCTGGASAD

SEQ ID NO: 7242 - protein, 262 aa, Zea mays
MLPGARTALFEFLTPHASALLNPDPCSNPTIVLKKTLSCSYPNLPFNEALRKESEKLQVELQRSQSNMDLGSCEVIQHLLGVTKTVESTIPEKETNVKAPEKKGSNYSESKGETAKSFDDDDDYPKKQNDEYPKKQKDTCSTQRCSLQVPYGHDLVSSRGSYSDEWHADLLGIASIAKDRPGEACNDIMAYSLILSCCCYTCCVRRKLRQKLDIAGGCCDDFLSHLLCCCCALVQEWREVEIRGAYSEKTKVTPPACQYMEH

SEQ ID NO: 7243 - protein, 155 aa, Zea mays
MKIQKANAGVLTNFEVLDFLRSRGAKIDPMGCLGAVAVSECKVYEYILKTPACNQTRESIYEFVKRSEGFRLAEADKLNVINWRPSSAADAYAMIEECGKRFSRDERGEACDEDERVQEFLDMVKEVLPAPPKAEVETAEAEAVEAEAEVEAMQE

SEQ ID NO: 7244 - protein, 491 aa, Zea mays
MGRTEAADGAESGGLGVGETVRELREAYEGGRTRSLAWRQAQLRGLLRLLEEKEVEAFQALHKDLGKHHAEAYRDEVGVLIKSANGALQQLGKWMAPEKVRVPLIAWPATAQVVPEPLGVVLVFSCWNVPLGLSLEPLIGAIAAGNAVALKPSELSPCTARFLGDNIGRYMDSSAVKVVQGGPDVGVQLMEHRWDKVLFTGSPRIARAVMAAASRHLTPVALELGGKCPCIFDAMGSARDLQISVNRMIAGKWSSCAGQACIAIDYVLVEERFAPILIKVLKSTLKRFFPEADHMARIVNERHFERLSNLLKDRSVAPSVLHGGSMDSKNLYIEPTILLNPPLDSAIMTEEIFGPLLPIITVKNIEDSIAFVKAMPKPLPLAIYAFTRDAALRRRIVDETSSGSVTFNDAVVQYAIDGLPFGGVGQSGFGQYHGKYSFEMFSHKKAVMKRGYLVELTLRYPPWDESKVTLMRYLYRFNYFAFVLSFLGLRR

SEQ ID NO: 7245 - protein, 422 aa, Zea mays
TTQRTCATPVSLIKCLRSIKKHAFVASPYPVIITLEDHLPSQLQEKVAKMVVEVFGNILYYPPDDTHELKELPSPEQLKGRVLLSTKPPKEYLETKLSDSTKEGDADLHLGKGTGDDAVWGKEVPDFRTEIQSAEKDDENDDVDDEEEQKLQPHIAPQYKHLITIRAGKPKDSLADALKSDPEKVRRLSLSEQQLAKAAKDHATEIVRFTQRNILRIYPKGTRVTSSNYNPFVGWVHGAQMVAFNMQGYGRALWLMHGFYKANGGCGYVKKPDFLMQTEPQVFDPREPQPVKKTLKVKVYMGDGWRMDFKQTHFDQYSPPDFYTRVGIAGVPADSVMKKTNAIEDNWTPVWEKEFSFPLTVPELALLRVEVHEYDMSEKDDFGGQTVLPVSELRPGIRAVALFDRKGMKYNHVKLLMRFEFA

SEQ ID NO: 7246 - protein, 420 aa, Zea mays
  misc_feature (24)..(24): Xaa can be any naturally occurring amino acid
  misc_feature (176)..(176): Xaa can be any naturally occurring amino acid
  misc_feature (395)..(395): Xaa can be any naturally occurring amino acid
PPAQVDVGLSDGSFARGAVPSAQXGASTDDVIYEALELRDGGSDYLGKGVLKAVNNVNSIIGPAIVGKLDGTSNEWGWCKQKLGANAILAVSLAVCKAGAMVQKIPLYQHIANLAGNKTLVLPVPAFNVINGGSHAGNKLAMQEFMILPTGASFKEAMKMGVEVYHHLKSIIKKNXKKYGQDATNVGDEGGFAPNIQENKKGLELLKAAIEKAGYTGKVFIGMDVAASEFFSEKDKTYDLNFKEENNDGSNKISGDSLKDLYKSFVSEYPIVSIEDPFDQDDWTTYAKLTGEIGQQVQIVGDDLLVTNPTRVAKAINEKTCNALLLKVNQIGSVTESIEAVRMSKRAGWGVMASHRSGETEDTFISDLSVGLATGQIKTGAPCRSERLAKYNQLXLRIEEELGVAAVHAGAKFRAPVEPY

SEQ ID NO: 7247 - protein, 364 aa, Zea mays
MCDYCSFFSRMFLPMLYKRRLVSIDLCQCLAENMVTSSKGKVCVTGASGFVASWLIKRLLESGYHVVGTVRDPGNHQKTAHLWKLPGAKERLQIVRADLLEEGSFDSAVMACEGVFHTASPVLAKPDSTSKEDTLVPAVNGTLNVLRSCKKNPFLKRVVLTSSSSAVRIRDDGGQSSNISLDETTWSSVPLCEKMHLWYALAKVFAEKAAWEFAKENGIDLVTVLPSFVIGPSLSHELCVTASDVLGLFQGDTARFSSYGRMGYVHIDDVASSHILVYEAPQAAGRYLCSSVVLDNDELVSSLAKRYPIFPIPRRLNSPYGKQSYQLNTSKLQGLGFKFRGVQEMFDDCVQSLKDQGHLLECPL

SEQ ID NO: 7248 - protein, 303 aa, Zea mays
LVRHQVTRDGCPVIFHDNFIYTQQDGQVSAKRVTELNLDEFLSYGPQRDQGKAGKPLLRKLKDGRILKWDVQSEDALCTLREVFEGVHRRVGFNVELKFDDDLFYTEERLTCILKSVLKVVFEHANDRPIIFSSFQPDAAQLIRKLQDKYPVLFLTNGGTQVYADPRRNSLEEAVKLCVAGGLQGIVSEVRAILRQPSAVAKIKEANKLSLMTYGQLNNVAEVVYVQHLMGVDGVIVDLVQEIAEAVSAFTVVTAVQASGSQDGGGIVVGERMETAAVAVAGTPSFSPREVSFLLRLIPELVQ

SEQ ID NO: 7249 - protein, 165 aa, Zea mays
MLDHLVGLLKLRVVRGVNLAVRDLRSSDPYVVVRIGKQKLKTRVVKKSVNPEWDEELTLSIEDPAVPIRLEVFDKDTFVDDTMGNAEVDIRPLVEIVKMKLQDVADRTVVKKLVPNRQNCLAEESSIYISEGKVKQDMVVRLRNVESGEIELQLQWIDLPGSKGV

SEQ ID NO: 7250 - protein, 425 aa, Zea mays
MGCGPSIPDKYTIGGKGRKRRSVIQEVAVFVPTIRIPVASDIAHPLRGIVSKDLVDRLSTLRAHVASLAEEIYHADVSAVQELQHALEEYLPVVLGLTTKESRLESSVQFRWKTLDDDQECCLASAWYEVLSVVHMMAMLALFEANLLLIPKSSQGGGERKVAEDAKKDVVDSLLRASGCLDYSVHRILVQIPAQVKKSFPSYLQEGMLEAISIQALAQCVEIQLGLASECEKATLSVKRRLACEQVSYFSQAHYCLSGCDTSDSYGKKLLLFLKWKWMEAKAVAYYYHGLVLDKGGEPANHTSAVCCLSAADDLLSDSKRACLSFCLANPVTRVPPPWGVMKNMHKKIPDVANKKFQAHGHLFEQNKNSALQSVPDLPEFALSLRPDGYELPITDSIWENVDGQPQIQSLKEHMIDDEDEVGTK

SEQ ID NO: 7251 - protein, 229 aa, Zea mays
MGKRWIPLEANPDVLNQFIWGLGVHEEDVQFCDVYGLDDELLAMVPQPVLAVLFLYPLTSLDEEKEESSVSAATSTSAGKELSKKVYFTKQTVGNACGTVGVIHAIGNATSQIKLVEGSYFEKFYKQTADMDPAQRAAFLEEDDEMEDAHSVAASAGDTDANVDVNEHFVCFSCVDGELYELDGRKSQPTSHGPSSPETLLQDAAKVIKARIAENPNSMNFNVMALSKK

SEQ ID NO: 7252 - protein, 323 aa, Zea mays
  misc_feature (18)..(18): Xaa can be any naturally occurring amino acid
FQAGDAFEYLTHEGLLFXGNPFRRIREVELKRDYAFIEFSEHRDADEARYQLDGRDVDGSRIVVEFAKGVPRGPGGSREYMGRGPPPGTGRCFNCGMDGHWARDCKAGDWKNKCYRCGERGHIERNCQNSPRSVSYSRSPSPRRGRGRSPSYSRSRSRSRSRSYSRSRSLSGSPRGGRRDRDDRRSRSLSYSRSPVRSPPAKEKERSPTPGGSRSPRSRSPQDQVMSPPPKDNGDRNGSDRGDSPRGREDSRSRSRSPSGGNRSPAANGRSPSPRGDRTPSPMADRGPSPMADRSPSPKGNGNNDGGDDDTGRGGSPTGSKSP

SEQ ID NO: 7253 - protein, 146 aa, Zea mays
  misc_feature (129)..(129): Xaa can be any naturally occurring amino acid
MEMKLTIRRVPTVVSNYQEDADKPRAGCGRNCLGDCCLPASKLPLYAFKLTPAKGSQEDAASTKLLLLVDILLSEWEDRMTRGLFRYDVTACETKVIPGNLGFVAQLNEGRHLKKRPTEFRVDRVLQPXFDPAKFNFTKVGQEEVL

SEQ ID NO: 7254 - protein, 347 aa, Zea mays
  misc_feature (85)..(85): Xaa can be any naturally occurring amino acid
LGTSRPAGRLRLPLARIIPPRERGRLLVPRLPRPRTLASALPTAAATLEWPRRRHPSRPPTSPQSRRCPLPPSHISFASAAPAAXAQRIVAMAGSGKFFVGGNWKCNGTKDSISKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFDVCFRQMKAFADSISNWADVVIAYEPVWAIGTGKVATPEQAQEVHAAVRNWLKTNISPDVASSTRIIYGGSVNAANCAELAKKEDIDGFLVGGASLKGPDFATIINSVTAKKVAA

SEQ ID NO: 7255 - protein, 549 aa, Zea mays
  misc_feature (379)..(379): Xaa can be any naturally occurring amino acid
MEQRNVLALGEHVLKATVWKRKHKTAMEHPEGNDVMVFSQHDQRKHPVIFDDRAKCKKSKLISCGSGVILESYWNFKTSGLPVRVLFYQHGDWSDFPEDVVNLAQQDFQLKKPITTAVFQNKHILLDFIHMICIDYEMTIDKPLAWVDDNGKRFFPDLSAGLYTSKPSQHENGEADECDGTPTSVAESSSSVSVGEVVSHGKRINDIAEDNMRAHNILYEAVGENISGPSFHLNEYSSGTIQATGKPNDCRRIDSAVRNLLLKGLGQPFSEEDIIGIYRTPLLDQRGQVRCGLFQKEIEETRSRRGNANVRYAWLPCSRYTMEQMAMRGALEIAKPHKGSICGVGTWLAPANCTNSCARYSDFHEDGIIRMMLCRVIMXYIVWDANVHKHIYAEYAVIVQAPLVTNECSGLKDSVPNISEIISSGSRDNLTKEDRFAPCGVEQEAPRLGRAPRAPSSPWMPFSMLFAAISTKVPRSDMELVIRYYEEFKRKRMSRSDLVVRMRQIVGDKILVSTIMRLHHQKKPPSMAAAAAGLARALARGEEGGGVAE

SEQ ID NO: 7256 - protein, 214 aa, Zea mays
QIMIIDYKLTYPSGTATAVLINGFHTTHGDATAKQQVNGFTKYFAISFFWSFFQWFYSGGDNCGFSQFPTFGLRAWKQTFFFDFSLTYVGAGMICSHLVNLSLLLGALLSWGIMWPLVSDLKGDWYPADMPESSMRSLQGYKAFICIALLLGDGLYNFVKVVAFTVKSLLGRSRLKNAKKEEDIPVLDEIQRNEIFTRDSIPTWLAYSGYLALS

SEQ ID NO: 7257 - protein, 246 aa, Zea mays
SIPIATQPEASARKSPFPNPHATASVFSVASVYSAKRDALTFPRGLSVVPRVWRRLAATYLAAFALLFAYHAVAVLVFVGLVVAADNGSGLAGLLGFLVADAYLLGLVYLGVVWHLASVVSVLEDHKGFAAMRKSKDLIRGKLVTAGAIFFTLNVVFAAVELGFRAWVVRGSGAASSRLLLGLIMLAALCCVVMLALVTQTVVYLVCKSYHHESLDKANISDHLEVYLGDYVPLKASDVQMEQFQV

SEQ ID NO: 7258 - protein, 625 aa, Zea mays
  misc_feature (95)..(95): Xaa can be any naturally occurring amino acid
MDQLVNFIIRPPRADYSPNDDLLEQEFMLKGRWFLRKDLEDKQTGHATLRCNSGGDLYTYPSTTAPSCSLATTSSLWHHRLGHPGPSSLAKLRSXVKNGQGKKLQCSHYMPVVIPEGKALPCVIYCHGNSGCRADASESAIILLPSNITVFTLDFSGSGLSEGEHVTLGWNEREDLKAVVNYLRTDGNVSCIGLWGRSMGAVTSLMYGAEDPSIAGMVLDSPFSNLVDLMMELVDTYKYPLPKFTVKLAIQHMRKIVKRKASFDIMDLDTIQVAKQCFVPALFGHATEDDFILPHHSDKIYESYIGDKNIIKFDGDHNSPRPQFYFDSITIFFHNVLNPPEVAEDHYFMTPHGSLGQGHWDTEQDIEYRFSQSPTGTANATTTEDAIAQLRSRRLMSRMEVPSGATTEDRTDRTEGFDSDLGPSSSSVSTATPPNGRNGRLLTPTSDDGEYVEYSFDSLSDMPHTVEDEDRMLMQAILESLKDYEQSNTKNVQSTASDPASDPASKANGTVKDCNGVAAAALEQDASSFDAPDKHTNVPNSGEKVSEGQSTDCNAGKSSASVSASGSSEPLAPTQMVNGQPASVDSQKVTQNANGEDGTRATLVVQKSRTGGLIEKWGSFFKNND

SEQ ID NO: 7259 - protein, 212 aa, Zea mays
  misc_feature (36)..(36): Xaa can be any naturally occurring amino acid
PSRPAGSCGISIGLGATLNVAKPAKGSTVAIFGLGXAVGTCLLCEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 7260 - protein, 440 aa, Zea mays
MSTTKVKRRVGKYELGRTIGEGTFAKVRFARDTVTGEAVAIKILDKEKVLKHKMVEQIKREISTMKLIKHPNVVRIYEVMGSKTKIYIVLEFATGGELFDTIVNHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEFTFPPWTSFPAKRLLTRILDPNPMTRITIPEILEDEWFKKGYKRPEFDEQYDTTLDDVDAVFNDSEEHHVTEKKEEEPVALNAFELISMSAGLNLGNLFDSEQEFKRETRFTSKCPPKEIVRKIEEAAKPLGFDVQKKNYKLRLEKVKAGRKGNLNVATEILQVAPSLHMVEVRKAKGDTLEFHKFYKNLSKTLKDVVWKSDDLQTQHAS

SEQ ID NO: 7261 - protein, 405 aa, Zea mays
  misc_feature (316)..(316): Xaa can be any naturally occurring amino acid
  misc_feature (329)..(329): Xaa can be any naturally occurring amino acid
LARRGGGGPYIFNTCAWRGPEEAQAEAAPALEGAWVWATAGRRRSRATHTHGGRYVQYNVYGNLLEVSAKYVPPIRPVGRGACGIICAAVNAQTREEVAIKKIGNAFDNQIDAKRTLREIKLLRHMNHENVISIKDIIRPPRRENFNDVYIVYELMDTDLHHLLRSNQQLTDDHCQYFVYQLLRGLKYVHSANVLHRDLRPSNMLLNAKCDLKIGDFGLARTTTETDFMMEYVVTRWYRAPELLLNCSEYTQAIDMWSVGCIFGEMVTREPLFPGKDYVHQLRLITELVGSPDDTSLGFLRSDHARRYVRSLPQHXKQQFRVRFPTMSXGAMDLLERMLVFDPSKRITVDEALCHPYLASLHEVNDEPICPAPFSFDFEQPSLTEEAIKELIWKESLKFNPDPIH

SEQ ID NO: 7262 - protein, 162 aa, Zea mays
MALVGQVATVAQLVGVDAFSLITMIADAAQTARRNRAVCRQLAQRVEMIGSLLRRLREQDDNDDMRLLRHAETRGPVEALEETLRRAYLLVRSCQRRGYAFRCLMGARHADELREMQGEIGFYLDLFPLISYVDWARRRGNGNGKAACGDTRSLQEVPAHNC

SEQ ID NO: 7263 - protein, 365 aa, Zea mays
MVCIGSLLRALVLRAASSAGRRRGPRILCGRATDVRVTPRHGHGWRGFRAVTGRMMLDSSESASSAAAAAAEAGAGAVAGQAQPQRRAVGAVPQAHDGGYASGGWEREDGKLSCGYSSFRGKRATMEDFYDVKLTEIDGQAISLFGVFDGHGGSRAAEYLREHLFENLLKHPDFLTDTKLAISETYQKTDTDFLESEASAFRDDGSTASTAILVGDRLYVANVGDSRAVISKAGKAMALSEDHKPNRIDERKRIENAGGIVIWAGTWRVGGVLAMSRAFGNRLLKPYVVAEPEIQEEQFSDELECLVLASDGLWDVVENEEAVSLGKSEDTPESAARKLTEIAYSRGSADNITCIVVQFHHDKTG

SEQ ID NO: 7264 - protein, 349 aa, Zea mays
MDGTSFDLTEHEGSNLSPFLLKLFNEWDDRKTRGLFHHDISSCETKVLPGVHNFVATLIEGRDQKKRPTEFTMNQVLQPFVSEKFNFTKVSPLEVIFRFNDTEKDPAQYFDGVPDTVSASSSAILINVSPIGYCHVLLTPKIQDCLPQRIDQESFLIAMYVAREARTPFFRVGYNSLGGFATINHLHFQAYYLKVQYPVEKAITEKLKTLGNSVSIFHLVDYPVNGFVFEGGASLEDLSDVVSKVCIFLQENNRPFNVLISESGKRIFLLPQCYAEKQLLGKASQEFLDMRINPAIWELSGHLVLKRRKDYEEASEANIRRFLVEAALSETEFQELNRCVLDFLTSSLG

SEQ ID NO: 7265 - protein, 328 aa, Zea mays
MAGETVLVTGASGFIGSTLVRLLLGRGYNVHAGVLNPDDGAETEHLLAMAAGAGAGEGRLRIFRGDLLDGAALTDAARGCSGVFHLASPCTVDPVSDPQKQLIVPAVEGTLNVLRAAKEAGSVRRVVVTSSSSAIMPSPGWPAGELRDERCWTDIDYCKKNGVWYPVSKTLAEKAAWRFAEENGLDVVVVNPMSVLGQIIPPTINSSMSVLLRLLQGCTEEYKDIWMGAVHVEDVALAHLLVFENPSASGRHICAESISHLSDFAAKLAELYPSYKVPKFPKDTQPGLVRAEAGVASKKLVELGLQFSPLEKIIRDAVESLKSKGYIS

SEQ ID NO: 7266 - protein, 417 aa, Zea mays
MAMSASSSSRALLRRIGGALLRRSFSSSSAAAAAGYHVAGGPSYMRGAVFWEPGRPLTLEEFRMPRPKAGELLIKTKACGVCHSDLHVLKGELPFSTPCVVGHEITGEVVDHGTHTPAEIINRFPVGSHVVGAFIMPCGNCFYCVKGQEDLCESFFAYNRAKGTLYDGETRLFLRGNGKPVYMYSMGGLAEYCVVPANALAVLPDSLPYTESANLGCAVFTAYGALRHAAEMRPGDSVAVIGVGGVGSSCLQIAKAFGASQVIAVDVLDEKLQNATTLGATHTVNAAKDDAVERIKEITDGRGVDVAIEALGKALTFSQCAKSVRDGGKAVMIGLAATNVMGEVDITRLVRRQVKIIGSYGARARQDLPQIVKLAESGAFNLQNTISRKCKFEEANGAYEDLNQGKIVGRAVVEIME

SEQ ID NO: 7267 - protein, 347 aa, Zea mays
MADNSIEQALIENPPNALKWKPSERAKRFRRCRSTPSDPTDQKPAENGSVLKAKELFKEKRPSFMLVGLLLFAYLLVGVIIFYLFMDQLSGKTTDRVLDALYFVIVTMTSVGYGDLFPNSDTTKLLACAFVFTGMAIIALFISKAADYLVEKQEVLFFKALHMNMKGSEAKMLGAMETNRIKYKFYTVALLLAMVIVAGTVFLWKVEKLSLVDSFYCVCATITTLGYGDKSFSSKLGRVFAVFWITTSTLIMAQFFMYLAELYTERRQKILTKWVINRRITTMDLEAADIDDDRQVGAAEFVLYKLKELGKISQEEISCFPEEFDKLDVDQSGTLSTYDLTLGQTSQ

SEQ ID NO: 7268 - protein, 99 aa, Zea mays
  misc_feature (45)..(45): Xaa can be any naturally occurring amino acid
FVCLVVGWSGHPVCVKRYHFIIENDSSHLSGRRRTCCLRWGTPMXLHLDDPTHLLHAGGHANGYGHLLRVNGREGGSRFLTGRDIMSLWDRLCKGLHVR

SEQ ID NO: 7269 - protein, 596 aa, Zea mays
MAAMNGEVLGECGRNINSLKRKRESPAAYAAGVFCTSELHQHTVNDSAVRFHLDKDRKAKIVCHFNKQVLQSYKKFMSSAPPKRILLRQGAVWKDFPEKIVKLAQADFRAKKMITETGYQNQLFLLDFAHMTFIDTKTGFQRPIAWIDENEKCYFPESFIQDQKLFMKKDFGNGNHEYISEERNGTRETNHQFGASESSAESSNFESSIGDVSSPKRARAEKNFIVKKYCDMGEAIGENEPCTLLPTACNLLPHQANLGEVSRAQRTIEAVEKLLLQGMGSVIESKDIIGIYRTPLLDDHGQVRYHIHQKQVQVTGCHRGNANVRYAWLPCSKSTVHVMMLNGVLQVDKPPNKCAAYGEGTLLTPANRSDACVKYSDVDENGIVRMMLCRVIMGNVEIVHPGSKQCQPSNKYFDSGVDDLKNPRHYVVWDMNLNSHIYSEFVVTVKLPSKTKDSFVSQENCQNSSDLSLVLNSSSPDCISQEMNLEAPPALGGGCAAPMLGDSMEKAPSSPWMPFSMLFAAISTKVSPENMDVIIGCYEEFKSKKISRGELVKKLRHVVGDRVLISTIMRLQDKQLPPVDKREEPDTSASKVVAEP

SEQ ID NO: 7270 - protein, 170 aa, Zea mays
FLLIIYFCHTKCWHHQVVRLFNEAAQMSPEDADVHIVLGVLYNLSREYDKAIASFKTALQLKPQDYSLWNKLGATQANSIQSADAILAYQQALDLKPNYVRAWANMGISYANQGLYEDSIRYYVRAVAMNPKADNAWQYLRISLSNASRADMIAACDARNLDALQKEFPL

SEQ ID NO: 7271 - protein, 77 aa, Zea mays
KRIYVTNSLFSRWDEQFFGDDLVKKGSPMLQIDVDTEKGGLAVNPNFFVDFGTEPDGPALAHEMRYPGGDCTSDIWI

SEQ ID NO: 7272 - protein, 597 aa, Zea mays
  misc_feature (368)..(368): Xaa can be any naturally occurring amino acid
  misc_feature (382)..(382): Xaa can be any naturally occurring amino acid
MVEIGSRVRGFLRNRWLVFVAAMWMQSCAGVGYLFGSLSPVIKASLGYNQRQVAGLGVAKDLGDSVGFLAGTLCSVLPLWAALLVGAAQNLVGYGWVWLAVTRRVPVPPLWAMCILIFIGNNGETYFNTAALVSCVQNFPKSRGPIVGILKGFAGLSGAILTQIYAIVHSPDDAALIFMVAVGPTMVVIASMFIVRPVGGHRQVRPSDGTSFTFVYSVCLLLASYLMGVMLLEDLVDLSQSVTVVLTVILIMFLLVPIVIPVLLSFFSDDDETLYALLLPSPRKEEPSASTSSEEQQEVILSEVEDEKPKDVDLLPASERQKRIAELQTRLFQAAADGAVRVKRRKGPRRGEDFTLMQALIKADFWLXFLSLLLGSGSGLSXGIDNLGQMSQSLGYEETHIFVSMIGGWNFLGRIGGGYFSEIIVKDYAYPRAIALGIAQILIAIGHFNFAMAWPGTMYVGTLLVGVGYGAHWAIVPAAASELFGVKNFGALYNFLTVANPAGSLVFSGVIASGIYDAEAAKQAQQRHSTSKLLATSGRVVSVVSEAAPALKCEGAICFFLSSLIMAGFCVVAFGLSLILVYRTKVVYAGLYGKPRT

SEQ ID NO: 7273 - protein, 259 aa, Zea mays
ARGSRSRAAARDLEPSGHWARDCKAGDWKNKCYRCGERGHIERNCQNSPRSLRRERSYSRSPSPRRGRGRSRSYGRSRSRSRSYSRSRSLSRSPRGGRRDRDDRRSRSPSYSRSPMRSASPPVKEKERSPAPDGSRSPRSRSPQDQVMSPPPKDNGEGNGSDRGGSPRGRENSRSCSRSRSPSGSNRSPAANGRSRSPGGERSPSPGGERSPSPRGERSPSPRADRSPSPNGNGNNDAAADVDADAAARSGSPTGSKSP

SEQ ID NO: 7274 - protein, 203 aa, Zea mays
MLVDLTNHLLVNRVGSGRAHASSPSQSRFSSSHITADEPSSYPEARAPEPSDIGGAIGLMAVALVLLGTWPVVLAVLERRGRLPQHTFLDFSATNFMAAVLIALTFGQIGPASSTPNFLTQLTQFKNNWASVLFAMAGGVTLSLGTLATQYGWAFVGLSVTEVMASSLKVVIGTTVNYFLDGRMNKAEILFPGVGCFLIAAIL

SEQ ID NO: 7275 - protein, 394 aa, Zea mays
MPISCRLAFGYAYPAYECYKTVELNKPQIEQLIFWCQYWILVALLTVLERFGDFTISWLPFYSEAKVLFFVYLWYPKTKGTTYVYGTFFKPYISQHENEIDRNLLELRARATDMVVLYFHKAASVGQNTFFDVLKYVAAQSPSRKSRLHPHQEPQQQQPQVQHENEIDRNLLELRARATDTVVLYFQKAASAGQSTFFDVLKYVAAQSPSQKSRQRLHQDSQQPPQQQQPQVQVQQAQPQKQAAPVMRRASSIAARQAAMAQQSQETKPVSSSPKIKRQTSARSGSVASTKPPVAASALKPGGSPKKGEVKPAADPVQTPTTGADSPKPEPSAPSLPGAEGVDKMAIDEASGDAPEGAEELDPALEEETPMEETIRVTRAKLRRRTATEDPAGN

SEQ ID NO: 7276 - protein, 348 aa, Zea mays
MSSSAGDKRKKTACVTGGNGYIGSALIKMLLEDGYAVKTTVRNPDDMDKNSHLKGLQQLGPLTVLRADMDEEGSFDDAVAGCDYAFLVAAPVNLSAQDPEKEQIEPSVRGTLNAMRSCAKAGTVRRVILTSSVAGVYIRPDLLQLRGDGHVLDEESWSDVEYLRANRPPTWGYCVSKVLLEKEACRFAGEHGISLVTVCPVITVGAAPAPKVRTSIIDSLSMLSGDERGLAVLKGIEKTSGAVQLVHVDDLCRAELFLAEAAAADGRYICCGLNTTVLELARFLAHKYPQYGVKTNLDGDEQQLLEKPRVRVSSEKLVREGFEYRHNTLDEIYDNVVEYGKALGILPY

SEQ ID NO: 7277 - protein, 182 aa, Zea mays
  misc_feature (116)..(116): Xaa can be any naturally occurring amino acid
  misc_feature (119)..(119): Xaa can be any naturally occurring amino acid
  misc_feature (160)..(160): Xaa can be any naturally occurring amino acid
GSTSRPVRCMARRPDSSYSPLRSGQGGDRAPTEMAPLFPGCDYEHWLIVMDKPGGEGATKQQMIDCYIQTLAQVLGSEEEAKKKIYNVSCERYFGFGCEIDEETSNKLEGLPGVLXVLXDSYVDAENKDYGAELFVNGEIVQRSPERQRRVPPVAPAASXDRTRYSDRTRYVKRRENQSYQR

SEQ ID NO: 7278 - protein, 452 aa, Zea mays
  misc_feature (123)..(123): Xaa can be any naturally occurring amino acid
  misc_feature (163)..(163): Xaa can be any naturally occurring amino acid
  misc_feature (191)..(191): Xaa can be any naturally occurring amino acid
  misc_feature (224)..(224): Xaa can be any naturally occurring amino acid
  misc_feature (343)..(343): Xaa can be any naturally occurring amino acid
  misc_feature (383)..(383): Xaa can be any naturally occurring amino acid
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLXAVCKAGAMVKKIPLYQHIANLAGNKTLVLPVPAFNVINGXGSHAGNKLAMQEFMILPTGASSFKEAMXMGGLKVYHNLKSIIRKKYGQDATNVGDEGGFAXPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRXVAKAINEKTCNALLLKVNQIGSVTESIEAVRMSKRAGWGXVMASHRSGETEDTFIADLSVGLSTGQIKTGAPCRSERLAKYNQLLRIEEELGDAAVYAGAKFRAPVEPY

SEQ ID NO: 7279 - protein, 672 aa, Zea mays
MPTPPLRGAGLLLRICLFLCLSLRPRLASSEPDADKAALLAFLSGVGRGATARARINWSTTHLACSADGPGPGWTGVTCSADGARVVALHLPGLGLSGAVPPGTLGRLTALQLLSLRSNDLSGPLPADLLRLPALEGLHLHRNAFSGALPAALAGLTALQVLDLSFNAFDGAVPGALANLTRLVALDLSNNSLSGRVPDLGLPALRFLNLSNNRLDGTVPASLLRFPDAAFAGNSLTRPAPAQAPPVVVAPPPGLAAPPPARRRPRLSEAAILAIAVGGCVLGFAVAALLLLAFCNSSREGRDEETVGGGAAAGKGGEKKGRESPESKAVIGKAGDGNRMVFFEAPSLAFDLEDLLRASAEVLGKGAFGTAYRAVLEDATTVVVKRLKEVNAGRRDFEQQMELLGRIRHDNVVELRAYYYSKDEKLLVYDYYSRGSVSNMLHGKRGEDRTPLDWETRLKIALGAARGVAHIHTENNGRFVHGNIKASNVFINKHEHGCVSDHGLASLMNPVTARSRSLGYCAPEVADTRKASQSSDVYSFGVFVLELLTGKSPVQITGGGGGDVVHLVRWVQSVVREEWTAEVFDGELLRYPNIEEEMVEMLQVAMACVSRSPERRPRMADVVRTIEEVRRSGSGTATGTGTRPSTEASTPATAAEAAQSRAEEGGSSAVAQ

SEQ ID NO: 7280 - protein, 322 aa, Zea mays
  misc_feature (72)..(72): Xaa can be any naturally occurring amino acid
  misc_feature (126)..(126): Xaa can be any naturally occurring amino acid
  misc_feature (156)..(156): Xaa can be any naturally occurring amino acid
  misc_feature (187)..(187): Xaa can be any naturally occurring amino acid
  misc_feature (199)..(199): Xaa can be any naturally occurring amino acid
  misc_feature (234)..(234): Xaa can be any naturally occurring amino acid
  misc_feature (244)..(244): Xaa can be any naturally occurring amino acid
  misc_feature (252)..(252): Xaa can be any naturally occurring amino acid
  misc_feature (266)..(266): Xaa can be any naturally occurring amino acid
  misc_feature (292)..(292): Xaa can be any naturally occurring amino acid
  misc_feature (316)..(316): Xaa can be any naturally occurring amino acid
MRGHKPHPTYIIPCPLSFFLHKHVKSNLEALFLPPSLPLSLFAVRSSAPQSNRHLTEMGRKFFVGGNWKCNXTTDQVEKIVKTLNEGQVPPSDVVEVVVSPPYVFLPVVKSQLRQEFHVAAQNCWXKKGGAFTGEVSAEMLVNLGVPWVILGHSEXRELCLGESNEFVGDKVAYALSQGLKVICMCXGETLEQREAGSXPVDVVAAQTKSNWLRRSKDWSNVVVAYEPVWAIGXTGKVATPAQXAQEVHASXEGHWLKTQWPGPEXVAESTRIIYGRLCNCLRTAKELAAQXPDVDGFLVGGASLKPEFIDIINAXATVKSA

SEQ ID NO: 7281 - protein, 714 aa, Zea mays
MAAAEWDSRSVASPTGDWPPAAAASPIKGKAALPESDGGASASGSSEAKVDDGNIQEAESSLREGLSLNYEEARALLWRLEYQRGNVEAALRVFDGIDLQAAIQRFQPSLSDKPLSKRSNKLRADSSNSGSQHAASLVLEAIYLKSMSLQKLGKAMEAAKQCKSVLDAVESIFQCGIPGVMVEQKLQETVSKSVELLPELWKQAGAYQEALASYRRALLSQWNLDDECCTRIQKRFAVFLLYGGVEAAPPSLASQTEGSFVPRNNLEEAILLLMILLKKWFLGKTHWDPSVMEHLTFALSLCGQTSIIAKHLEEVLPGIYPRTERWYSLALCYFAVSHNEAALNLLRKSLNKNESPNDIMALLLAAKICSSNNLLSSEGVEYAKRAVRDAESSDGHLKSVALHVLGSCLSRKSKVASSDHQRSVLQAEALKSLNEAISLDRHNPELLFELGIEYAEQRNMHAALKCAKEFIDVTGGSVSKGWRLLLLVLSAQQRYSEAEVVTDAALDETAKWEQGPLLRIRAKLKVAQALPMEAVEAYRTLLALVQAQRKAYGSVKNGTEDNEDKVREVEVWHGLANLYSSLSYWRDAEICLQKAKALKTYSATTLHVEGNKHELHEKIQDAVAAYFNAISMEVEHVPSKVSIGALLSKQGPKFLPVARCFLSDALRLEPTNRMAWFYLGEVHKQDGRLADAADCFQAASMLEDSDPVESFRSL

SEQ ID NO: 7282 - protein, 154 aa, Zea mays
  misc_feature (116)..(116): Xaa can be any naturally occurring amino acid
  misc_feature (151)..(151): Xaa can be any naturally occurring amino acid
MDASGAGSMGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAXGGVLPNIHSVLLPKKVAENASSGGSKESKSPKKAXKSP

SEQ ID NO: 7283 - protein, 428 aa, Zea mays
  misc_feature (386)..(386): Xaa can be any naturally occurring amino acid
MSYHCRVLVPVLFPYPPGAGARVGASAGSPFPSASRALRLPRPRASVEKREQVAAMEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFVGSCRSCDSCGKGDDNYCAGIVLTSNGVDHAHGGAPTRGGFSDVLVASEHYVVRVPDGLALDRTAPLLCAGVTVYSPMMRHGLNEPGKHLGVVGLGGLGHVAVKFGKAFGMKVTVISTSASKRQEAIENLGADEFLISRDENQMKAATGTMDGIIDTVSAWHPITPLLALLKPLGQMVIVGAPSKPLELPAYAIVPGGKGVAGNNVGSVRDCQAMLEFAGKHGIGAEVEVIKMDYXQHGHGAAREERRPLPLRHRRRRQPRLCRLGVAAKVSIRAQPQ

SEQ ID NO: 7284 - protein, 263 aa, Zea mays
  misc_feature (125)..(125): Xaa can be any naturally occurring amino acid
MKQETDDGSRRLVVGRARHRGGLARQRAARAGRGLCGVAVGRALGRLLPVLLVREREKARERENREERGRREHGGLIEDGCRSKGGKKAAAGRRGGGGPKKKPVSRSVKAGLQFPVGRIGRYLKXGRYSQRVGTGAPVYLAAVLEYLAAELLELAGNAARDNKKNRIIPRHVLLAIRNDEELGKLLAGVTIAHGGVLPNINPVLLPKKTAVAAAKEGKEKKSPKKAAAAKSPKKFLYAGLKFRQTMWCMFCKMPELGCSLLLD

SEQ ID NO: 7285 - protein, 375 aa, Zea mays
MAAAAIHQFAESITWHAWSPDQSMIAFCPNNHEVHIPTRPTDKWEKLHVLSKHDQIVSGIDWSNSSNKIVTVSHDRNSYVWTQEGSDWIPTLVILKLNRAALCVQWSPKENKFAVGSGAKSVCICYYEQENNWWISKVIRKRHESSVTSLAWHPNNIYLATSSTDGKCRVFSTFIKGVDTRGSKSSTSTDSKFGEQIAQLDLSSTWVFGVRWSPSGKTLAYAGHNSMIYFIDEVESSPVAQNLALRDLPLRDVLFVSERTLIGVGFDCNPMIFAADDTGLWSFVRFLDEMKAAPSASKASQLSEALGKLYGQSKQGASSDTVEPSKARGGAHENCITCIVPLRKGSDGTIKRFSTSGLDGKVVVWDLENHVSIAK

SEQ ID NO: 7286 - protein, 348 aa, Zea mays
MSSSTSGTREMSSPNSTATSIGQVQKVPGFAKLQGENFVYFMQTYSIMLGRTSRSYTADFDLSKYECGSQCVSRCHACIFYDFELRHFAIEVLGRNGCTIRGVSYLPGSVPIKLNSQDLIEIAGIKFYFLLPSRSIFATLAARDATMLPPQSPSLLHPNYPGNPSANDCGRSNGENGVKISNDMQGKLVKQKRSFSGELDISYSYGTKKNVDRVGTLDGCVNKLHIQIADKDTDNQQILLEEEKDVTTCLTTLISELSGPKEWVPMERLLSEIFKRFGKKWLRDRVSKYLPQKGMSGSSTKVDHRPWCSLWELLRKHPEHFVMTTLTRGEETLDYVGLVHLVSVENEP

SEQ ID NO: 7287 - protein, 498 aa, Zea mays
MGLFTVTKKATTPFDGQKPGTSGLRKKNFVQSTFNALPVDQVRASHNPGGPKEDFGIKYNMGNGGPAPESVTDKIFSNTTTISEYLISEDLPDVDISVVGVTSFSGPEGPFDVDVFDSSVDYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEFFGNLMDAGMCSICGEESFGTGSDHIREKDGIWAVLAWLSIIAFKNKDNLGGDKLVTVEDIVRQHWATYGRHYYTRYDYENVDAGAAKELMANLVSMQSSLSDVNKLVKEIRSDVSEVVAADEFEYKDPVDGSVSKHQGIRYLFGDGSRLVFRLSGTGSVGATIRVYIEQYERDSSKTGRDSQDALAPLVDVALKLSKMQEYTGRSAPTVIT

SEQ ID NO: 7288 - protein, 303 aa, Zea mays
AERFLKAVLDIPFAFKRVDAMLYRANFEAEINYLMKSFETLEAACEDLRGSRLFLKLLEAVLRTGNRMNVGTNRGEAKAFKLDTLLKLADVKSTDGKTTLLHFVVQEIIRSEDAKSEKESAMIIHSSKDEQLRKQGLKLVSGLSSELGNVKKAAMMDFDVLHGYVSKLETGIEKIKSVLQLERQCTQGQKFFTTMQSFLKKAETEIDKVRGEEKKALVRVKDITEYFHGDTAKEEAHPLRIFMVVRDFLSTLDHVCKEVGRLQQDRTVIGSARSFRISATSMPVLSVYGQRRENNSDDDSASS

SEQ ID NO: 7289 - protein, 342 aa, Zea mays
MEQAAMPQVPRVKLGIQGLEVSKLGFGCMGLTGTYNAPLGDEAVAAVVAHAFRRGITFFDTSDAYGPRTNETLLGKALKQLPREQVQVATKFGIGQGAAGMTVCGTPEYVRACCEASLRRLDAGYIDLYYQHRVDTTVPIEDTIGELKKLVEEGKVKYIGLSEASPDTIRRAHAVHPITAVQMEWSLWSRDIEPEIVPLCRELGIGIVAYSPIGRGFFGGRGVTQQVSSESSLQRHPRFTTESLEKNKQIYLKIEDLAKKYQCSPAQLALAWVLHQGDDVVPIPGTTKTKNLDANVDSLKVKLTAEDLKEIGSQIRAEDVAGGRQYNSYAHTSWKYADTPKK

SEQ ID NO: 7290 - protein, 408 aa, Zea mays
  misc_feature (122)..(122): Xaa can be any naturally occurring amino acid
  misc_feature (145)..(145): Xaa can be any naturally occurring amino acid
MDDAGRAPPPAPAAVTVSATAAPAPTPPSATVAADKSSLDPDALYEEGMWQQMAMNSGATMQPGSYPERPGEPDCTYYLRTGLCRFGMSCRFNHPPDRNLAIASARMKGEYPERVGQPECQXKAGIAGRVQLNTLGYPLRPNEKXECAYYLKTGQCKYANTCKFHHPELFNVVPSSRGSPIYTSVHSSASAGPQSYTGTMSSWTFPRASFIPSPRWQSPSNYAPMIVPHGLVQVPSWNSYPGQLQSPGAQQTYGSSQQGEASAGNQGMLSPYRSSSFPVPQYVLQRDNVFPERPDEPECQYYMKTGDCKFGAVCKFHHPRVRSQPPPDCVLSPMGLPIRPGEELCKFYSRYGICKFGANCKFDHPTMAAPMGVYAYGFSGSASVAPASTNAPMTRHLLGSPSGSGYMS

SEQ ID NO: 7291 - protein, 354 aa, Zea mays
MCVEGLDDAAGRLGFGDQDTDRRAGDAMERVCENTVAVDFKQTKLNNFVPFIRSGEWSDIGGRDYMEDAHVCISDLAKNFGYDSVEDEVISFYGVFDGHNGKDAAHYVRDNLPRVIVEDADFPLELEKVVKRSFVQTDSKFAEKFSHHRGLSSGTTALTAMIFGRSLLVANAGDCRAVLSRRGTAIEMSKDHRPCCMNERKRVESLGGYVDDGYLNGQLAVTRALGDWHLDGMKEVGEPGGPLSAEPELKMVTLTKDDEFLIIGSDGIWDFFSSQNAVDFARRRLQDHNDLRLCCREMVDEAVRRGASDNLTAVMVSFHPDAPPPSRANKRTGRVTRSISAEGLHSLRVLLEGQ

SEQ ID NO: 7292 - protein, 424 aa, Zea mays
  misc_feature (313)..(313): Xaa can be any naturally occurring amino acid
  misc_feature (372)..(372): Xaa can be any naturally occurring amino acid
AEHSMELEAIGKRLRISSGSSSLARDRLTSLPDCVIHHIMSFLRARQVVQTCVLSTRWRHLWRSVPCLDIDQDEFKAAGSNRITEKEREHFEDFTDHLLIPNNISIALLDTLRLHVSDDEYYHRGASVRWIRHGIKYSAQNPGIMHKESNLAFWRLKKLHLSGVYLDGSFMKHVSSGCPYLEVLELKDCPCTFEEVTSHTLKNLILENCGCNGLYGITITSPTLKSLTIIGSEYYNTITLVLKAPAVAYLLLDVIAYFVKFGVSFDEMSSLAKASIYLRDCVGSGLSKHQFKLLCSVFNVTTLVLSGFQTMVXCCLHRCFLIALNYIAVPFLLLNELYNTFQMLANFLQHSPDLEKLTLGRCKFSKDPKRGXLNQFNVRCKNLKLTEIIYEDADAKKVVELFWSMSGDLPKNYIKLPKVDPDHP

SEQ ID NO: 7293 - protein, 568 aa, Zea mays
  misc_feature (178)..(178): Xaa can be any naturally occurring amino acid
MLRHYSKNLSLAREHVQSYTLSQSDRRRGVKTSATATMTWHEDLATHVGNTGVRLPGAGGHAPAAANVAAAGAGWYGEEEEGRAEEGWAQQAKGFAESTAEMLRELGRGLWDVAAQSLAGAEDSEVARRLRKRAAATGKRLSFMNEYLPEERDPVRCWLTVGAVAFVTADLASAALVXRQRRETPGELQETLPIGPPSADRIQLPDGRHLAYEEQGVSANRARFSLIAPHSFLSSRLTGIPGISASLLEEFGVRLVTYDLPGFGESDPHVGRNLNSSALDMLYLANALNIPEKFWVVGYSGGGMHAWSALRYIPDRIAGAAMFAPMANPYDSKMTKDERRKTWDSWSTKRKLMHILARRFPSLLPFFYRQTFLSGKQGQLESWLSLSLGKKDKTLLEGPVFNAFWERNVAEAVRQGDARPFVEEAVLQVSDWGFSLSDIQMQKKEAGGFFELIKSLFNQAEREWVGFLGPIHIWQGMDDRVVSPAVAEFVRRVVPGATVHKLLDEGHFSYFCFCDECHRQIFSTLFGIPQGPINPAPPQPGEVVSELTEETTVPDNATDEEQGKSGLP

SEQ ID NO: 7294 - protein, 467 aa, Zea mays
  misc_feature (74)..(74): Xaa can be any naturally occurring amino acid
METYTTDDALTAMGFGKFQALVLVYAGTGWLADSMELMLLSFVGPLVRQQWNVSAQHESLLSSVVFTGMLLGAXSWGYISDKYGRRTALLFSVTLTAGAGLTSALSPNYISLLALRFLVGVGVGGTHVFSSWFLEFVPTKNRGAWMLVFSAFWTIGTIFEASLAWVVLSRLSWRWLLAFTSLPCFALLVFFVVAPESPRYLCAQNRISDATLVLERMSRTNKAALPPGALAYHHTETQLGLGGSTTDDASKSGSGGMAALRRLFPRKLLRSTLLIWFVWFANSLAYYGLVLLTSQLSDANRRCASSSAHKSQAHEGNPNLYKDVFITSLAEFPGLVISAIIVDWLGRKATMWILLFGCCGFLGPLAVHQKESVTTALLFGARACGMGSSTVLCLYAPEVYPTSARSTGVGIATAIGKIGGIVCPLIAVGMLRSCHQMQAVLVFELVLGLAGVACILFPVETKGREMK

SEQ ID NO: 7295 - protein, 318 aa, Zea mays
HWREREPSANEKQSRAQNWRKWPEAADSASSGGQRRREKIRPGEIRPWRLTAQAGWRPGDAALAEDQRRREKIRPWRWPAFFGRWREMSIMKMLNHPNIVNLVEVIDDPNIDKFYMVLDYVEGKMVCDNGLEEGTARNYLRDIISGLMYLHSHNVIHGDIKPDNLLVTSAGNVKIGDFSVSQVFEDDDDMLWRSPGTPVFTAPECCQGSAYHGRASDTWAVGVTLYCMVSGHYPFLGDTLQETYDKIANDPVQIPGDMNPQLADLLLRLLCKDPGDRITLQAAAEHPWVAGDEGPVPEFICRCGFGRRKRNDVREEVQ

SEQ ID NO: 7296 - protein, 72 aa, Zea mays
  misc_feature (45)..(45): Xaa can be any naturally occurring amino acid
GEQKKKRIKSDTDSARFSAASRRNQLDQAASLKGEQIANGSGNWXAARVKSDDEKDEWFVVKVIHFDKETKE

SEQ ID NO: 7297 - protein, 180 aa, Zea mays
MRGAEEERSGAATDAGGEEEKQERSVGLMAGLMDKAKGFVVEKVMQIPKPEAALDHVSFRSISREGVELHSHVDISNPYSHRIPICEITYTFKSAGKVIASGTMPDPGWIAASGSTKLDLPVKVPYDFIVSLMKDLGGDWDIDYMMEVGLTVDLPAIGAFTIPLTTEGEIKLPTFRDLLF

SEQ ID NO: 7298 - protein, 393 aa, Zea mays
  misc_feature (309)..(309): Xaa can be any naturally occurring amino acid
MAPTACLRTPFFPARARSTNATPFSPHRRFSLKCSASNGDNSNPNSISISPTSPPRLTVSDGVESVDVNGLRRPPAPASVPAARDPHWLPRPLTSADVMEVDGKGLKVAYQGCAGAYSEAAAKKAYPNCETVPCEHFDTAFQAVQNWVADRAVLPLENSLGGSIHRNYDLLLRHSLHIVGEVRLAVRHCLLANPGVKIENLKSAMSHPQALAQCEHTLTSLGIEHREAVDDTAGAAKIVAEHMLQDTGAIASSLAAKLYGLDVLAENIQDDKDNVTRFMMLAREPIIPRTDKPFKTSIVFSLEEGPGQXFKALAVFALRDINLTKIESRPHKERPLRVSDDCSSLLKNFDYLFYVDLEASMADPKTQNALGNLKEFATFLRVLGSYPTDVNEP

SEQ ID NO: 7299 - protein, 169 aa, Zea mays
  misc_feature (95)..(95): Xaa can be any naturally occurring amino acid
MEYGQQGQRGHGATGHVDQYGNPVGGVEHGTGGMRHGTGTTGGMGQLGEHGGAGMGGGQFQPAREEHKTGGILHRSGSSSSSSSEDDGMGGKRKXKGIKEKIKEKLPGGHKDDQHATATTGGAYGQQGHTGGAYGQQGHTGGAYATGAEGTGEKKGIMDKIKEKLPGQH

SEQ ID NO: 7300 - protein, 168 aa, Zea mays
MEYGQQGQRGHGATGHVDQYGNPVGGVEHGTGGMRHGTGTAGGMGQLGEHGGAGMGGGQFQPAREEHKTGGILHRSGSSSSSSSEDDGMGGRRKKGIKEKIKEKLPGGHKDDQHATATTGGAYGQQGHTGSAYGQQGHTGGSYATGTEGTGEKKGIMDKIKEKLPGQH

SEQ ID NO: 7301 - protein, 479 aa, Zea mays
METYTTDDALTIMGFGKFQALVLFYAGMGWVAEAMELMLLSFLGPFIREEWNVSPENESPLSSVVFAGMLLGACAWGFVSDKYGRRTGLIFSTLFTSGMGFLSALSPNYLCLVALRFLVGVGVGGSHVFISWFLEFVPAQNRGTWMVIFSLFWTLGTILEASLAWVVLPALNWRWLLVFTALPCFLLLPFFGLTPESPRYLCAQNRMSDATSVLERMANANQSALPPGVLTYNRQTKCDHDVLAPESECLLPVREKECTVDNAKSSESGSLAALRMLLSRELLRSTLLLWFVFYANSFAYYGLVLLTSQLSDANKSCASGVSFGLRQKEINLYKDTFITSLAEIPGLFLSAVLVDWFGRKASMWSMMFACCAFLGPLVLQQTELLTTILLFGARACAMGSFTVLCLYAPEVYPTFVRSTGAGIATAIGRIGGVVCPLVAVAMLRSCHQMEALIVFEVILCLAAVACMFFPVETKGRGMD

SEQ ID NO: 7302 - protein, 86 aa, Zea mays
METYTTDDALTIMGFGKFQALVLFYAGMGWVAEAMELMLLSFLGPFIREEWNVSPENESLLSSVVFAGMLLGACAWGFVSDKYGRR

SEQ ID NO: 7303 - protein, 530 aa, Zea mays
  misc_feature (493)..(493): Xaa can be any naturally occurring amino acid
MAAGGGGSIADEKAPVAEAFGGHLEAAEMTEAEEEHSGGGGVKSRLSGLLWHGGSAYDAWFSCASNQVAQVLLTLPYSFAQLGMLSGVLFQLFYGLLGSWTAYLISILYLEYRTRREREKAADFRNHVIQWFEVLDGLLGRHWRNAGLAFNCTFLLFGSVIQLIGCASNIYYVNDRLDKRTWTYVFGACCATTVFIPSFHNYRVWSFLGLVMTTYTAWYMAVASLVHGQVEGVQHSGPTRIVLYFTGATNILYTFGGHAVTVEIMHAMWRPQKFKAIYLLATLYVLTLTLPSAAASYWAFGDELLTHSNALALLPRTPFRDAAVVLMLIHQFITFGFACTPLYFVWEKLIGLHDCRSLCKRAAARLPVVVPIWFLAIIFPFFGPINSAVGSLLVSFTVYIIPALAHMVTFRSPQSRENAVERPPRFAGGWTGAYVINSFVVAWVLVVGFGFGGWASITNFVQQVNTFGLFAKCYQCPPHLTAAPPAAFMPPPXHQWPRRPPCHRRRRRSMPPASSSLRCQPRFRLRLRRR

SEQ ID NO: 7304 - protein, 129 aa, Zea mays
  misc_feature (13)..(13): Xaa can be any naturally occurring amino acid
  misc_feature (36)..(36): Xaa can be any naturally occurring amino acid
  misc_feature (38)..(38): Xaa can be any naturally occurring amino acid
  misc_feature (45)..(48): Xaa can be any naturally occurring amino acid
  misc_feature (63)..(63): Xaa can be any naturally occurring amino acid
  misc_feature (83)..(83): Xaa can be any naturally occurring amino acid
KSKVIDNINFPGXFLELVPEVRELVNDFYASRYGSXLXHLEKLKXXXXLSDIHVHQHVETLYXEIRHKAIIQYALPFISVDLXAMAGAFKTSVSMCRRSWSLLITEAQIQEGIGSPTNILCARRAQQIK

SEQ ID NO: 7305 - protein, 92 aa, Zea mays
  misc_feature (13)..(13): Xaa can be any naturally occurring amino acid
VIKADDVVGPEVXKLVSALPNGNVVLLENVRFYKEEEKNDPEFAKKLASLADLYVNDAFGTAHRAHASTEGVTKFLKPSVAGFLLQKELDYL

SEQ ID NO: 7306 - protein, 374 aa, Zea mays
  misc_feature (257)..(257): Xaa can be any naturally occurring amino acid
MASALVPASFSLAHPAARRPVNSTGPAAMLMLRRAGLATVCPPERSLGSDCLRAGADPRLAIHVALRCRSASSTGRGTRAAATMTKKSVGDLTAADLEGKRVLVRADLNVPLDDSQNITDDTRVRAAIPTIKHLISNGARVILTSHLQELDYLVGAVSNPKRPFAAVIGGSKVSSKIGVIESLLEKCDILLLSGGMIFTFYKAQGHSIGSSLVEDDKLELATSLLRKAKEKGVSLMLPFDLVVADKFAPDASSQLSXVVPASAIPDAWMGLDIGPDSISAFSSALETTQTVIWNGPMGVFEFDKFAVGTKAIAKKLAELSGKGVTTIVGGGDSIAAVEKVGVADSLSHISTGGGASLELLEGKELPGVAALDEA

SEQ ID NO: 7307 - protein, 520 aa, Zea mays
MSSEASSVVVADENGAAETVGVGRYVEMEKDQDSSAAKSRLSGLLWHGGSAYDAWFSCASNQVAQVLLTLPYSFSQLGMLSGILFQLLYGLMGSWTAYLISVLYVEYRARKEREKADFRNHVIQWFEVLDGLLGRHWRNVGLAFNCTFLLFGSVIQLIACASNIYYINDKLDKRTWTYIFGACCATTVFIPSFHNYRIWSFLGLVMTTYTAWYLAVASLIHGQVDGVKHSGPTKMVLYFTGATNILYTFGGHAVTVEIMHAMWRPQKFKAIYLMATLYVLTLTLPSAASVYWAFGDQLLTRSNALALLPRTAFRDAAVVLMLAHQFITFGFACTPLYFVWEKLVGLHDCRSLCRRAAARLPVVVPIWFLAIIFPFFGPINSAVGSLLVSFTVYIIPALAHMITFRSATARENAMEPPPRLLGRWTGAYMINAFVVAWVLVVGFGFGGWASMTNFVRQIDTFGLFTKCYQCPPPPPLPFPGGGLGNITMPFNGDGLPPTPAPSPAHYFFRHHRHHSHHRGL

SEQ ID NO: 7308 - protein, 261 aa, Zea mays
  misc_feature (230)..(230): Xaa can be any naturally occurring amino acid
  misc_feature (244)..(244): Xaa can be any naturally occurring amino acid
  misc_feature (248)..(248): Xaa can be any naturally occurring amino acid
MASSSPDLADDGFAAPRLFSQGVSYTYDDVIFLPGYIGFPADAVDLSTRLSRRVPLSIPCVASPMDTVSEAAMAAAMASLGAAAVVHCNTEPHSQAAIVRAAKSRRLPFVSSVPFFSPSSSPTLNDFAGSEYALVTERGDSLSRLVGIAVAADAASREVPISVSEYMRPTPRSASSAFDFEEAATFLADEGLDYAPLVSDDGEVVDLITAKDVERIRSYPKLGKPSLGAXGKFVVAASIGTREXDDRXRLEQLVKAGAMLS

SEQ ID NO: 7309 - protein, 193 aa, Zea mays
  misc_feature (147)..(147): Xaa can be any naturally occurring amino acid
  misc_feature (178)..(178): Xaa can be any naturally occurring amino acid
  misc_feature (184)..(184): Xaa can be any naturally occurring amino acid
MASSSTYLADDGFAAPRLFSQGVSYTYDDVIFLPAYIGFPADAVDLSTRLSRRIPLSIPCVASPMDTVSEAAMAAAMASLGAAAVVHCNTDPHAQAAIVRAAKSRRLPFVSSVPFFSPSSAPTLNDFAGSEYALVTERGDSLSRLVXGVAVAADAASREVPVSVSEYMRPTPRSASAXFDFEEXTFLADEGLD

SEQ ID NO: 7310 - protein, 168 aa, Zea mays
  misc_feature (102)..(102): Xaa can be any naturally occurring amino acid
  misc_feature (114)..(114): Xaa can be any naturally occurring amino acid
  misc_feature (129)..(129): Xaa can be any naturally occurring amino acid
MVDYQDLLSGDELLSDSFTYKELENGVLREVEGKRVTQRPVDVDIGASPSGEGGEDQSVDDTAANARDIADTFRLHEQPPFDKKSFVFYITKYIQNLTACDXPQKACDFKKGVXGATKFLLNKLNDLQXSLLVETMKDDASVVFAYYKDGATNPTFLYYSHGLNEIKC

SEQ ID NO: 7311 - protein, 160 aa, Zea mays
  misc_feature (148)..(148): Xaa can be any naturally occurring amino acid
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASGGSKEPKFPXSPKKGAKSPKKA

SEQ ID NO: 7312 - protein, 157 aa, Zea mays
  misc_feature (62)..(62): Xaa can be any naturally occurring amino acid
MAAAKIAPSMLSSDFANLASEAERMVRLGADWLHMDIMDGHFVPNLTIGAPVIQSLRKHTKXEAENPVELVLVMTVEPGFGGQKFMPEMMDKVRTLRKKYPSLDIEVDGGLGPSTIDVAASAGANCIVAGSSIFGAADPGAIISVLRKSVEGSQNKN

SEQ ID NO: 7313 - protein, 213 aa, Zea mays
  misc_feature (13)..(13): Xaa can be any naturally occurring amino acid
  misc_feature (34)..(34): Xaa can be any naturally occurring amino acid
  misc_feature (45)..(45): Xaa can be any naturally occurring amino acid
  misc_feature (126)..(126): Xaa can be any naturally occurring amino acid
  misc_feature (159)..(159): Xaa can be any naturally occurring amino acid
  misc_feature (168)..(168): Xaa can be any naturally occurring amino acid
DPEDGAMYGALCXLARFDAPNLRRRVLDSMNFRXLFWSVPPEVQXLTNDRYACRSGSWSAHTEMLRPSLLLYIHLHQHVETLYMEIRHTAIIQHTLAFISDDLNTKVDGFKTSTSMLRKELAELIXLSDKIQARVDSHITILYARRADQRNATFQRALXTGNDLERDXKAMLLRANLLKHDDIQRTSATWKMQRMLTAVLGKASCWMPLHFFF

SEQ ID NO: 7314 - protein, 160 aa, Zea mays
RSSVQTAFIPYITAGDPDLATTAEALRLLDGCGADVIELGVPCSDPYIDGPIIQASVARALASGTTMDAVLEMLREVTPELSCPVVLLSYYKPIMSRSLAEMKEAGVHGLIVPDLPYVAAHSLWSEAKNNNLELVLLTTPAIPEDRMKEITKASEGFVYL

SEQ ID NO: 7315 - protein, 275 aa, Zea mays
MEGQFQVGKEEVIQAWYMDDSEEDQRLSHHLDSRPAGKLNHKRRPLDADSALRTQEHSRSRRKFEDEEQLHCGRTSGMEGQFQFGKEEVIQAWYMDDSEEDQRLPHHREPKEFIPLDKLSELGILSWRLNADDWENDENLKKIREARGYSYMDICDVCPEKLPNYEAKIKNFFEEHLHTDEEIRYCLEGSGYFDVRDQDDQWIRVAVKKGGMIVLPAGMYHRFTLDSDNYIKAMRLFVGEPVWTPYNRPHDHLPARKEYVEKIINRGGNQAVEAR

SEQ ID NO: 7316 - protein, 507 aa, Zea mays
MASNGCNGNGNGKAAPAGVVVPEIKFTKLFINGEFVDAASGKTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 7317 - protein, 389 aa, Zea mays
  misc_feature (198)..(198): Xaa can be any naturally occurring amino acid
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLASREAAYYQQGARFAKWRTVVSIPNGPSELAVKEAAWGXLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 7318 - protein, 93 aa, Zea mays
  misc_feature (80)..(80): Xaa can be any naturally occurring amino acid
MGRAAPSSSPSSPQLGRKRTAAPTPEPPTPQRHCSMVDVMRRSRAVAAPPPVARARVYTYYETLLCETCGLGDRDDQMLXCDRCDRGCHTFCL

SEQ ID NO: 7319 - protein, 314 aa, Zea mays
MNTTHAMEQVDDGQHTQEGVSTERAFEADPIPSLSETITARAIAASFILGVALCAVAMKISLNSGFLPSLTVPAGLVGFYLVRAWIRALDCCFQVPHQLPFTRQENTVIQTCVVACSAITFSGGFGTYILAMGKNAAGGDVRDGKNIVEPSIGRTVAFLFLVSFSGMFVLMPFRKVMIIRHRLTYPNGMATAHLINSFHTPQGASKARQQVEMLFRSLGGTMLWNMFQWFCAAAKGCGFGVFPIFGLEAYKHGFYFDFSMSNIGIGMLCPYTITVSMFIGSVVSWGLVLPYLATKAGVWYSSHLSPSRPQRHQG

SEQ ID NO: 7320 - protein, 212 aa, Zea mays
EACYNYGFLPADRGKHQPPPAPHATLPHAAADFLCISEDAGELWEYFPCPFCYIEVEVPFICNHLQEEHCFDTRNAVCPICANNLGKDMAAHFRLQHTHLLKRRKPYRPSSCPAAATSPATYQVNSYYEEAEPQQHYSRPYKDPAPDPLLSQFICSVDAIPGDDNAQKDDQRLKLNNKGATASDDDASSKLGLEERLQRIDFLTEILMSTIL

SEQ ID NO: 7321 - protein, 336 aa, Zea mays
  misc_feature (171)..(171): Xaa can be any naturally occurring amino acid
  misc_feature (223)..(223): Xaa can be any naturally occurring amino acid
  misc_feature (226)..(226): Xaa can be any naturally occurring amino acid
  misc_feature (277)..(277): Xaa can be any naturally occurring amino acid
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKXAGVLCSYDPNVRLPLWPSPDAAREGILSIWKEADFIKVSDDEVAFLTRGDAXDEXNVLSLWFDGLKLLVVTDGDKGCRYFTKDFKGSVSGFKVDTVDTTGAGDAFXVGSLLVNVAKDDSIFHNEEKLREALKFSNACGAICTTKKGAIPALPTVATAQDLIAKAN

SEQ ID NO: 7322 - protein, 530 aa, Zea mays
  misc_feature (114)..(114): Xaa can be any naturally occurring amino acid
  misc_feature (149)..(149): Xaa can be any naturally occurring amino acid
  misc_feature (157)..(157): Xaa can be any naturally occurring amino acid
  misc_feature (168)..(168): Xaa can be any naturally occurring amino acid
  misc_feature (191)..(191): Xaa can be any naturally occurring amino acid
  misc_feature (201)..(201): Xaa can be any naturally occurring amino acid
  misc_feature (227)..(227): Xaa can be any naturally occurring amino acid
  misc_feature (384)..(384): Xaa can be any naturally occurring amino acid
  misc_feature (403)..(403): Xaa can be any naturally occurring amino acid
  misc_feature (496)..(496): Xaa can be any naturally occurring amino acid
MDASLLLSVGLALVLIPLSLSLLNRLRLGRLPPGPRPWPILGNLRQIKPVRCRCFQEWAERYGPIISVWFGSGLTVVVSTSELAKEVLKENDQQLADRPRNRSTQRFSRNGQDXLIWADYGPHYIKVRKLCNLELFTPRRLEALRPIRXEDEVTAMXVESVHRAATAXGLCCIQVMKESQCVVRKHLSMVXAFNNITRLAXFGKRFMNGKRVMLTNKGREFKTIVKXMGIKIGASLSVAEFIWYLEDGLVSHLMESFYKTHNERRDRLTMKIIDEHAKSLKESGAKQHFVDALFTLKQQYDLSEDTVIGLLWDMITAGMDTTVISVEWAMAELVRNPRVQKKLQEELDRVVGRDRVMLETDFQNLPYLQAVVKESLRLHPPTPXLMLPHKASSNVKIGGYNIXPKGANVMVNVWAVARDPKVWSNPLEYRPERFLEENIDIKGSDFRVLPFGAGRRVCPGAQLGINLVASMIGHLLHHFEWSLPEGTRPEDVNMMXESPGLVTFMGTPLQAVVKPRLEKEELYNRVPVEM

SEQ ID NO: 7323 - protein, 199 aa, Zea mays
  misc_feature (46)..(46): Xaa can be any naturally occurring amino acid
  misc_feature (60)..(60): Xaa can be any naturally occurring amino acid
  misc_feature (74)..(74): Xaa can be any naturally occurring amino acid
  misc_feature (81)..(81): Xaa can be any naturally occurring amino acid
  misc_feature (101)..(101): Xaa can be any naturally occurring amino acid
VPSESRPGFAAPTATNRLFVPRATDNPAALRCWFIQDLLSGDELLXDSFTYKELEERNPXEVEGKRVTQGPVDXDIAANSXADEAGDDESVDDTGAKVADXADTFRVQEQPPFDKKSYVSYIKKYIKNLTDVMEPEKAYELKKGVKGATKKILSKLKDLKFFVGESMKDKSYVELDYYKDGATNTTLLYFSHGLKEIKR

SEQ ID NO: 7324 - protein, 365 aa, Zea mays
  misc_feature (79)..(79): Xaa can be any naturally occurring amino acid
  misc_feature (113)..(113): Xaa can be any naturally occurring amino acid
  misc_feature (188)..(188): Xaa can be any naturally occurring amino acid
  misc_feature (206)..(206): Xaa can be any naturally occurring amino acid
  misc_feature (286)..(286): Xaa can be any naturally occurring amino acid
MGLDYYKILGVDKGATDDDLKKAYRKLAMKWHPDKNPNNKKEAENKFKQISEAYEVLSDPQKRAVYDQYGEEGLKGQVXPPPGAGGAGPGGATFFSTGGDGPTVFRFNPRNAXDIFAEFFGGSSPFGGMGGRWHGRQRHGGWGMPGMRSGGTRFSSSIFGDDIFGSAFGGGPDGHGMHRRRAGREGAXIERKLPCSLEELYKGTTXKKMKISREISDASGKTIPVEEILTIDVKPGWKKGTKITFPEKGNETPNTIPADLVFIIDEKPHPVFTRDGNDLVVTQKMXLAEALTGYTAHVTTLDGRSLTVPISSVIHPGYEEVVRGEGMPIPKDPSRKGNLRIKFDIKFPARLTADQKSGVKRLLGQ

SEQ ID NO: 7325 - protein, 550 aa, Zea mays
MAATVRRAASSVLSRFLLTKPSPSPASAAGNNSALLGSGAAALHRFSTAPASAAAAAEEPIQPAVEVKHTQLLINGNFVDAASGKTFPTLDPRTGEVIARVAEGDSEDIDRAVAAARRAFDEGPWPRMTAYERCRVLLRFADLIERHAEEVAALETWDNGKTLAQAAGAEVPMVARCVRYYAGWADKIHGLVAPADGAHHVQVLHEPVGVAGQIIPWNFPLLMFAWKVGPALACGNTVVLKTAEQTPLSALYVANLLHEAGLPEGVLNVVSGFGPTAGAALSSHMGVDKLAFTGSTGTGQIVLELAARSNLKPVTLELGGKSPFIVMDDADVDQAVELAHQAVFFNQGQCCCAGSRTFVHERVYDEFVEKSKARALKRVVGDPFRDGVEQGPQIDGEQFNKILRYVQSGVDSGATLVAGGDRVGDRGFYIQPTVFADAKDEMKIAREEIFGPVQTILKFSGVEEVIRRANATPYGLAAGVFTRSLDAANTLSRALRAGTVWVNCYDVFDATIPFGGYKMSGVGREKGIYALRNYLQTKAVVTPIKNPAWL

SEQ ID NO: 7326 - protein, 179 aa, Zea mays
MPTMHALRLCPLLSTIRSTPPRATAAARQGALFVARCSSAGTPSAAQALKVKVFQQENYLANWIQALFNSLPPEDYVGATLVLGGDGRYFNKEAAQIIIKIAAGNGVQKIIVGRNGLLSTPAVSAVIRKRKANGGFIMSASHNPGGPDNDWGIKFNYSSGQPAPETITDQIYGNTLSIS

SEQ ID NO: 7327 - protein, 193 aa, Zea mays
MSAVNITNVAVLDNPTAFINPFQFEISYECLVPLDDDLEWKLIYVGSAEDENYDQQLESVLVGPVNVGTYRFVLQADPPDPSKIREEDIIGVTVLLLTCSYMGQEFMRVGYYVNNDYGDEQLREEPPAKVLIDRVQRNILADKPRVTKFPINFHPEPSTGTGRQQQQQEPQTASPEKHAGSGEGNGSKPEADQ

SEQ ID NO: 7328 - protein, 242 aa, Zea mays
MFSHMIPRASRPLLRSANNTFRASPSTLYLVDKVQSRRSYATETEEKDLVIIGGGVAGYVAAIKAGQEGLKVACIEKRGSLGGTCLNVGCIPSKSLLNNSHLYHQILHDTKNRGIEVSDVKLNLKQMMKAKETSVNGLTKGIEFLFKKNNVEYIKGTGAFADEHAVQVNLTEGGETSVRGKNILIATGSEATPFPGLNIDEKKVITSTGAIALETVPKKMVVIGGGIIGLEMGSVWSRLGAE

SEQ ID NO: 7329 - protein, 170 aa, Zea mays
MAMSAGRGLLVLFFSAAVVAELASAANGPFLSDSVFQSSAGSTGRSLLQAKNSCPVNFEFQNYTIITSKCKGPKFPASQCCAALKEFACPFNNYLNDESNECASTMFSYINLYGKYPPGLFSSECKEGKMGLSCADVPRKDSSTANSGYRAQSSLLALITVLSVVAALFY

SEQ ID NO: 7330 - protein, 421 aa, Zea mays
MTDGGDEYKREESVALLVIVFLAALSLLSVIAAFAYYCYITRKVSRRLQSFHIPKRSSSHPPPPPPRALPPPQQQGTDSPSSSSASDGAAAAAAAMSVVVAGERGVQVFSYRQLHAAMGGFGRAHMVGQGSFGTVYRGVLPDGRKVAVKLMDRPGKQGEEEFEMEVELLSRLRSPYLLGLIGHCSEGGHRLLVYEFMANGGLQEHLYPTRGSCGGISKLDWDTRMRIALEAAKGLEYLHEHVNPPVIHRDFKSSNILLDKDFHARVSDFGLAKLGSDRAGGHVSTRVLGTQGYVAPEYALTGHLTTKSDVYSYGVVLLELLTGRVPVDMKRPPGEGVLVNWALPMLTDREKVVRILDPASEGQYSLKDAVQVAAIAAMCVQPEADYRPLMADVVQSLVPLVKNRYNQKSCNPNVQPSKPLD

SEQ ID NO: 7331 - protein, 96 aa, Zea mays
TADHGNAEYMSDESGNPWTAHTTNPVPFILVEGEGRKIPGHGGEVKLREGGKLADIAPTILDILQLPVPAEMTGKTLIDQPLVEIKANRTPVNLSR

SEQ ID NO: 7332 - protein, 373 aa, Zea mays
MRRRRMGALHVVGEPRISFRQQPAAVVAKNGGHGAVVEEIHGLIRVYKDGHVERLPAIPAVPCTWGGTAAPDAPGGVVARDVVVDPATGVWARLYAPTSAAAGDGARRPVVVYFHGGGFCVGSAAWSCYHEFLAQLAARAGCAVMSVDYRLAPEHRLPAAFDDGLAAVRWLRHQAAASASASACSNDDLSWWRARCGFDRVFLMGDSAGASIALHVAARLGQGQLGALPPLTVRGAVLIQPFLGGEGRTASEKNVAQPPRSALTLPTSDCYWRLALPAGASREHPWCNPLSGRAAPRLETTPLPPLLVCVSETDILRDRNLELCRALREAGKRVEQAVYGGVGHAFQVLHNCHLSQPRTQEMLAHIKAFVSAR

SEQ ID NO: 7333 - protein, 364 aa, Zea mays
MASEPVARAVAEEVGRWGSMKQTGVTLRYMMEFGSRPTQRNLLLSAQFLHKELPIRFARRALELDSLPFGLSNKPAILKVRDWYMDSFRDIRYFPEVRSRNDELAFTQMINMVKVRHNNVVPTMALGVQQLKKELGRSRKVPFEFDEIDEFLDRFYMSRIGIRMLIGQHVALHDPKPEPGVIGLINTRLSPIQVAQAACEDARSVCLREYGSAPDINIYGDPNFTFPYVTLHLHLMLFELVKNSLRAVQERYMNSDKDVPPVRIIVADGEEDVTIKVSDEGGGIPRSGLPRIFTYLYSTAKNPPELDRPNTEGVTMAGYGFGLPISRLYARYFGGDLQIISMEGYGTDAYLHLSRLGDSEEPLP

SEQ ID NO: 7334 - protein, 2195 aa, Zea mays
MSTAQGTALKSAPIGAGHRARRGRPVVPPYRSGWQAYGGVSLEGSGFLGGLQRTEERVATLAPRAAARDAEVVRPLSKLPNSSIGLYDPSFERDACGVGFVAELSGDYKRETVNDAIEMLERMAHRGACGCEKNTGDGAGIMVALPHDFFKEVTKDAGFELPPPGDYAVGMFFMPTDEKRREKGKAEFKKVAESLGHVILGWRPVPTDNSDLGESALETEPVIEQVFVTKSSRSEAEFEQQLYILRRLSIISVRASLNIKRGGERDFYMCSLSSRTIVYKGQLKPCQLKGYYYADLGQENFMSYMALSQAAVLLWPTAMPDSSGCDLRLGGGKEMCLVHSRFSTNTFPSWDRAQPMRVLGHNGEINTLRGNKNWMTAREGLLEAEKLGLSKEQLARILPIVDATSSDSGAFDNVLELLVRGGRSLLEAVMMMIPEAWQNDGNMDPEKKALYEFLSALMEPWDGPALISFTDGRYLGATLDRNGLRPGRFYVTHSGRVIMGSEVGVVDVPPEDVLRKGRLNPGMMLLVDFENHTVVDDEALKAQYSKAHPYGEWLKRQKIYLKDIVESVPETDRVAPSISSSLPAKNENKDHVGINGILTPLKAFGYTVEALDMLLLPMAKDGVEALGSMGNDTPLAVMSNREKLTFEYFKQMFAQVTNPPIDPIREKIVTSMECMIGPEGDLLETTEKQCNRLSLKGPLVSIDEMEAIKKMNYRGWRSKVLDITYPKKSGRKGLEETLNRMCAEAREAIREGYTILVLSDRGFSSDRVAASSLLAVGAVHQHLVANLERTRIGLLVESAEPREVHHFCTLLGFGADAICPYLAIEAIWCLQNDGKIPPNGDGQPNSKEELVKKYFYASNYGMMKVLAKMGISTLASYKGAQIFEALGLSSEVIGKCFEGTPSRIEGATFEMLARDALRLHELAFPSRTPPAGSADAKALPNPGDYHWRKNGEVHLNDPLAMGKLQEAARVNSRAAYKEYSKRIQELNKACNLRGMLKFKDISDKISLDDVEPASEIVKRFCTGAMSYGSISLEAHTALAIAMNKLGGKSNTGEGGEQPSRMEPLPDGSMNPRRSAIKQVASGRFGVSSYYLTNADELQIKMAQGAKPGEGGELPGHKVIGDIAVTRHSTAGVGLISPPPHHDIYSIEDLAQLIHDLKNSNPGARISVKLVSEAGVGVVASGVVKGHADHVLISGHDGGTGASRWTGIKNAGLPWELGLAETHQTLVANGLRGRAVLQTDGQLKTGRDVAVACLLGAEEFGFSTAPLITLGCIMMRKCHMNTCPVGIATQDPVLREKFAGEPEHVINFFFMLAEELREIMANLGFRTITEMVGRSDMLEVDPEVVKTNEKLENIDLSLILKPASEIRPGVAQYCVEKQDHGLDMALDNKLIDLSRTAIEKQVRVFIETPIQNTNRAVGTMLSHEVTKRYHINGLPAGTIHVKFTGSAGQSFGAFLCPGITLELEGDSNDYVGKGLSGGKIVVYPPRNSSFSPEDNIVIGNVALYGATMGEAYFNGMAAERFCVRNSGAQAVVEGIGDHGCEYMTGGTVVILGKTGRNFAAGMSGGIAYVYDVDGKFSARCNNELVDLYHVEEEDDIITLKMMIEQHRRNTESVLARDILSDFDNLLPKFVKVYPRDYKRVLESMKVEKAVAKHAKEPKMANGISVTTKKVQPDQSASRPTHVANAKKYRGFITYERESISYRDPKERVRDWKEVAIESTPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMIPRPPLQRTGRKVAIVGSGPSGLAAADQLNKMGHFVTVFERADRIGGLMMYGVPNMKTDKIGVVQRRVNLMAEEGVTFVVNANVGSDPLYSIERLRSENDAVILACGATKPRDLTIPGRELSGVHFAMEFLHANTKSLLDSNLEDGKYISARGKKVVVIGGGDTGTDCIGTSIRHGCTSLVNLELLSKPPSTRAADNPWPQWPRIFRVDYGHQEAATKFGKDPRTYEVLTKRFIGDGNGKVKALEVVRVKWEKVDGRFQLKEMEGSEEIIEADLVLLAMGFLGPEATIAEKLGLEKDNRSNFKAQFGDFATSVDGVFAAGDCRRGQSLVVWAITEGRQAAAAVDKYLSRYDQNAAATGDSTPSGTGLVQPVAA

SEQ ID NO: 7335 - protein, 175 aa, Zea mays
  misc_feature (132)..(132): Xaa can be any naturally occurring amino acid
MRPQLQLMCVVIFIGTNGQTYFITASLVTSIQNFPKSRGPTVGILKGFMGLTSAILTQVYTVMHTPDHAALIFMVAVGPSLVAIGLMFVIRPVGGHRQIRPSDKNSFMFIYTVCLLLASYLVGAMLIQDFLXTSYDVVGFLTVILFVLLISQSHPCDCVVHAEKAQHLMEMLSYL

SEQ ID NO: 7336 - protein, 363 aa, Zea mays
MGAPEVHHLFHNPIADHSFSADQSTLAVARDTSVELYGKVGSAFKLKDSLKGHDKTVTGVDIAPNSGRIVTCSQDRNAIVWEPSPEGYKPTLVLLRISRAATFVRWSPSENKFAVGSGDRVIAVCYFEEENDWWVSKHLKKPIRSTITSVAWHPNSVLLAAGSTDAHARVFSAFIKGMDARPPPGVWGERLPFNTVCGEYLNNSAGWVHSVSFSPSGDSLAFAAHDSSITVVYPSGPDQAPRAVVTVSTQQLPFKSLIWTSEDEIIAAGYDCEAFRFQGGEGGWQLAGPIEQKGGPGLGEHREESALNMFRQMDLKGKAKDDTQLQTTHQNTISTVRPFESSGDRVTKFSTSGVDGRIVLWSA

SEQ ID NO: 7337 - protein, 148 aa, Zea mays
ISHSRYTGKTTLSTDHNRLLIGDHQHCWSENGVSNTEGGCSAKCIDLSQEKEPDIWNAIKFGAALENAVFHEHTREADYADKSGTENTRAAYPIEYIPNAKIPCGGPHPKNAILLASDPFGVLPPVSKLDLAQTMYHFLSGYTDLVGE

SEQ ID NO: 7338 - protein, 667 aa, Zea mays
MATPNGLARIETTGKKKQDNGVWYDDSSAPVRAQTIDELHSLQRKRSAPSTPKRSAPTTPIKGGAHSPFAVAISEEERHTQQMQSISASLASLTRETGPKVVKGDPAAKGEAAAQGAPSTPRAHQQHRHPAAPAIAVSDSSLKFTHVLNNLSPAELYEQAIKYEKGSFITSTGALATLSGAKTGRSPRDKRVVKDEVTAQDLWWGKGSPNIEMDEKTFLINRERAVDYLNSLEKVFVNDQYLNWDPENRIKVRIISARAYHSLFMHNMCIRPTDEELEDFGTPDFTIYNAGQFPCNRYTHYMTSSTSIDLNLARREMVIMGTQYAGEMKKGLFGVMHYLMPKRGILSLHSGCNMGKDGDVALFFGLSGTGKTTLSTDHNRLLIGDDEHCWSDNGVSNIEGGCYAKCIDLAQEKEPDIWNAIKFGTVLENVVFDEHTREVDYADNSVTENTRAAYPIEYIPNAKIPCVGPHPKNVILLACDAFGVLPPVSKLNLAQTMYHFISGYTALVAGTEDGIKEPQATFSACFGAAFIMLHPTKYAAMLAEKMQKYGATGWLVNTGWSGGRYGVGKRIRLPYTRKIIDAIHSGELLTANYQKTEVFGLEIPTEINGVPSEILDPINTWTDKAAYKENLLRLGGLFKKNFEVFASYKIGDDSSLTDEILAAGPNF

SEQ ID NO: 7339 - protein, 354 aa, Zea mays
MHPKARIHADPVREVDHFDCLPDSLVLLILNKVEDVRSLGRCYAVSKRLCGLVSLVHDVYVKIDRVVAVDGDAEGTLNLSSPKPRSIFSHFLKLMLFTIIKPFHNMRSPNGTARPLFPQLSQHSPAQVLRNFTHVRNLRIELPSGDVGTEEGVLLKWRAEYGSTLENCVILGGTRVDRKPVGGEHEPALEDNGSMPESFYTNGGLRLRVVWTISSLIAASTRHYLLRSIINGHPTLQSLVLTDADGQGTLCMGAKQLEEFRENQLSTSACSNRTQVPACNMKLKYAPYVELPGGMALQGATLVAIKPSPEGSNGSHPNRKEAEGFVFGAFDGPFKAAVKALMKRRTYLLEMNGF

SEQ ID NO: 7340 - protein, 215 aa, Zea mays
LLHPGLAFPGADRAGMDELEMDEEVRPEFPCPYCYEDHDVGSLCAHLEEEHPFEPQAAACPVCSEMVTKDMVNHITTQHGYLFKNRRRLRRFIIPGSQALSLLSRDLREAHLQVLLGGGGQRSSDNSSSRAPNIWGDPLLWSLGLGFPPSDAEQASKSTVSIPDDATPVKKAPAQARKLSIDSSLPSEKRELKRKQARVKTPFVQDLLLFTLFGD

SEQ ID NO: 7341 - protein, 672 aa, Zea mays
MDQLRPEPAAGAHEIEKTAAPDVESEPAAAVPEPERVPPWREQVTARGMVAALLIGFVYTVIIMKLSLTTGLTPTMNVSAALLAFLALRGWTRALGRLGIACRPFTRQENTVVQTCVVACYTIGFGGGFGSFLLGLDKKTYELSGVSTPGNVPGSYREPAIGWMTGFLLAVSFVGLLTLLPLRKVLVIDYKLTYPSGTATAVLINGFHTPQGDKNAKIQVRGFLKYFGISFLWSFFQWFYTAGDHCGFAQFPTFGLQAFNQTFSFDFSLTYVGAGMICSHLVNLSLLFGAVVSWGVMWPLIGKQKGNWYPADASQNSMTGIYGYKAFLCIALLVGDGLYNFVKVIAITVKNIRERSRRKNLNRVADADTMALDDMQRDEVFNRDNIPTWLSYAGYAALSLIAVIAIPIMFREVRWYYVVVAYALAPALGFCNAYGTGLTDMNMGYNYGKVALFVLAAWAGKDSGVVAGLVGCGLVKQLVLVSADLMHDFKTGHLTLTSPRSMLVGQAVGTLMGCVLAPLTFMLFYRAFDVGEPDGYWKAPYALIYRNMAILGVEGFSALPRHCLQLCAGFFAFAVLANLARDLLPRRLARLVPLPMAMAVPFLVGASFAVDMCVGSLVVFAWHKLDGKKAALLVPAVASGLICGDGIWTFPSSLLALAKVKPPICMKFTPGS

SEQ ID NO: 7342 - protein, 262 aa, Zea mays
  misc_feature (245)..(245): Xaa can be any naturally occurring amino acid
MATGTAAASASGVGADSLESGAMLLRRRHAGGLAGAGDDDGVGNAEEVAASVEQAFADEPVPSWREQLTVRAFVVGFILAVLFSVIVMKLNLTTGVIPSLNVSASLLGYFLVRLWTKAIESVGLLKHPFTRQENTVIQTCVVSAYGLAFSGGFGSYLFGMSRTIAIQATEANDAQNIKDPQLGWMIGFMFLVSFVGLFVLVPLRKVMIVDYKLTYPSGTATAYLINGFHTPPGCPNVQRSKVRTXLGKYFSLSFLWAFFQWF

SEQ ID NO: 7343 - protein, 727 aa, Zea mays
  misc_feature (220)..(220): Xaa can be any naturally occurring amino acid
  misc_feature (387)..(388): Xaa can be any naturally occurring amino acid
MGSSIKHANFVEDGSSTVDLNEALPCNSHSSPNINGHSSFVNKEFCNHSKEHQRAKDASVVEDCSQTSSTRELEDSSIPHAAASVVLESKSSRTPIHVELERSKTKSAGNDSIQSTKPVPSALTVDKATSVRGSLSITPNNSSKVADSLPDRSFKPSDRSGSTTNNLATSLKKMVRQQTAPKVVRHYPSESTLFPYELFVKLYSKVELHPFGLHNLGNRXNCYANAVFQCLMFTRPLTTYLLEGLHSKNCSQNGWCFMCEFEKLIVEGKRRKIALSPTGILSHLNDIGSSFGPGKQEDAHEFLRYAIDAMQSVCMKEARKGGVLQSTEETTLVQLIFGGYLRSKIKCSKCHVSSEQCEPMLDLTVEIDGDISSLGEALVRFTSTEVXXMGENKYHCSRCKSYERAKKKLTIEEAPNILTIALKRYQSGKFGKISKAIRFPETLNLARYMNPDTDDISPVYSLYAVVVHHDVMNAAFSGHYVCYVKDTQGKWFKADDSQVKPVSLDNVMSKCAYMLLYARCSPRAPSSVRQAMSDPAHPKQAKQRVVPGGPTWRGGSFNGHQAGQRHSDDAEDDDATHAAFDEYRYAPYSPSDSPSPSESSSLFSNSDAGSHSTDSSESTRNSTSTEEYEYVFGAADQMYRVGGGTPVEGGYPTYSRSRSSLNASSSGREAYSAGTYAEHRTQGGGPGGLWVEGDESPSLLYTDRSKQPSNSTLRDQYRQLDRSDERT

SEQ ID NO: 7344 - protein, 443 aa, Zea mays
MRSPRIPGRRDAASPQTPKGFNPGDPVEVVPDEAGLHGAHFAAVVVGPSAKPRGYTVEYDSLLESEGSDRPLREALPARSLRPRPPPPPAPASEAPPAEHAAVDALIDDAWWLGVALARAGAPSKVRVCFPETREVMEFDAADVRPHLEWVDGEWRSPDNMEIPKTMPYAKGMQIEVSKLEDNSVVAWSPAVVAKTIWKNNLLVDYTLSKCYGTTLSEEIVDVKHVRPCPPQASEISFCINDEVEAFQGDCWWLGVITNVLPEFKYTFKSTHLGTEVEVNQKFLRLRYDWVGDQWEQESKNVPKAKFTQGVKVEVCSDDEGFRGAWFEATVVKAVGSKFLVEYATLKADDGTKPLKESVEARHIRPCPPDIPATDGFKLLDEVDAFCNDAWWVGVVSKVLGEKRCTVYFRPWKEEMEFEHAQLRLHCDWMGGRWMRASPALEM

SEQ ID NO: 7345 - protein, 200 aa, Zea mays
MALVGQVATVAQLVGVDAFSLITMIAEAAQTARRNRAVCRQLARRVEMIGSLLRRLREQDDNDDMRLLRHAETRGPVEALEETLRRAYLLVRSCQRRGYAFRCLMGARHADELREMQGEIGFYLGLFPLISYVDWARRRGNGNGKAACGDSRSLQEAPMVRLPCLVPFLFLSLLRWMQLFREYVMPLVCMHLLCLSPYVY

SEQ ID NO: 7346 - protein, 156 aa, Zea mays
MALVGQVATVAQLVGVDAFSLITMIADAAQTARRNRAVCRQLARRVEMIGGLLRRLRDDDDARLLRHAETRGPVEALEETLRRAYLLVRSCQRRGYAFRCLMGARHADELREMQGEIGFYLGLFPLISYVDWARRRGNGNGRPPVVTLVLCKRHLW

SEQ ID NO: 7347 - protein, 198 aa, Zea mays
MSEPVQPIIEFRGVSQSFGRKVILDDVDLKIYPGEAVGVIGPSGTGKSTILRIVAGLLTPDSGEVIVHGHRRQRSIEEGEKALGVGLVFQQSALFDSLTVAENVGFTLYRDSDLRPREIRAIVEENLELVGLPGIGDRFPAELSGGMRKRVSLARAIVINPEQHQQYKNILLYDEPTAGLDPVASTRIESLIRHLLSQ

SEQ ID NO: 7348 - protein, 484 aa, Zea mays
  misc_feature (257)..(257): Xaa can be any naturally occurring amino acid
MAAAAIEAAGRRKGSCFLEVGRREIGSSFPRVSSRRISGSEHIVSSMSQYGKLHGHEGCVNTVSFNPAGDLLVSGSDDTNIILWDWLSKTKKLVYPSGHQDNVFHARVMPFTDDSTIVTVAADGQVRVGRLKEGGEVTTKLVGEHDSRVHKMAIEPGNPYIFYSCGEDGLVQHSDLRSDSATKLFTCCSFLNDRRRVKLNSIVIDPQNPYYFSIGGSDEYARLYDMRKFQLDGSRNTNQPVDTFCPKHLIKGCECKXHITSIAYSYAREILVSYNDELIYLFQHNMGLGPNPVSTEPEFFNMLDQPQAYRGHRNFRTVKGVSFFGQHDEYVVSGSDCGNVFIWRKKGGELIRMMNGDKSVVNCIEPHPHFPFMATSGIDTTVKLWTPAAKKLIMPLPKNAKQIIAANELERTVHISQATASLSSDVMMHVLRLLRRRDSEMYIENEPASADLASDDDEAFYFGFEDDAERNERENSDPRECNMT

SEQ ID NO: 7349 - protein, 799 aa, Zea mays
MASSLPAPPASPSSSWRGLTPRCPPPRCGPLLACAAARSYRYRFRTDDDGVVDVAVAGKDGDAGYVVAIEAPTHGQRGGLVLRPAGSGSGVPLAPAAPGGALVAELSYDVARAPFHVSFTLADAMGAEIRTHRGTSFRVPVGVGRGCPSPLGLSQSKDGAANFAVYSKIAKGMVLCLFGGGGGDGPALEIELDPYVHRTGDVWHVSMESVEGYARYGFRSGLFAMFGIDRPLLDPYAKVIGDFVAGDSVDEDGLAVPSIRCLASLKNAPNYDWGRDKHPCLPLEKLVVYRANVALFTKDRSSRLADNAAGTFSGMSAKVEHFRHLGVNAVLLEPVFPFHQVKGPYFPYHFFSPMSLYSSECSSVSAIKSMKDMVKTMHRNGIEVLLEVVFTHTAEGGAECQMISLRGIDGSSYYIADGIAGCKASVLNCNHPVTQKLILDSLRHWVLDFHVDGFCFINAPFLVRGPRGEGLSRPPLLEAIAFDPVLSKTKIIADPWSPLDISNVQFPFPHWKRWAEMNTRFSMDVRKFLKGEALISDLATRLCGSGDLFSSRAPAFSFNYVSRNSGLTLVDLVSFSSDELASEFSWNCGEEGPSENNAVLQTRLRQIRNFLFILFISLGIPVLNMGDECGNSAAGSTSYKDRGPLNWKALKTAFVKEVTGFISFLSALRSRRADIFQRCEFLKLENIHWYGSDLSEPCWEDPTSNFLCLHINAELDEKLPDSTGGDLYICFNANEESASATLPAIAEGSMWLRLVDTSLAFPGFFSRGSSHETHQVLGFSSYQVKAHSCVLFESKRVLS

SEQ ID NO: 7350 - protein, 421 aa, Zea mays
MIIYFIYSKQSLLLPSVLLLDPSSFPTTAFQSIPIATQPEASARKSPFPNPHATASLPSPSPPNSIVSKRQSAPSPNPRQAGSQPAMECEPEELQFLGVVGIYRFSAEILRGPHRPLFARIAAAFALPLSALFLLHVAISHALFTHIDSDDTALDASSPGTDTQRRLLSRLASDWLALLLFKSAYLLALLLLSLLSVAASVFSVASVYSAKRDALTFPRVLSVVPRVWRRLAATFLAAFALLFAYHAVAVLVFVGLLVAADNGSGLAGLLAFLVAVAYLLGLVYLGVVWHLASVVSVLEDHKGFAAMRKSKDLIRGKLVTAGAIFFTLNVVFAAVELGFRAWVVRGSGAASSRLLLGLIMLAALCCVVMLALVTQTVVYLVCKSYHHESLDKANISDHLEVYLGDYVPLKASDVQMEQFQV

SEQ ID NO: 7351 - protein, 556 aa, Zea mays
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLLLKGVSERGAKKIRVHILTDGRDVLDGSSVGFVETLENDLLELRGKGIDAQIASGGGRMYVTMDRYENDWDVVKRGWDAQVLGEAPYKFKSALEAVKTLRAQPKANDQYLPPFVIVDDSGKAVGPVLDGDAVVTINFRADRMVMLAKALEYADFNNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILDAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 7352 - protein, 237 aa, Zea mays
  misc_feature (202)..(202): Xaa can be any naturally occurring amino acid
  misc_feature (227)..(227): Xaa can be any naturally occurring amino acid
MATCATTLAPLLGPAANATEYLCNQFADTTSAVDSTYLLFSAYLVFAMQLGFAMLCAGSVRAKNTMNIMLTNVLDAAAGALFYYLFGFAFAYGTPSNGFIGKHFFGLKRLPQVGFDYDFFLFQWAFAIAAAGITSGSIAERTQFVAYLIYSAFLTGFVYPVVSHWVWSADGWASPTRTSGKLLFGSGIIDFAGSSVVHMVGXASPGLWGALIEGPRIGRFDTPGRSXALRGHSASLV

SEQ ID NO: 7353 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVYEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 7354 - protein, 430 aa, Zea mays
  misc_feature (108)..(108): Xaa can be any naturally occurring amino acid
MAAVAVSGGHWRRLRTLGRGASGAVVSLAWDAASGELVAVKSAGAIGAAALRREHAVLAGLRSPHVVRCVGGGDAAEEGSSYQLFLEYAPGGSLADEVARSGGSLGEXAVRAFAADVLRGLAYLHARSVVHGDVKARNVLVGAGGRAMLADFGCARALSGSGSGSARRPIVGATPAFMAPEVARGEDQGPPADVWALGCTVVEMATGRAPFGGMGGAGVLAMVHRIAYTDAVPEVPAWLSPEAGDFLARCFARDAADRWTAARLLEHPFVAFARHDDKAPRPSPKSALDAAAFWESETESEDDADDASGSASASERIDSLACSAGALPDWDGEGGWIDVLGEHCGAPGKASSVLVAVPAGEMDVGGGLPSDDGLEADDVPFGGGDVPVPAADAYEKHCSSSDCHALSCQLVPCNLVFNAIKLWVPKKKKK

SEQ ID NO: 7355 - protein, 512 aa, Zea mays
MKAARGRHWESRTMNRIQEDLDNLVDEYDRIAATSSGGGSSRTSRIRLFLFPANPFTLSSLLPNEDLDSLISVSTDEDLDNLVDEYDRWAPRGRPGGSSRTSRIRLFLFPAKPESSSSLGSLLDDSSKSENWFVDALNSAISGSLDGIPRGISTDSASVNCLLGLEDDSSVHSRSGVTNSAPTEDQRASQPKLPAGAAAAAVGAGRHPHDVQSVPDSPMLDKNSSFGSTSSAPSLSNLPPIRVRPEDRPSDARIMQPTAVEDHFAQMGISEQQLPMYIQAQQQVPIPAMTGMSPSEASSRLFSDDDKSDHGGGGGRKQQPPKQDVPPVVDSTNRAVYYNDRSTPAELKRDMPVGTEAASYRLPVSATDAAAAAAATAATQAPPGYVLAQMHAPPPPQQPPPQQQPQQPAPQQIVAAGNQHFIHNPATGTFIPIQSYYHHPVHQQAPQTMQRQQQAPTFDPNTGMYYVPMQQNAHQAYGVPPGAQVTLPPPDPFFFFFFFFFFFFFRTRGTDA

SEQ ID NO: 7356 - protein, 237 aa, Zea mays
VIRKWGTPNKIDFLSLSYTRHAEDVRQAREFLSKLGDLSQTLIFAKIENVEGLNQFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKQTVKYVGEPMTHLESIASSAVRAAIKVKASVIICFTSSGRAARLVETDMLIQGCSSVEINLMYISI

SEQ ID NO: 7357 - protein, 162 aa, Zea mays
MASNSTYLADDGFAAPRLFSQGVSYTYDDVIFLPAYIGFPADVVDLSTRLSRRIPLSIPCVASPMDTVSEAAMAAAMASLGAAAVVHCNTDPHAQAAMVRAAKSRRLPFVSSVPFFSPSSAPTLNDFAGSEYALVTERGDSLSRLVGVAVAADAVSREVPVS

SEQ ID NO: 7358 - protein, 476 aa, Zea mays
  misc_feature (186)..(186): Xaa can be any naturally occurring amino acid
  misc_feature (195)..(195): Xaa can be any naturally occurring amino acid
  misc_feature (428)..(428): Xaa can be any naturally occurring amino acid
MGKLAARLRAFSRNRWLVLVAAMWVQSMAGIGYLFGAISPVLKARLGYNQRQLAALAVAKNVGGYVGVVAGTLSAALPAWAMLLMGAAQNLLGYGWLWLIVTGQAPPLPLWMARASDRASFVFVYAVCLLLASYLAGVKLVQDFLQLSDGVVVSLTVVLLVLLISPVAVPVALTLTPEAECPIREXPLLSSSEPXRERGTLRKNRLHAHLRAGAGRAPYLGENFTMMEALVKADFWLIWVSFLLGSGSGLTVMDNLGQMSQALGFEDAHIFVSLTSIWNFLGRIGGGYFSEIIARQRAYPRHIALAFAQVLIAAAHFLFAMAWPGTIYIGTFLVGLGYGAHWAIVPAAVSELFGIKHFGAMYNFLALANPTGSLVFSNLITSTLYDYEAEKQARQRRRRVMAELLASSPRSLHSAGLFAGAVVEEEDXLIKCEGPACFLVSSLIMSVLCVVGAGLSLVTVHRTRRVYARLYRSVRT

SEQ ID NO: 7359 - protein, 342 aa, Zea mays
  misc_feature (140)..(140): Xaa can be any naturally occurring amino acid
IGYLEAGRASKSDAETSPPADKAPPEISSPECYSDLVSTRPARGGWVQPLVLYQNYWLTPGRLQHIIPVKELYKPRADDIVLVTYPKCGTTWLKALAFAITTRSRHAFAAHPLLARHPQELVPHLELPALAGDLADVEKXLPSPRLLATHLPLSLLPPDVSGYRVVYLCRHPKDAFVSWWFFANGMLRRGSSSSSVDLDDALSMFCEGFSPLGPFWEHYLEYWKASLERPQHILFLRYEEIVADPVKVVKTLAGFFSDPFTEAEERGGVPEQVARLCSFEVLSGLEKNQTGGVAFGNDLVIGKSTFFREGKVGDWENHMTKEQGQRLDDVLEDKLKGSGLVF

SEQ ID NO: 7360 - protein, 288 aa, Zea mays
  misc_feature (96)..(96): Xaa can be any naturally occurring amino acid
MEQAAMPQVPRVKLGTQGLEVSKLGFGCMGLTGTYNAPLGDEAVAAVVAHAFRRGITFFDTSDAYGPRTNETLLGKALKQLPREQVQVATKFGIGXAPAGMTVCGTPEYVRACCEASLRRLDAGYIDLYYQHRVDTTVPIEDTIGELKKLVEEGKVKYIGLSEASPDTIRRAHAVHPITAVQMEWSLWSRDIEPEIVPLCRELGIGIVAYSPIGRGFFGGRGVTQQVSSESSLQRHPRFTTESLEKNKQIYLKIEDLAKKYQCSPAQLALAWVLHQGDDVVPIPGVTL

SEQ ID NO: 7361 - protein, 168 aa, Zea mays
  misc_feature (120)..(120): Xaa can be any naturally occurring amino acid
  misc_feature (134)..(134): Xaa can be any naturally occurring amino acid
MASDAAHGSSLDGVTPSSKFDLPVDSEHKAKTIRLLSFANPHMRTFHLSWMSFFTCVVSTFAAAPLIPIIRENLGLTKADIGNAGVASVSGAIFSRLAMGAVCDLLGPRYGCAFVVMLGXPAVSCMAVIASAGXYVAWRFLIGFSLATFVSLQYWTSTMFNIKIIGTS

SEQ ID NO: 7362 - protein, 750 aa, Zea mays
MGSACQAGTDGPSRKDVLGIGNAALENGHHQAEADADEWREKEEDLANNGHSAPPPGMQQVDEHKEEQRQSIHWERFLPVKTLRVLLVENDDSTRQVVSALLRKCCYEVIPAENGLHAWRYLEDLQNNIDLVLTEVFMPCLSGIGLLSKITSHKICKDIPVIMMSTNDSMSMVFKCLSKGAVDFLVKPLRKNELKNLWQHVWRRCHSSSGSESGIQTQKCAKLNTGDEYENGSDSNHDDEENDDGDDDDFSVGLNARDGSDNGSGTQSSWTKRAVEIDSPQPISPDQLVDPPDSTCAQVIHPRSEICSNKWLPTANKRNVKKQKENKDESMGRYLGIGAPRNSSAEYQSSLNDVSVNPIEKGHENHMSKCKSKKETMAEDDCTNMPSATNAETADLISSIARNTEGQQAVQAVDAPDGPSKMANGNDKNHDSHIEVTPHELGLKRSRTNGATAEIHDERNILKRSDQSAFTRYHTSVASNQGGARYGESSSPQDNSSEAMKTDSTCKMKSNSDAAPIKQGSNGSSNNDVGSSTKNVAARPSGDRERVASPLAIKSTQHASAFHTIQNQTSPANLIGEDKADEGISNTVKMSHPTEVPQGCVQHHHHVHYYLHVMTQKQPSTDRGSSDVHCGSSNVFDPPVEGHAANYSVNGGVSVGHNGCNGQNGSSAVPNIARPNIESINGTMSQNIAGGGIVSGSGSGNDMYQNRFLQREAALNKFRLKRKDRNFGKKVACFQLHACCSYDLKSVIVI

SEQ ID NO: 7363 - protein, 165 aa, Zea mays
  misc_feature (36)..(36): Xaa can be any naturally occurring amino acid
GRWRDRFTFLSPLNRQFSFDFSLTYVRARMICSHLXKLSLLLGAVVSSGVMWPLIGKQKGNWYAADASQHRMPRIYGYKALLCIALLVGDGLYNFVKVIAITVKNIRERSRRKNLNRVADADTMALVPAVASGLICGDGIWTFPSSLLALAKVKPPICMKFTAGS

SEQ ID NO: 7364 - protein, 551 aa, Zea mays
MALTLRSSTSFLSPVDPTSKLLHKPADEAQPCCVAVPPAPGRRPRALRAAAAAAPSPATRRAPAEAAELLHGGGAGQHHGLPRGGVPVYVMLPLDTVGPGGQLSRQRAVAASLMALRGAGVEGVMVDVWWGVVEREGPGRYDWEAYAELVRMVERAGLRLQAVMSFHQCGGNVGDTCNIPLPPWVLEEMSSNPDIVYTDRSGRRNPEYISLGCDTLPVLKGRTPIQVYTDYMRSFRERFRDYLGNVIAEIQVGMGPCGELRYPSYPEANGTWRFPGIGEFQCYDKYMRASLEAAAVAAGHQEWGRGGPHDAGEYKQMPDDTGFFRREGTWSTEYGHFFLAWYSGMLLEHGDRVLAAAEAVFGGTGATLSAKVAGIHWHYRTRSHAAELTAGYYNTRDRDGYAPIARMLAKRGAVLNFTCMEMKDEQQPKHASCSPELLVQQVKTAASAAGVELAGENALERYDEAAFSQVASTARGAGLAAFTYLRMNKTLFDGDNWRQFVSFVRAMADGGARPALPRCDTGHSDLYVGFLDAAKKSKAPEAEGAATAAAL

SEQ ID NO: 7365 - protein, 45 aa, Zea mays
MIEVVLNDRLGKKVRVKRTEDDTFGDLKKLVAGQTETRPEKIRIQ

SEQ ID NO: 7366 - protein, 370 aa, Zea mays
NSDPSYHIRSPLPFPPLARRLHADPGDMPRYDDRYGGTRLYVGRLATRTRSRDLEHLFGRYGRIREVELKRDYAFIEFSDYRDADEARYQLDGRDVDGSRIVVEFAKGVPRGSGGSREYMGRGPPPGTGRCFNCGVDGHWARDCKAGDWKNKCYRCGERGHIERNCQNSPRSLRRERSYSRSPSPRRGRGRSRSYSRSRSRSRSYSRSRSLSRSPRGGRRDRDDRRSRSPSYSRSPMRSASPPVKEKERSPAPDGSRSPRSRSPQDQVMSPPPKDNGEGNGSDRGGSPRGRENSRSRSRSPSGSNRSPAANGRSRSPGGERSPSPGGERSPSPGGDRSPSPNGNGNNDAAADVDADAAARGGSPTGSKSP

SEQ ID NO: 7367 - protein, 119 aa, Zea mays
KNRFGATQEIGIFEMVQSGLQEVLNPSQLFLGSREEFMSGTAITVACEGTRPLVVELQALVSPTSYASPRRSTTGVDYNRLLQVLAVLEKRLGVPLSKLDAYLSVAGGLEVEEPAVDLA

SEQ ID NO: 7368 - protein, 391 aa, Zea mays
MRMEGAGGGAGGGGAGAGGCLGMGHGGEAQIKGTHTHGGRYVQYNVYGNLLEVSAKYVPPIRPVGRGACGIICAAVNAQTREEVAIKKIGNAFDNQIDAKRTLREIKLLRHMNHENVISIKDIIRPPRRENFNDVYIVYELMDTDLHHLLRSNQQLTDDHCQYFVYQLLRGLKYVHSANVLHRDLRPSNMLLNAKCDLKIGDFGLARTTTETDFMMEYVVTRWYRAPELLLNCSEYTQAIDMWSVGCIFGEMVTREPLFPGKDYVHQLRLITELVGSPDDTSLGFLRSDHARRYVRSLPQHPKQQFRVRFPTMSSGAMDLLERMLVFDPSKRITVDEALCHPYLASLHEVNDEPICPAPFSFDFEQPSLTEEAIKELIWKESLKFNPDPIH

SEQ ID NO: 7369 - protein, 137 aa, Zea mays
MAEGEFKPAAMQVEAPAEAAAAPSKPRFRMPVDSDNKATEFWLFSFARPHMSAFHMSWFSFFCCFLSTFAAPPLLPLIRDTLGLTATDIGNAGIASVSGAVFARVAMGTACDLVGPRLASAAIILLTTPPVYYSGVI

SEQ ID NO: 7370 - protein, 238 aa, Zea mays
  misc_feature (210)..(210): Xaa can be any naturally occurring amino acid
MGDPQFAKYPDLQLSQHIFQLTNPAASKQAKQAALKSVQDGIAENKMAPLYRYLAHPVDGVLNAQGEGSADQPSRNRRPSASLATMLATRTPTLEVPLPWDEKLYESLKAECEKELEAIQKEEEEAEEKAGETEVQAARGKRAELYNRIGDKDKAIASYEAIFEKTGILGTKIDLVLAIIRIALFFGDRILAKKSIDRASALVESGGDWXDRRNRLKAYTGLHYLTVRSHSQAAPLLL

SEQ ID NO: 7371 - protein, 130 aa, Zea mays
CRWIRPLKLIMIIDYKLTYPSGTATAVLINGFHTTHGDATAKYQVNGFTKYFAISFFWSFFQWFYSGGDNCGFSQFPTFGLRAWKQTLTYVGAGMICSHLVNLSLLLGALLSWGIMWPLVSDLKGDWYPA

SEQ ID NO: 7372 - protein, 259 aa, Zea mays
MEEDYVFLLFPLSLKPNISLLLCWIKNQVDTLLDSVKWDSKGLAVAIAQNVDTGAILMQGFANKEALAKTISTRKATFFSRSRSSLWTKGETSMNFINVHDIFLDCDHDSIIYLGKPDGPTCHTGAETCYYTSVYDALQSSKPNEGRQVMTTLYSLEDTISRRHEEKVTDGGGKPSWTKKLLLDNQLLCSKIREEAGELIQTLLENEDQSRAASEMADLLYHAMVLLRVKDVKMEQVLEVLRKRFSQSGIEEKASRNKS

SEQ ID NO: 7373 - protein, 323 aa, Zea mays
QLTPSDFCTCRVVESVGEGVEGLAPGDHVVPIFTGECEKCVYCKSDKTNLCGTYRVDPLKSSMVYDDGTRFSVVDQASGQRRPVYHFLNTSTFTEYTVLDAACAVKINPEAPLQRMCLLSCGISTGVGAAWNTANVSARSTVAVFGLGAVGLAVAEGARLRGATRIIGVDVNPSKFTKGKEMGITDFIDPNDICDKPVHEVIREMTDGGVDYSFECTGINDVLREAFLSTHDGWGLTVVLGIHSTPKMVPLHPMELYGRRITGCVFGDFKGKSQLPDLVDKCVNGEVNINFDGFITHKMPFSDINKAFRLLEEGKSLRCLLSL

SEQ ID NO: 7374 - protein, 161 aa, Zea mays
  misc_feature (17)..(17): Xaa can be any naturally occurring amino acid
  misc_feature (38)..(38): Xaa can be any naturally occurring amino acid
  misc_feature (96)..(96): Xaa can be any naturally occurring amino acid
  misc_feature (114)..(114): Xaa can be any naturally occurring amino acid
  misc_feature (135)..(135): Xaa can be any naturally occurring amino acid
SAGTPGEAEQKGKKEDXRADHNDPPDDFYIITHHSGMXASIPTINFLLHKGAKVILPIHLGRPKGVTPNYSLKPLVPRLTELLGVELVMANDCIAXEFQKLAAALPQRLVLLLXNVRFYNEKEKNEPEFPKNLTXVPHLYLNYAQGTTHISYASTERLTNY

SEQ ID NO: 7375 - protein, 339 aa, Zea mays
  misc_feature (109)..(109): Xaa can be any naturally occurring amino acid
TRPGPSKKSSEDIIQLRAQNGFACREVPVKETKKVFRSEDENGNKMVNQYVHLGKIGSGSYGKVVLYRNIKDGKLYAVKVLNKPYMMKVRVVRTETAMTDVLREVMIVXSIMKMLNHPNIVNLVEVIDDPNMDKFYMVLEYVEGKMVCDNGLEEATARIFLRDIISGLLYLHSHNVIHGDIKPDNLLVTSTGNVKIGDFSVSQVFEDDDDMLWRSPGTPVFTAPECCQGSAYHGRASDTWAVGVTLYCMVSGHYPFLGDTLQETYDKIANDPVEIPGDVNPQLADLLLRLLCKDPGDRITLRAAAEHPWVAGDEGPVPEFICRCGFGRRKRNDVREEVQ

SEQ ID NO: 7376 - protein, 160 aa, Zea mays
RFPPRVDPRVRSAGLGSSTVTTYIESTAGIREGGRTGLTAITVAACFLASLFFGPLLMSVPPWAVGPSLVLVGAMMMRVAKDIEWGDMKEGVPAFVTMALMPLSFSIANGIIAGLGVYVALHWYDWARHGYGKVRNALDERRNQVAAAAGEVGPAAQDVV

SEQ ID NO: 7377 - protein, 76 aa, Zea mays
MAVARAPLGAVAAMAVAALVFAILMTAAAAAQAPAPAPTSDGTSIDLGIAYILMLVALVLTYLIHPLDASSPYKLF

SEQ ID NO: 7378 - protein, 360 aa, Zea mays
TERERENLRLRLVAAEASVLASLGSNITMSSNCGEDEKELVCVTGAGGFIGSWVVNELLQRGYRVRGTARDPADSKNAHLLALEGAKERLTLCRADVLDRASLRAAFAGCHGVFHVASPVSNDPELVPVAVEGTRNVINAAADEGARRVVFTSSYGAVHMDPSRSPDAVLDETCWSDYDFCKRTDNLYCCAKMMAEVTAAAEAGARGLQLAVVLPCMTTGPMLQQTLNFSTNHVARYLMGTKRSIPNAVAAYVDVRDVARAHVLAYERPGARGRYLCIGTVLHRADLVDMLRDLFPQYPVTAKCEEDGKPMAKPFKFSNQRLRDLGLEFTPLRKSLYETVLCLQQKGHLPVIQPQQRAYL

SEQ ID NO: 7379 - protein, 327 aa, Zea mays
MGSGNLVTKKVVRRPSSIDQDIKFDQSWVEDVACPICLDSPHNAVLLRCASYEKGCRPFICDTDQTRSNCLERFRGAHGLPLPVPANARASSRTVAPLNSIHTITISSSNANNNRPACPLCRGDVMGWFVIGEARSHLNQKRRCCEESRCSYVGSFHELQRHTQQKHPDSRPSAIDPARRADWENLQRSSDVVDVLSTIHAQVPNGVVLGDYVIEYGDGDEAGDDDYEVYHGVRASWWTSCIFCKAFCRSSPPGGVRRRTRTRERRSSGGSGTRSSSNRSRSSQERFTLDEVDDGYVVAGAMARVAVSGTMAARYRDPTLGHRRSHS

SEQ ID NO: 7380 - protein, 202 aa, Zea mays
MDIAKLAGVDAVKLVVMIVRAAQTVRRNKKTCRQLVHHVQIIGDLLEKLQTPAMMQHPETRNGLNDLEEILHEVYMFVTSCQNNKYLYHLFTGKKQADQLRILQKRMNSCLQVFPLISHIDTTDRLDKILEIIASTFTGCKMCQDCLQVAHPATPGLKCIGEVKRCSLQLNCADAFNFQFVPSGGATNNFSDRNLMKVALAA

SEQ ID NO: 7381 - protein, 201 aa, Zea mays
  misc_feature (182)..(182): Xaa can be any naturally occurring amino acid
MLTRRHGGFRLGRKLLSVWRWALCRRRRRRVRGRGYLRLQPCQRGGGTTKSPSPSPMAAHAVVSIKMMQQQQQKHDDSAGSPRMLTWGRSLARRVRLLRRRGGGGGKDRLLEDAAADATTPKGQVAVYVGGGGESMRYVVPVVYFNHPLFGELLREAEEEFGFQHPGGITIPCAASRFERAXAAVAAAGGGAGKKVPSVWW

SEQ ID NO: 7382 - protein, 533 aa, Zea mays
  misc_feature (112)..(112): Xaa can be any naturally occurring amino acid
  misc_feature (145)..(145): Xaa can be any naturally occurring amino acid
  misc_feature (188)..(188): Xaa can be any naturally occurring amino acid
  misc_feature (239)..(239): Xaa can be any naturally occurring amino acid
  misc_feature (340)..(340): Xaa can be any naturally occurring amino acid
  misc_feature (436)..(436): Xaa can be any naturally occurring amino acid
  misc_feature (483)..(483): Xaa can be any naturally occurring amino acid
  misc_feature (505)..(505): Xaa can be any naturally occurring amino acid
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEXTGLSCSRPHQGQEASSTLLPINFDGLAKGFDTXGQTIFVGQYLFTGSETTSVWLEVSEVKGDDVVCIIKNTATLGXGSLFTLHCSQIHIDLPTLSDEDKDVIKKWGAPNKIDFLSLSYTRHAEDVRXQAREFLSKLGDLSQTQIFAKIENVEGLNHFDEILAEADGIILSRGNLGIDLPPEKVFLFQKSALHKCNMAGKPAVVTRVVDSMTDNLRPTRAEATDVANAXVLDGSDAILLGAETLRGLYPVETISTVGRICAEAEKVFNQDLYYKRTVKYVGEPMTHLESIASSAVRAAIKVKASVIICFTSSGRAARLIAKYRPXMPVLSVVIPRLKTNQLKWSFTGAFEARQSLIVRGLFPMLADPRHPVXAESTSATNESVLKVALDHGQSXGVIKSHDRVVVCQKVGDSSVVKIIELDD

SEQ ID NO: 7383 - protein, 185 aa, Zea mays
AILLGAETLRGLYPVETISTVGRICAEAEKVFNQDLYYKRTVKYVGEPMTHLESIASSAVRAAIKVKASVIICFTSSGRAARLIAKYRPSMPVLSVVIPRLKTNQLKWSFTGAFEARQSLIVRGLFPMLADPRHPAESTSATNESVLKVALDHGKASGVIKSRDRVVVCQKVGDSSVVKIIELDD

SEQ ID NO: 7384 - protein, 946 aa, Zea mays
MHLKLWKPLSHCAALLLDKKNRPPRTPPAGAGAGSGGGRRLQESKLREALEEASEDGSLAKSRDAALLDGGDGGAEEGSVGRSRSLARLHAQRDFLRATALAAERAFQSPDALPVLEEALAKFLVMYPNYASASDVDRLRADEYPHLDKVCLDYCGFGLFSYLQSCNPADSSAAFTLSEITANLSNHALYGAAEKGTAEHDIKNRIMDYLNIPESEYCLVFTVSRGSAFRLLAECYPFGTNKRLLTMFDHESQSVNWMTQVARDKGAKAYSAWFKWPTLKICTTELRKLISTKKRRRKDSATGLFVFPVQSRVTGAKYSYQWMALAQQNHWHVLLDAGALGPKDMDSLGLSLFRPDFIITSFYRVFGADPTGFGCLLIKKSVMACLQSPSGGTGAGLVRIVPVFPQYLSDSVDGFDGVLDGLEDDNIIPIEEGSASNSHHASQLPAFSGAYSSAQVREVIESEMDQDSSDRDGASTIYEESESVSVGEVMKSPVFSEDESSENSFWVDLGQSPLGSDHSEQSSKGKLGSPLPASWFSGRKSAKKASPKVPSKLSRSPIHDNHVMSFDAAVRSVSQEPGPEKGDPDEDNSHINIKNTPISEIEEDNKDAKVNKRFVKFSCANDTAEGEGNATSVFGSCTARENGSTSEICSESQGETKDSAIRRENEGDFRLLGRREAYNGRFNGGRFFGVEESERVPSMGHNVSFTLDDSKLCRNADAGETSGYGMADDDDDDDDAYSDYDEAQDGRKEPEIVCRHLDHVNMLGLSKTTLRLRYLINWLVTSLLQLRLPDSGDGEGAAAAAAPPLVYIYGPKIKYDRGAAVAFNVKDCGSGTSLINPETVQKLAEKEGLSLGVGFLSHIRLTDSQRHGAADVGLSSSSSPAAASGRREKKSTRKNAVVGTEVVTASLGFLTNFEDVYRLWAFVAKFLDSSFLEQERLSSIPEDAER

SEQ ID NO: 7385 - protein, 195 aa, Zea mays
  misc_feature (79)..(79): Xaa can be any naturally occurring amino acid
  misc_feature (103)..(103): Xaa can be any naturally occurring amino acid
  misc_feature (120)..(120): Xaa can be any naturally occurring amino acid
  misc_feature (143)..(143): Xaa can be any naturally occurring amino acid
  misc_feature (167)..(167): Xaa can be any naturally occurring amino acid
RLSLAATPPPRSYLRTHEKPIICRRRYVGLSGSPICRPSSCSDSFSYKELQNRCLREDQGKWVTQSAGDVDIGGNPSGXGGEDQSVDDTTAKVDDIADTFRLXENNTPFDQKSFVTISIXKYIKNLTDVVNAEKAHEIKNGDXGATTFLLNEMKDLLFFGADAHVGXDASVVFTYYKDGATNTTFLYFSHGLKEI

SEQ ID NO: 7386 - protein, 95 aa, Zea mays
  misc_feature (44)..(44): Xaa can be any naturally occurring amino acid
  misc_feature (73)..(73): Xaa can be any naturally occurring amino acid
GVTKYIQALLFAGFLMQKELDYLVGAVANPKKPFAAIVGGSKVXRKIGVIESLLAKDDILILGGGMIYTFYKXQGILVEKSLGEKDNLELGTFLI

SEQ ID NO: 7387 - protein, 523 aa, Zea mays
  misc_feature (30)..(30): Xaa can be any naturally occurring amino acid
  misc_feature (77)..(77): Xaa can be any naturally occurring amino acid
  misc_feature (144)..(144): Xaa can be any naturally occurring amino acid
MFNKIIKRGNRKGARGDSAEVAARPAAPSXSSGSGGGGAGAAAPVTVNHASRATAPSPSSPTSPHVAPSAFATNPAXAASPPLLEPLPLLRDVAAADRPGLFLRKLRLVAALFDLSDSLKHPREKEAKRQALLELVDYVQAPAXGQAGANAPTRLPDHVQEALVAAISANIFRPLPPALHESAAAIDPGAAPDEEEEPYLDPSWPHLQLVYELLLRYVVSPDTDTKVAKRYVDHAFVLRLLDLFDSEDPREREYLKTVLHRIYGKFMVHRPFIRKAINNVFYRFIFETQRHNGIGELLEILGSIINGFALPMKEEHKLFLARALIPLHKPKSVAIYHQQLSYCIVQFVEKDYKLADTVIRGLLKYWPVTNCQKEVLFLGELEEVLEATQPAEFQRCMVPLFKQIGRCLNSSHFQVAERALFLWNNDHIVSLIAQNRVVIFPIIFEALERNIQSHWNQAVHGLTANVRKMFLDMDSELFEECQQQYMEKQAKAKEIQEQRESAWRQLEAVVAAKAAGDDMVLVN

SEQ ID NO: 7388 - protein, 248 aa, Zea mays
MGRQFFVGGNFKMNGTIKSITEIVDNLNKAKLDENTEVVIAPPSLYLLLTREHLRKGIEVAAQNIFDKPNGAFTGEISVEQLKDSGITWTILGHSERRQILQENDDFVASKTKAAVDGGLGVILCCGESLEQREAGETVNVVTKQLKAVADKVKDWSKIVVAYEPIWAIGTGKVATTEQAQEVHAALREWLKKEVSAEASEKTRILYGGSVSEKNCKELAKRPDIDGFLVGGASLKPAFVDIINSHQA

SEQ ID NO: 7389 - protein, 291 aa, Zea mays
MKNVAKCDAWCELQNPANHRVFERKLRPKPSGGGHVCLGVTPLAWDRREKTRRDVVRRVLPAVPLLQFCRCCCRCHPPSASRSRHPNRSAGLQHGGGGGGEGEGEGSGSPALALALVLALAGANSEGDALSALRRSLRDPGGVLQSWDPTLVNPCTWFHVTCDRDNRVTRLDLGNLNLSGHLVPELGKLEHLQYLELYKNSIQGTIPSELGNLKNLISLDLYKNNISGTIPPSLGKLKSLVFLRLNGNHLTGPIPRELSGISSLKVVDVSSNDLCGTIPTSGPFEHIPLSK

SEQ ID NO: 7390 - protein, 159 aa, Zea mays
MDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLAGVTIAHGGVLPNINPVLLPKKTAEKASSGGSKEAKSPRKVAKSPKKA

SEQ ID NO: 7391 - protein, 87 aa, Zea mays
  misc_feature (32)..(32): Xaa can be any naturally occurring amino acid
  misc_feature (48)..(48): Xaa can be any naturally occurring amino acid
MSEYLYEGTFCGTRLEPDGIKRDIVSRAGARXSELHMYMQLDVATDVXYPMPAGEKFNMAIAPTLNLDGTPYTGYYTQGGRTTLEGN

SEQ ID NO: 7392 - protein, 309 aa, Zea mays
  misc_feature (183)..(183): Xaa can be any naturally occurring amino acid
DMPRYDDRYGGTRLYVGRLATRTRSRDLEHLFGRYGRIREVELKRDYAFIEFSDHRDADEARYQLDGRDVDGSRIVVEFAKGVPRGSGGSREYMGRGPPPGTGRCFNCGVDGHWARDCKAGDWKNKCYRCGERGHIERNCQNSPRSLRRERSYSRSPSPRRRRDRDDRRSRSPSYSRSPHAIXSPPVKEKERSPAPDGSRSPRSRSPQDQVMSPPPKDNGEGNGSDRGGSPRGRENSRSCSRSRSPSGSNRSPAANGRERSPSPRGERSPSPRADRSPSPNGNGNNDAAADVDADAAARSGSPTGSKSP

SEQ ID NO: 7393 - protein, 300 aa, Zea mays
MGNARRPAADSAAASDREVGFAKLHGECFEYYMQTYSIVLGRHSRRRSKGPVAAPPEADDGVDVDLGALGAGMNVSRRHARIFYDFLRRRFALEVLGKNGCLVEGVHHVPGSAPVKLDSQDLLQMGDTKFYFLLPSRSVFDAGITRRSSAVQRAIPPPPSDDDEDEDEHEEAVAAAKRRRDGYNGSKSYREADDQLLLQLEEKDVISSAATILSDLCGPQEWISINKLHEVMFDKYGGMWHHSRVRKYLTSEDFAEAETDGRLWHGLALLLRKYPEHFVINIRKGGGLITEFVSLVSLQS

SEQ ID NO: 7394 - protein, 328 aa, Zea mays
HASGKIGPAIATGNTVIIKTAEQTPLSGLYASKLIVEAGFPPGVINVISGFGRTAGAAISSHMDIDKVAFTGSTLVGRMILQAAAKSNLKKVTLELGGKSPNIVFDDADIDNAISWSNFGIFFNHGQCCCAGSRLLVQEGIYDKFIERFKERAAKNQLGNPFAKDTFQGPQVSQLQFDRIMEYINHGKKEGATVALGGERHGTEGYFIQPTVFTDVTPNMKIAQEEIFGPVIAVTKFKDEAEAIKIGNSTSYGLAAAVHTKNVNTAIRVSNALKAGTVWINNYNMISYQAPFGGFKESGLGRELGSYALDNYTQVKTVHYRLGDALFG

SEQ ID NO: 7395 - protein, 234 aa, Zea mays
MEASGSRVRRGSPVPKRRRGVGVATGFGSTAQSLNDDILRNRIIETAHLMRDMYYKRNPPARGSSSNISVKSYFEMLAMDEHASAFSRGPAEAFQWIGHPMRATLCRMKSGLILTGVGDKILRLWSAESCKFMNEYNVPNSKTLVDFDFDENKIVGLTSSQICIWRRSEPRSIFQSGGASFNHGLCMSFADPEVVIGCEDGRAFVYDMYSRSCSRIYRLHSSPVTCLMITDDQL

SEQ ID NO: 7396 - protein, 193 aa, Zea mays
  misc_feature (30)..(30): Xaa can be any naturally occurring amino acid
  misc_feature (33)..(33): Xaa can be any naturally occurring amino acid
  misc_feature (48)..(48): Xaa can be any naturally occurring amino acid
  misc_feature (54)..(54): Xaa can be any naturally occurring amino acid
  misc_feature (113)..(113): Xaa can be any naturally occurring amino acid
MLVYQDLLSGDELLSDSFTYNELENCVLWXSRXKWVTQGSVEVDIGAXPSDEGXEYENVDDTVRRCDIDDTFRLQEQPPIYKRSFGSYIRKYIQNLTAGMQTEKADDFKKGVXIATKFLLSKLKDLQFFVAEAMKDDASVIFTYYKDDATNPTFLYFSHGLNEIKCYACSAIIYAGCVLSMYYYYIANYSCPG

SEQ ID NO: 7397 - protein, 268 aa, Zea mays
  misc_feature (156)..(156): Xaa can be any naturally occurring amino acid
MATLSSCSRLSSGTGAAAIHRQPARAGAVLVVTCRRSSSATVRAAAAATAAAPAAVELQNKGVSLPTWAEFELGRAPVYWKTSSGLPPSPGEGLTLFYNPAATKMAPNEVFGVAFNGGFNQPIMCGGEPRQMTLQERGKADPPIYTIRIRVPQHAXVSLIFSFTNGAEWDGPYTLKFRVPKPWQNKPLSFFNEGLADELNREGACDLAIYPDENIAITSCAMDGYLEEGGDRCKLDIVSGCTDPSSDMFDPLATVDDGSCPLESDSEE

SEQ ID NO: 7398 - protein, 170 aa, Zea mays
  misc_feature (32)..(32): Xaa can be any naturally occurring amino acid
  misc_feature (60)..(60): Xaa can be any naturally occurring amino acid
  misc_feature (75)..(75): Xaa can be any naturally occurring amino acid
  misc_feature (93)..(93): Xaa can be any naturally occurring amino acid
  misc_feature (109)..(109): Xaa can be any naturally occurring amino acid
  misc_feature (127)..(127): Xaa can be any naturally occurring amino acid
  misc_feature (157)..(157): Xaa can be any naturally occurring amino acid
MLVYQDLLSGDELLLDSFTYKELENGVLWHAXGKRVAQGPVDVDIGAYPSAEGGEDESVXTHPRKVIDIADTFRXLQEPPPFDKKSFVSYIKXYMLILTAVLNAEKVDXEIRKAVKGATKCLLMKLXDLRFFAGESHDTTNRTTRFAYYKDGATNAXFLYFSHGLTEIEC

SEQ ID NO: 7399 - protein, 657 aa, Zea mays
MMNYVIFGVLLLVVGGGLRPSPAAADVFCDNLKQVAATLPQNTSSSPVQFATAIVGQAPDVVYALAFCQGDYSATACRECVAQAFNVTPACNKDGIFSYKACPVLYAGDNFIDPSNATEQADDTPFVRWNINNVTGDADDVRLITGLIRELLVDTVDRAASTAPRRFATGVMDSGRPFPTMYSMAQCTPDLSASDCLACLRRLVGMVNSTMALRMGAQIHVIRCYFRYEAYSLYDSQPMLRVGPPSVPAPAPAPAIGARRKSKLWVIPVVVVPLAVAAAAALCFIFYSPWFRRYRKGETTMAKAGSQELQGELVLDGKNSEFRVFDFEQVLEATNDFSDENKLGEGGFGAVYKGQFADGLEVAVKRLASHSGQGFTEFKNEVQLIAKLQHSNLVRLLGCCSQEEKKILVYEYLPNKSLDSFIFDENKRALLDWSRLLSIIEGIAHGLNYLHKHSRLRVIHRDLKPSNILLDREMNPKISDFGLAKIFSSNNIGGNTTRRVVGTYGYMAPEYASEGIFSVKSDVFSFGVLVLEIITGKRNSGSHQCGDFINLIGYAWQLWDDGRWIDLVDAYLVPMNHSAEMTKCIKIALLCVQENASDRPTMAEVVAMLSLSNDTAMIVAEPKQPAYFNVRVGNEEAYTTTESCSINDVTISVTTPR

SEQ ID NO: 7400 - protein, 335 aa, Zea mays
NSDPSHGPTTSIPFPSLPSCPAGSPARRLCPDPGDMPRYDDRYGGTRLYVGRLAPRTRSRDLEYLFGKYGRIREVELKRDYAFIEFSEHRDADEARYQLDGRDVDGSRIVVEFAKGVPRGPGGSREYMGRGPPPGTGRCFNCGMDGHWARDCKAGDWKNKCYRCGERGHIERNCQNSPRSVRRERSYSRSPSPRRGRGRSPSYSRSRSRSRSRSYSRSRSLSGSPRGGRRDRDDRRSRSLSYSRSPVRSPPAKEKERSPTPGGSRSPRSRSPQDQVMSPPPKDNGDRNGSDRGDSPRGREDSRSRSRSPSGGNRSPAANGRSPSPRGDRTPRPLG

SEQ ID NO: 7401 - protein, 378 aa, Zea mays
LEAGRGGLEFGSLPAHPSPSLPSCPAGSPARRLCPDPGDMPRYDDRYGGTRLYVGRLAPRTRSRDLEYLFGKYGRLTVCGNPFRRIREVELKRDYAFIEFSEHRDADEARYQLDGRDVDGSRIVVEFAKGVPRGPGGSREYMGRGPPPGTGRCFNCGMDGHWARDCKAGDWKNKCYRCGERGHIERNCQNSPRSVRRERSYSRSPSPRRGRGRSPSYSRSRSRSRSYSRSRSLSGSPRGGRRDRDDRRSRSLSYSRSPVRSPPAKEKERSPTPGGSRSPRSRSPQDQVMSPPPKDNGDRNGSDRGDSPRGREDSRSRSRSPSGGNRSPAANGRSPSPRGDRGPSPMADRSPSPKGNGNNDGGDDDTGRGGSPTGSKSP

SEQ ID NO: 7402 - protein, 559 aa, Zea mays
  misc_feature (180)..(180): Xaa can be any naturally occurring amino acid
  misc_feature (190)..(190): Xaa can be any naturally occurring amino acid
  misc_feature (197)..(197): Xaa can be any naturally occurring amino acid
  misc_feature (333)..(333): Xaa can be any naturally occurring amino acid
  misc_feature (370)..(370): Xaa can be any naturally occurring amino acid
MALEAAYDYLHVAVVQCTPTQAAAVLGVLLLLAIRLAAAARSSSATSPKWKQHRLPPTPPGKLPIIGHLHLIGSHPHVSFRDLHAKYGHNGLMLVQVGAVPTIVVSTPQAAEAVLRTHDHVLASRPRNPVADIIRYNSTDVAFAPYGEYWRTARKVVNTHLLSAKMVFSKRREREEEGAXLVVARIRDAXAEASPGXTALDMTELLGGYASGLACRAVLGESHRKQGRNKLFRELTETSAALLGGFNVEDYFPKLADVDLFLRIICAKAKGVSKRWDSLFNELLSEYALSGGKQGDHNSEDFVHLLLSLQKDYGLTTDNIKGILGVIYATTYXLSCLSVCLSSQCLWFYRTWFEAAIETSFLVLEYSMSXELMNNRHVLAKLQKEVRTATPDGRMVMEEDLSRMPYLKATIKESMRIHPPAPFLLPHFSTHDCEINGYTIPAGTRVIVNAWALARDPTCWDKAEEFFPERFLEQGRDAEVDMYGKDIRFVPFGAGRRICAGATFAIATVEIMLANLIYHFDWEMPAEMERTGAKVDMSDQFGMTLRRTQKLYLVPRIPK

SEQ ID NO: 7403 - protein, 82 aa, Zea mays
CYFLSQGTCWTSYFQDTFGGTILDPDGRHVDKVPRGEAHHEPLDMYMHLDVATDAYRMPRSERLNMEIAPTLNFPGTPDTDI

SEQ ID NO: 7404 - protein, 157 aa, Zea mays
MANALDHLNSGRTRIEWLSQLNTEYTPAREYRRTSIICTIGPKTNSAEKINALRKVGLNVVRMNFSHGSYEYHQSVIDNAREAERTQPGRPVAIALDTKGPEIRTGNTVGDADIPIKAGSIINMTTDEQYATGCDDKNMYVDYKNITKGIVPGRTIY

SEQ ID NO: 7405 - protein, 208 aa, Zea mays
MEVEACYNYGFLPADRGRHQPPPPPHATLPHAAEDAGELWEYFPCPFCYIEVEVPFICNHLQEEHCFDTRNAVCPICANNLGKDMAAHFRLQHTHLLKRRKPYRPSSCPAAATSPATYQVNSYYEEAEPQQHYSRPYKDPAPDPLLSQFICSVDAIPGDDNAQKDDQRLKLNNKGATASDDDASSKLGLEERLQRIDFLTEILMSTIL

SEQ ID NO: 7406 - protein, 322 aa, Zea mays
METAERGTTVCVTGAGGFVASWLVKLLLSTGRYTVRGTVRHLGDGKNAHLKTLEDAGERLQLVKADMLDYGSVASAVAGCQGVFHVASPVPSGKSSNPEEDVIAPAVTGTLNVLKACYEAKAKRVVVVSSVAAVFNNPDWPKGEAFTEDSWSDGEYCRKNEEWYFLSKTLAEHEAFAYAAKTGLDIVTICPSLVIGPLLQPAVNTSIKVFLSYIKGDQEIVKDGPKNLVDVRDVAGALLLAYENLQASGRYLCSSPAIRVSDIVNILKTEYPTYTYPQKFVEAEGSNTYNTEKLRKLGWTSRPMEDTLRDSIECYRAMGILN

SEQ ID NO: 7407 - protein, 63 aa, Zea mays
MAGGRVAHATLKGPSVVKEIFIGLTLGLIAGGMWKMHHWNEQRKTRSFYDMLDKGQISVVVEE

SEQ ID NO: 7408 - protein, 77 aa, Zea mays
  misc_feature (52)..(52): Xaa can be any naturally occurring amino acid
MGPDQPRSKRERRQMAGGRVAHATLKGPSVVKEIFIGLTLGLIAGGMWKMHXWNEQRKTRSFYDMLDKGQISVVVEE

SEQ ID NO: 7409 - protein, 150 aa, Zea mays
FTYKEIENGVLWEGEGKRDTQGPVDVDIGANPSVEAGEDESADDTTAKVGDIVDTFRLQEQPTFDMKSLEYYIKTYIKTLTVVLEPEKANEFIKGEEGATKLLLSKLKDLQFFDGEFMKEDATVVLGYYKDAATNPTFLYSSNGLMDIKG

SEQ ID NO: 7410 - protein, 547 aa, Zea mays
MGNACSGALRSKYLHSFKHAASQRHDSEYSASADDSPRKPTPPATTDAHAPAPPAAAMRRGAAGATPDLGSVLGHPTPNLRDLYALGRKLGQGQFGTTYLCTELATGIDYACKSISKRKLITKEDVDDVRREIQIMHHLSGHKNVVAIKGAYEDQVYVHIVMELCAGGELFDRIIQRGHYSERKAAALTRIIVGVVEACHSLGVMHRDLKPENFLLANRDDDLSLKAIDFGLSVFFKPGQVFTDVVGSPYYVAPEVLLKSYGPAADVWTAGVILYILLSGVPPFWAETQQGIFDAVLKGAIDFDSDPWPVISDSAKDLIRRMLNPRSAERLTAHEVLCHPWIRDHGVAPDRPLDPAVLSRIKQFSAMNKLKKMALRVIAESLSEEEIAGLKEMFQIMDTDNSGAITYDELKEGLRKYGSTLKDTEIRDLMEAADIDNSGTIDYIEFIAATLHLNKLEREEHLVAAFSYFDKDGSGYITVDELQQACKEHNMPDAFLDDVINEADQDNDGRIDYGEFVAMMTKGNMGVGRRTMRNSLNISMRDAPGAF

SEQ ID NO: 7411 - protein, 375 aa, Zea mays
MAAVAIHQFAECITCHAWSPDQSMIAFCPNNHEVHIYKFFTDKWEKLHVLSKHDQMVSGIDWSKSSNKIVTVSHDRNSYVWTQEGSDWVPTLVILKLNRAALCVQWSPKENKFAVGSGAKSVCICYYEQENNWWISKVIRKRHESSVTSLAWHPNNIYLATSSTDGKCRVFSTFIKGVDTRGSKSSTSTDSKFGEQIAQLDLSSTWVFGVRWSPSGKTLAYAGHNSMVYFIDEVESSPVAQNLALRDLPLRDVLFVSERTLIGVGFDCNPMIFAADDTGLWTFIRFLDEMKAAPSASKASQLSEALGKLYGQSKQGASSDTVEPSKARGGAHENCITCIVPLRKGSDGSIKRFSTSGLDGKVVVWDLENHVSIAK

SEQ ID NO: 7412 - protein, 779 aa, Zea mays
MLAQLLLVHLLLLPAASSADHHRHYRGRRALHEPLFPLESTPTLPPPPPAPFFPFLPGAAAPPTPVATPEVGSASTPADTGAGDASSSPHPTAPANISSLAPLPVSHGAPLRAFLSSHRLLTVLVLVVAVAAAVLTAALVYILARRQHRHSPKEEAAVYAKPSSLAPGNPVPYDGGDQHGRGSTATVSSASSPELRPMPPLPRQFQQTQMNLASCSKSVLDAGAGGKRPSEGAPPPPPPPPPPLLPPMPPVKDKGGATAATAPPAPPPPLPRAGNGSGWLPRRHSERPATTVIRASASAVHPEESPGRAPSEKQEPADADADALPKLKPLHWDKVRASSGRPTVWDQLKASSFRVNEEMIETLFVSNSTWRSSKSGIKAPNSSSCSQENKVLDPKKSQNIAIMLRALNATKEEVCRALLDGQAESLGSELLEMLLKMAPSREEEIKLKECREDAVSKLGPAESFLKAVLAIPFAFKRVEAMLYITNFDLEVDYLKTSYKTLEAACEELQGSRLFHKILDAVLKTGNRMNTGTNRGNAHAFKLDALLKLVDVKGADGRTTLLHFVLEEDRQVRRRHVVATGQTSGQAGALADDLQCRKVGLKIVASLSGELSSVKKAAAMDSSTLGSCVSKLSSGARRISEVLHLSSASEDGCKCKRFRASIGEFLQKAEAEVAGVQAQEDRALARVRETTEFFHGDSAREEGHPLRIFMVVRDFLTALDHVCRDVVKVNERAAAGGWSRRVGKHARSSGVWRGAVPVHLLLLLVGGELGAPSRRDAMQH

SEQ ID NO: 7413 - protein, 375 aa, Zea mays
MAAAAIHQFAECITCHAWSPDQSMIAFCPNNHEVHIYKFFTDKWEKLHVLSKHDQIVSGIDWSNSSNKIVTVSHDRNSYVWTQEGSDWIPTLVILKLNRAALCVQWSPKENKFAVGSGAKSVCICYYEQENNWWISKVIRKRHESSVTSLAWHPNNIYLATTSTDGKCRVFSTFIKGVDTRGSQSSTSTNSKFGEQIAQLDLSSTWVFGVRWSPSGKTLAYAGHNSMIYFIDEVESSPVAQNLALRDLPLRDVLFVSERTLIGVGFDCNPMIFAADDTGLWSFVRFLDEMKAAPSASKASQLSEALGKLYGQSKQGASSDTVEPSKARGGAHENCITCIVPLRKGSDGTIKRFSTSGLDGKVVVWDLENHVSIAK

SEQ ID NO: 7414 - protein, 175 aa, Zea mays
  misc_feature (73)..(73): Xaa can be any naturally occurring amino acid
  misc_feature (87)..(87): Xaa can be any naturally occurring amino acid
  misc_feature (96)..(96): Xaa can be any naturally occurring amino acid
  misc_feature (105)..(105): Xaa can be any naturally occurring amino acid
  misc_feature (130)..(130): Xaa can be any naturally occurring amino acid
  misc_feature (140)..(140): Xaa can be any naturally occurring amino acid
MAPTVMMASSATAVAPFQGLKSAASLPVARRSTRSLGNVSNGGRIRCMQVWPAYGNKKFETLSYLPPLSTDDXLLKQVDYLLRNGWXIPCLEFSKXGFVYRENSXTSPCYYDGRYWTMWKLPMFGCTDAXTQVYKELQEXAIAAYPDAFHRVIGFDNVRQTQCVSFIAYKPPGSE

SEQ ID NO: 7415 - protein, 186 aa, Zea mays
  misc_feature (73)..(73): Xaa can be any naturally occurring amino acid
  misc_feature (87)..(87): Xaa can be any naturally occurring amino acid
  misc_feature (110)..(110): Xaa can be any naturally occurring amino acid
  misc_feature (125)..(125): Xaa can be any naturally occurring amino acid
MAPTVMMASSATAVAPFQGLKSTASLPVARRSSRSLGNVSNGGRIRCMQVWPAYGNKKFETLSYLPPLSTDDXLLKQVDYLLRNGWXIPCLEFSKVGFVYRENSTSPVLXDGRYWTMWKLPMFGXCTTPTQVYKELQEAIKSYPDAFHRVIGFDNIKQTQCVSFIAYKPPGQRLDRAAPAAPPPAS

SEQ ID NO: 7416 - protein, 279 aa, Zea mays
HERSAPRRRDRLTRPLVSDLKGDWYPADMPESSMRSLQGYKAFICIALLLGDGLYNFVKVVAFTVKSLLGRSRLKNAKKEEDIPVLDEIQRNEIFTRDSIPTWLAYSGYLALSAVAVFAIPLMFHEMKWYYVIIAYLLAPALGFCNAYGAGLTDINMAYNYGKVALFILAAWAGKDSGVVAGLVGCGLVKSLVSISADLMHDFKTGHLTLTSPRSMIIAQAIGTAMGCVIGPLTFLLFYKAFDIGNPDGYWKAPYALIYRNMAILGVQGFSALPLHCLQ

SEQ ID NO: 7417 - protein, 170 aa, Zea mays
MAPTVMMASSATAVAPFQGLKSTASLPIARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 7418 - protein, 336 aa, Zea mays
MGADYYKVLGVDRGAGDDDLKKAYRKLAMRWHPDKNTTNKKEAETKFKDISVAYEVLSDPKKRAIYDQLGEEGLKGQPPPGAGGSGAFPFFPGGAHSTAPHFNHRSADDIFKEFFGSPGMGGMRAEPGFQRSMFGNDIFSSRFGAEGSTSMQQPPRKAAAIENPLPVSLADLYKGVTKKMKISREAIDASGRISNAEDILTIEVRPGWKKGTKITFPDKGNEAPNMKAADIVFILDEKPHDVFTRDGNDLVVTEKISLVEALIGYTARVTTLDGRSLSLPINSIIHPSYEEVVPREGMPIPKDPSKKGNLRIKFNIMFPSRLTSDQKAGLKRILGS

SEQ ID NO: 7419 - protein, 237 aa, Zea mays
LALADEEQHLILKQHPVLCVVLLAGASGAQEGRRRQHQHEHHRPPPRLELAMAHARDGGGHGHGHEEEAEAAVCLDGDSEAGEARSAGRAPPWRDQLTARGMVASLAVGAMYSVIVMKLGLTTGLVPTLNVSAALIAFVILRGWTQALARFGVATRPFTRQENTVVQTCAVACYSIAVGGGFGSFLLALNKRTYEMAGEDTEGNLPGSYKEPGIGWMTGFLFAVSFVGIVALIPLRK

SEQ ID NO: 7420 - protein, 186 aa, Zea mays
  misc_feature (110)..(110): Xaa can be any naturally occurring amino acid
  misc_feature (164)..(164): Xaa can be any naturally occurring amino acid
LAGNRRINFYVRPQVEEFGSIFHLYVWGTSLSTTVLRSIGSDYGRPGTWCWIQQGSMAKVLHLITFYLPLWGAILYNGFTYYEVNRMLNNATQMAAGISDQSNQSDIRAXQEGHRIVWLSFLDVGFAGLMGLFNSIAYGLNSSVRRAISERIDTFLPERIKRSXPALSRLRSQQENELTFLIVEGN

SEQ ID NO: 7421 - protein, 490 aa, Zea mays
MVWQIIATAIALGICLHAGNHLACDFPRLIASAPEEYRLVARFFGRDRPSYRGLLAGAEGVTGIVMVTLMAVSFTLATRPFRKREEASRDKKKAAACRGVPLAGFNAFWYSHHLLIVVYLLLLVHGWFMFLVDKWYQRTTWMYISVPLALYVGERTLRAFRSKAYAVKILKVCLLPGNVLTVTMSKPYGFRYRSGQYIFLQCPTISPFEWHPFSITSAPGDDCVSVHVQTRGDWTQELKRIFVENYFTPCVPRRAAFGDLGAVDHKTKSPPRLLVDGPYGAPAQDFRNYDVLLLVGLGIGATPFISILRDLLNNIKLADELMDLAMETGRAEDSASNLSASTASGGNKRRAYRTTCAHFYWVTREPGSFEWFKGVMNEVAEMDKKGVIELHNYLTSVYEERDARTTLLSMVQALNHAKHGVDIVSGTRVRTHFARPNWKEVFTRIASKHPNSTVGVFYCGRPTLAKELKKLSLDMSHRTGTRFDFHKEYF

SEQ ID NO: 7422 - protein, 157 aa, Zea mays
MDGGGAKAKKAAAGRKLGGGGPKRKPVSRSVKAGLQFPVGRIGRYLKKGRYAQRVGTGAPVFLAAVLEYLAAEVLELAGNAARDNKKTRIIPRHLLLAIRNDEELGKLLGGVTIAHGGVLPNINPVLLPKKAAERAEKAAAAGPKSPKKAAAKSPKK

SEQ ID NO: 7423 - protein, 423 aa, Zea mays
  misc_feature (304)..(304): Xaa can be any naturally occurring amino acid
HWVPRGRPGGAKTALPAIPSHLLHHRHIAADLIPPPLEESAEPTEGDHMGAEAAHPQQQPPSSVRPCREAAAPAVLGLQLSALIDHVARVDWSLLDRVAGDRGGSQQVSIVELNHILNEVNTHILPSHNDLTPITTIAGGSVANTIRGLSAGFGISTGIIGACGDDNQGLLFVNNMSFSGVDLTRLRAKKGHTAQCVCLVDASGNRTMRPCQSSAVKIQANEFRKEDFKGSKWLIVRYAQQNMEQIIEAIRIAKQEGLSVSLDLASFEMVRDSRSKLINLLETGNIDLCFANEDEAREVIGGGXLESDPEEALAFLGKYCKWAVVTLASKGCMAKHGKQVVQVPAIGESNAVAVDTTGAGDLFASGFLYGLVKGLPLEECCMVGACSGGSVTRALGGEVRPENWQWMYKQMHARGMLLPELKN

SEQ ID NO: 7424 - protein, 253 aa, Zea mays
  misc_feature (190)..(190): Xaa can be any naturally occurring amino acid
MAGASRKDLLKKVYNMVPPMLESFHKGQLGRVAVIGGSEDYTGAPYFSAMASAKLGCDMSHVICEPGAGAVIKTYSPNLMVHPYMRQSKNLAQSESAESVSAEVVGMLSRLHVVVIGPGLGRDKLMQDTCAKVIEEARKQGIPFVLDADGLYLAQTRPELVEGCKECILTPNVVEFGRLAKAKGVNVDEXRSFRTLLQAIKGFLGGVTIIQKGAKDYISNGSHTLVSEGEGGLKRSGGQGDTLTGSLATLLTY

SEQ ID NO: 7425 - protein, 200 aa, Zea mays
  misc_feature (50)..(50): Xaa can be any naturally occurring amino acid
  misc_feature (65)..(65): Xaa can be any naturally occurring amino acid
  misc_feature (111)..(111): Xaa can be any naturally occurring amino acid
RPGLSFSRRSSIHTRRNRRARARHGAASEKKSNGLSTYTVDETLVSMTLXKLPACAAAYSGYGYXTSEPTETTLLSFAATSAHTDRPLSAHEESLITSVAFARMLVRPYAXRILSNNYGRRAEINFTDIVTVGDDLHIAFAPNYLSLIELRFMLASWTVTVRPVIRSCCLKFIPAPNRGTWMVMLSTLWTAGTIMQASLA

SEQ ID NO: 7426 - protein, 234 aa, Zea mays
TRKTWFDDKPNDGTAAHVISRGGPVERGQIDEEGIREGEDLHRGLKARQISMIAIGGSIGTGLVIGSGSGLAKGGPVGLLIAYVIMGAMCFGVMCSLGEMATYLPHKKGFGGYASRFVDPSMGFALGWNYLMKYLVVTPNNITAGAIVVRYWTDKVPIGAWITIYIGGCFLVNLLGIEVFGEVEFWASFIKIIVLAGLILLGIIIDLGGAVVDRIGFRYWRGQPFSHYIFQNDT

SEQ ID NO: 7427 - protein, 111 aa, Zea mays
YDNIGLKTLFFPCGTFSRIASIAKDRPMSSGEACNDIMAYSLILSCCCYTCCVRRKLRQKLDIAGGCCDDFLSHLLCCCCALVQEWREVEIRGAYSEKTKVTPPACQYMEH

SEQ ID NO: 7428 - protein, 173 aa, Zea mays
  misc_feature (27)..(27): Xaa can be any naturally occurring amino acid
  misc_feature (62)..(62): Xaa can be any naturally occurring amino acid
  misc_feature (113)..(113): Xaa can be any naturally occurring amino acid
  misc_feature (152)..(152): Xaa can be any naturally occurring amino acid
MAALPLATAEVCDANPHLIMNGELRAXLQPIFQIYGRRQVFAGPIVTLKVYEDNVLVREFLXEEKGHGRVLVVDGGGSMRCAILGGNPVQQAQNNGWAGILVNGCIRDVDENXINGCDIGVRALSSHPMKANKKGMGEKHVPVNIAGTRICXDGEWLYADPDGILVSRTELTV

SEQ ID NO: 7429 - protein, 260 aa, Zea mays
  misc_feature (192)..(192): Xaa can be any naturally occurring amino acid
  misc_feature (241)..(241): Xaa can be any naturally occurring amino acid
MVENGVEQPLLQGGGPPNNAGHAKPPPGARPPRRFRRCRTAPSTDAAQESPPRSQQDPSLQRGTTQLAPPKELLRGARPSFRVVGVLLLAYLLAGTVAFYLAMDHMSGDRTGSRVVDALYFSVVTMTTVGYGDLVPSSDAAKLLACAFAFAGVALVGTFLSKAADYLVEKQEALLFRALHARNRKALRVVEXNRVRYKLYTAAALLAAALASGTAFHGPRVEGMRPVDAFYCVCATVTTLXYGDRSFSSVAGRAFAAAWI

SEQ ID NO: 7430 - protein, 523 aa, Zea mays
  misc_feature (306)..(306): Xaa can be any naturally occurring amino acid
PPGSFFLKDAVQIITKMAAANGVRRVWVGQNSLMSTPAVSAVIRERIGADGSKATGAFILTASHNPGGPTEDFGIKYNMGNGGPAPESVTDKIFSNTTTISEYLISEDLPDVDISVVGVTSFSGPEGPFDVDVFDSSVNYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEVXPTGWKFFGNLMDAGMCSICGEESFGTGSDHIREKDGIWAVLAWLSIIAFKNKDNLGGDKLVTVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKTGRDSQEALAPLVDVALKLSKMQEYTGRSAPTVIT

SEQ ID NO: 7431 - protein, 410 aa, Zea mays; identical to SEQ ID NO: 535

SEQ ID NO: 7432 - protein, 202 aa, Zea mays
MCARTRCSTRSQFDSSSSIQRLPPVRIEERRKNRHRTSSPVQIMALLKAARVADVPTLDVVVAPGLVAVAKARSAAAVGGRFSVIGHRGKGMNALASEDPRLRDVRENTVRSFNDAGRFPVDYVEFDVQERQLTIAKNTTLLVTKDGCPIIFHDNFIFTQDDGKISQKRVADIQLEDFLQYGLQNEQGKVRRVTMHLAYGIE

SEQ ID NO: 7433 - protein, 685 aa, Zea mays
MAPPFACAMHGRALLAAAAAALLASAVTLTLLPSAAAQPWVGPWPTCDDTTGNYSAGSAYAKNIKQLILSLQANASNTPALFATGSAGAGADAVYGLILCRGDLSPTDCFDCGTNAGQDVYRVCNGTRDAALVYNQCYVRLAPTDFLATTNNTGMRDLINGNSVPAGVNVTAYDGAITRLLNATARYAVDSSAPSLSPRKYFATGQMAGVDPRFPTGIWSMAQCAGDISPVQCRSCLDDLLAQWWQKFDSKEIGARLDGSRCNLRFETGNFYTGSPMVKLQMNGEEAAPAPVPSTDVLPGTTGGKKNSVGKLLGIILPIVFVAAIAAIALCIWIVRKKRTYQGTNLPQTDTTYMAEDIESIKSILLSLPSLQAATNNFDESNKLGEGGFGTVYKGNLSGQEVAVKRLPKGLDQGLEELKNELGLMAKLHHRNLVRLEGFCLEEGERLLVYEYMPNKSLDNILFDHEKKRQLDWRKRFNIIEGVARGLQYLHEDSQNKIVHRDLKASNILLDSNMNPKIGDFGLARLFLQDQTRGITNHIVGTFGYMSPEYVMRGQYSIKSDVFSFGILVIEIVTGQKNNGHYFDEQNEDVVSIVWKHWSEGTLAEIIDDSLGRNYSETEVLKCVNIGLWCLQQNPMDRPTMSDVMVMLNDDDTSSLPAAAKPTFFLDASSGYSYTSGTISHPSAR

SEQ ID NO: 7434 - protein, 433 aa, Zea mays
  misc_feature (140)..(140): Xaa can be any naturally occurring amino acid
MAASARDSTDAAERVVDDHDGWASDAEMDVEMDVVEGDADRRDGGADGDDEYLLLTRIRDTSAAEARAGKDIQGIPWERIHIARQDYRKARLEQYKNYENFPQSGELMDKLCKQVEKSSKYYEFQHNTRSVKPSILHFQXSHWSSLSHKLSEVLDFSGHVAPAEKYPGSLLEGFSGVQVSTLAVNEGLVVAGGFQGELIGKDVEGCSVKFCMRTTLSDNAITNAIDIHRSMSGSLHITVSNNDCGVREYDMERYQLVNHYRYNWPVNHTSVSPDKKLLAVVGDDRDALLVDSRNGKVTSTLVGHLDYSFATAWHPDSRTFATGNQDKTCRIWDTRNLSTSLAVLRGNIGAIRCIRYSSDGRFLVFSEPADFVHVYSVAADYKKRQEIDFFGEVSGITLSPDDESLFIGVCDRVYASLLQYRMIRGFDYLDSYV

SEQ ID NO: 7435 - protein, 75 aa, Zea mays
  misc_feature (40)..(40): Xaa can be any naturally occurring amino acid
GTLWYNYCTNPFFILCRFQEHLSSFNQSPGASRGVYVFSXELTPYVGHPNPMQEGQELFRKGLLSEAVLALEAEV

SEQ ID NO: 7436 - protein, 499 aa, Zea mays
PGRAALKVWEELVNVLRKDGADPAAAFVHRKKVQHAEKSIRDAFLALYRGLDLLKKFSSLNVKAFTKILKKFVKVLDLPFTQNPDTHTLTLCCAVCTKPRNSFSAFQQVSEQHRKGDLFSEKVKRSPFSSSDKVLQLADEVECIFLRHFAGNDRKVAMKYLKPQQPRNTHMVTFLVGDMFALISLHVFLYGCNLSMWKGTRINHNFIFDFSSSTALTHRDAFLMSASIMCTVVAALVVNLFLRNAGATYANALPGALLLLSAGVLFCPFNIFYRSTRFCFMRVMRNIVLSPFYKVLMADFFMADQLTSQIPLLRHLEFTGCYFMAETFRTHAYGSCTSSSQYKNLAYVLSFLPYYWRAMQCLRRYLEEGHDMNQLANAGKYVSAMVAAAVRFKYAATPTPFWMWMVIASSTGATIYQLYWDFVMDWGFLNPKSKNFWLRDQLILKNKSIYYASMMLNLVLRLAWAESVMKLRLGMVESRLLDFSLASLEIIRRGHWNFY

SEQ ID NO: 7437 - protein, 501 aa, Zea mays
MASNGCNGNGNGKAAPAGVVVPEIKFTKLFINGEFVDAASGKTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAGVAVGARRHRVGDLLLRHRPGRAVRQVQDERLRPGPGAGSHGQVPAGQERHHRAPGLAMGPMEPHRSLLVQCTCVMRACSHSWTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 7438 - protein, 164 aa, Zea mays
  misc_feature (65)..(65): Xaa can be any naturally occurring amino acid
  misc_feature (102)..(102): Xaa can be any naturally occurring amino acid
RGGRARFLSLSVSRIERERSRREQRARGAEGSRGQEEEEEEARSERGCRALNVSTNVNLEGVDTXSAILAEASKSVANIIGKPEAYVMVVLKGSVPMAFGGXTQEPAAYGELVSIGGLNPDVNKKLSAGIASILESKLSVPKSRFYLKFYDSKRSDFGWNGSTF

SEQ ID NO: 7439 - protein, 354 aa, Zea mays
MAAESENGNCKAWAARDPSGVLSPHSFNRRAVQSGDVSLKIIYCGVCYADVAWTRNKLNDSKYPLVPGHEIAGVVTQVGADVKGFKVGDHVGVGTYVNSCRDCENCNISLDNHCPKAVYTFNGIDTDGTVTKGGYSTHIVVHERYCFKIPDGYPLAKAAPLLCAGITVYTPMMRHNMNQPGKSLGVIGLGGLGHMAVKFGKAFGLKVTVFSTSESKRDEAINLLGADNFVISSDTQQMESLKNSLHFIIDTASGDHPFDPYFSLLKVGGVMTLVGFPSEIKMHPASLILGARTLSGSVVGGIKDIQEMVNFCAANNIYPEIEIIKIDYINEALARLVNRDVKYRFVIDIENSFK

SEQ ID NO: 7440 - protein, 228 aa, Zea mays
MATVSLTPQAVFSTESGGALASATILRFPPSAAADVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVPAGGHIVTTTDCYRKTRIYMENELPKRGISMTVIRPADRDALPNALDHNNVSLFFTETPTNPFLRCIDIEHVSN

SEQ ID NO: 7441 - protein, 243 aa, Zea mays
MTGFGSPCGACKFLRRKCVRGCVFAPYFCHEQGAAHFAAIHKVFGASNVSKLLAHLPLADRAEAAVTISYEAQARLRDPIYGCVAHIFALQQQVMTLQAQLASLKAQAAQGQQGVHEDAKGYVGSAAAEQLGYGYPWCSGNGGAAAAAGAVGAPAAQPGAYGNGAHESLTALLGSSDYMQQSLYHAFEQAGADDDDGRQGYGFEAAAESSSLGAEESGWRSSSGYQDCEDLQSVAYAYLNHRS

SEQ ID NO: 7442 - protein, 207 aa, Zea mays
  misc_feature (156)..(157): Xaa can be any naturally occurring amino acid
  misc_feature (188)..(188): Xaa can be any naturally occurring amino acid
MASEINPKTEAFDAHDGSPRYDEKHGTTEPIQTPKGSWALRNGLTIESFKAHDDYAKGTVELSRDMKPRHLNMIAIGGSIGAGFFVGSGGALQTGGPGSLTIGFLIMGVMIFNVVYALGELAVMYPVSGGFYTYANRFVDPSWGFAMGWNYVMQWXXVLPLELTVCGTVIQYWAPDTSVAIWVSVFLXVIIIVNIFGTLGYAEEEFW

SEQ ID NO: 7443 - protein, 443 aa, Zea mays
MAAPSGGGGGGAGEGSSSAAAAMTIGAHGVDQVTEAMWQMNLGDAMELGPYPERVGDPDCSYYMRTGMCRFGMTCKFNHPADRKLAVAAARMKGEYPQRIGQPECQYYLKTGTCKFGATCKFHHPREKAAMATRVQLNELGYPLRLNEKECAYYLRTGQCKFGSTCKFHHPQPSTMMVAVRGSVYSPGQSATSPGHHAYQGAVTSWPLSRSASFIASPRWPGHSSYAQVIVPPGLVQVPGWSPYAAQIGSSSSDDQQRTPGAAQYYTGSRQSGTPGIGDRGMFSSYQAGSVPVGLYAVQTENVFPERPDQPECQFYMKTGDCKFGSVCKFHHPRERIIPTPNCALSPLGLPLRPGEPICSFYNRYGMCKFGPNCKFHHPMGNPMYGHASSPTSEAQTSRRMLAHVPSHPEVSPDSGSGRSRRIVHSDSQQIPSVERITEREAS

SEQ ID NO: 7444 - protein, 255 aa, Zea mays
  misc_feature (43)..(43): Xaa can be any naturally occurring amino acid
  misc_feature (201)..(201): Xaa can be any naturally occurring amino acid
  misc_feature (226)..(226): Xaa can be any naturally occurring amino acid
  misc_feature (231)..(231): Xaa can be any naturally occurring amino acid
MATVSLTPQAVFSTESGGALASATILRFPPNFVRQLSTKARRXSAAAEVSAIPNAKVAQPSAVVLAERNLLGSDASLAAHAGERLGRRIATDAITTPVVNTSAYWFNNSQELIDFKEGRHASFEYGSALEKAESTVFVASGMYAAVAMLSALVPAGGHIVTTTDCYRKTRIYMETELPKRGISMTVIRPADMDALQNALDXNNVSLFFTETPTNPFLRCIDIEHVXNMCHXKGSVLRIDSTFASPYHQKALTFSA

SEQ ID NO: 7445 - protein, 381 aa, Zea mays
MATVSLTPQAVFSTESGGALASATILRFPPNFVRQLSTKARRNCSNIGVAQIVAAAWSDCPAAASAAAEVSAIPNAKVAQPSAVVLAERNLLGSDASLAVHAGERLGRRIATDAITTPVVNTSAYWFNNSQELIDFKMTVIRPADMDALQNALDNNNVSLFFTETPTNPFLRCIDIEHVSNMCHSKGALLCIDSTFASPINQKALTLGADLVIHSATKYIAGHNDVIGGCVSGRDELVSKVRIYHHVVGGVLNPNNTALRMAQFLEEHLKIARVYYPGLPSHPEHHIAKSQMTGFGGVVSFEVAGDFDATRKFIDSVKIPYHAPSFGGCESIIDQPAIMSYWDSKEQRDIYGIKDNLIRFSIGVEDFEDLKNDLVQALEKI

SEQ ID NO: 7446 - protein, 290 aa, Zea mays
MGKDDVVESGAGGGEFAAKDYTDPPPAPLVDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 7447 - protein, 149 aa, Zea mays
  misc_feature (69)..(69): Xaa can be any naturally occurring amino acid
ASFPVSRKQSLDITSIASNGGRVSCMQVWPPINMKKYETLSYLPDLSDEQLLSEIEYLLKNGWVPCLEXFETEHGFVYRENHKSPGYYDGRYWTMWKLPMFGCTDATQVLAEGQEAKKAYPQAWVRIIGFDNVRQVQRIRFIGYKPEGY

SEQ ID NO: 7448 - protein, 350 aa, Zea mays
MQAKARIHADPVHEFDQFDCLHDSLVLLILNKLEDVRSLGRCSAVSKRFSGLVLLVHDVRVKIDHVVTVDGGADDALNLSSPKPHNIISHLFKMMLFAIAKPFHDMRSPISAGRLLFPQLSQHSPVQVLKNFSHVRNLQVELPSGDVAVEEGVLLKWRAEYGSTLQSCVILGGTLVDRKAAGSGHEPSPDDKGSMPESFYTNGGLKLRVVWTISCLIAASTRHYLLRSIINDHPTLRSLVLADAEGQGALSMGAEQLNDFREHQLSASPCSNRTQVPACNMKLKYAQYLELPGGLALQGATLLVTKPASDGHGNRKEVEAFVSSAFDGPLRFAAKALMKRRTYLLEMNGF

SEQ ID NO: 7449 - protein, 573 aa, Zea mays
MALSIIPSTSSGEHAAASASATATTTTKLGQLNAAVERSWVGRRFRLAARGTTFTTELRAGTATFLTMAYILAVNASILSDSGATCTVDDCDVPSPGCKFPPVDPGYAACVARVRRDLIVATAASSVIGSFIMGAFANLPIALAPGMGTNAYFAYTVVGFHGSGTLPYRTALAAVFLEGLIFLFISIVGLRSKLAQFIPTPVRISASAGIGLFLAFIGLQSNEGVGLVGFSSSTLVTLGACPASQRASVAPVLTFPNGTVALMPGGTVSGGILCLSGRMTSPTFWLAVVGFLIIAFCLIKRVKGALIYGILFVTFVSWPRHTAVTAFPDTPAGDDSFHYFKKVFDVHRIRSTAGALDFSGIGQGYFWEALFTFLYVDILDTTGSLYTMARFAGFVDDATGEFEGQYFAFMSDATAIVFGSLLGTSPVTAFIESSTGIREGGRTGLTALTAAIYFAAALFITPVLASIPSWAVGPPLVLVGVMMMRAVAEVDWDDMRQAVPAFLTLALMPLTYSIAYGLIGGIASYMLLHSWDWACQATRRLGCLKKGGGGADSTNGGVAEQSVEEQRKDMESA

SEQ ID NO: 7450 - protein, 402 aa, Zea mays
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSSKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFNEALDTTKTVIWNGPMGVFEFEKFAAGTEAIAKKLAELTTTKGVTTIIGGGDSVAAVEKAGLADKMSHISTGGGASLELLEGKTLPGVLALDDA

SEQ ID NO: 7451 - protein, 363 aa, Zea mays
  misc_feature (67)..(67): Xaa can be any naturally occurring amino acid
KSGWLEEPNASVSELTARRTRSPLLSSSSGSPSPHAIPTHYRLAFGYAYPAYECYKTVELNKPEIAXLIFWCQYWILVALLTVLERFGDFTISWLPFYSEAKLMFFVYLWYPKTKGTTYVYGTFFKPYISQHENEIDRNLLELRARATDTVVLYFQKAASAGQSTFFDVLKYVAAQSPSQKSRQRLHQESQQPPQQQQPQVQVQQAQPQKQAAPVMRRASSIAARQAAMAQQSQETKPVSSSPKIKRQTSARSGSVASTKPPVAASAPKPGGSPKKGEVKPAAGPVQTPTTGADSPKPEPSAPSLPGAEGVDNIAIDEASGDAPEGAEELDPALEEETPMEETIRVTRAKLRRRMTTEDPAGN

SEQ ID NO: 7452 - protein, 284 aa, Zea mays
  misc_feature (281)..(281): Xaa can be any naturally occurring amino acid
LGTSRPAGDKVQGIPQNEALVFSVQENFHGRTFAAITMSTDPESRENYGPYLPGIGSVCPVTGKPIRYNNVDDVRETLEKHGKNTAAFLVEPIQGEAGIVVPDDSYLREVRALCDKHNVLLICDEIQTGIARTGKMLCHEWSGIKPDLVLLGKAISGGMYPVSCVLGSKEVMLTIEPGTHGSTYGGNPLGSAVAIRALELIEEENMIERAETLGNKFRQGLQDINNPMIKTIRGKGLLNAIVIDESRTNGHSAWDLCMLFKEKGLLAKPTHQNIIRLCPPXIIT

SEQ ID NO: 7453 - protein, 344 aa, Zea mays
MDTQARPVPRVKLGTQGFEVSKLGFGCMGLTGAYNSPLDDEAGIAVIAHAFSRGVTLFDTSDVYGPLTNEILLGKALKQLPREQVQVATKFGIRRDESGTRTVCGRPEYVRACCEASLRRLGIDCIDLYYQHRIDTTIPIEETIGELKKLVEEGKVKYIGLSEASPDTIRRAHAVHPITAVQMEWSLWSRDIEPEIVPLCRELGIGIVPYSPLGRGFFGGRGVKEQVSAESNLHGIPRFAPENLEKNKQIYLRMEELANKHQCSPAQLALAWVLHQGDDVVPIPGTTKIKNLDSNIDSLKVKLTDEDLKEMGSQIREEDVAGGRQFTSYAHTTWKYADTPKKQS

SEQ ID NO: 7454 - protein, 194 aa, Zea mays
SIRAVSAPAKKDASEVKRSKVEIIKEKSNFLRYPLNEELVSEAPNINESAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPYVKKDILFAQQTAENIAALLTPQSGAYYDLWVDGEKIMS

SEQ ID NO: 7455 - protein, 147 aa, Zea mays
PASAPRPNMDSGPVATFQVHEYLRPKLCDLYENDSIFDKFECCLSGDGLHVATGSYSNLFRVFGCSPESVEASTLEASRNPMRRQVVDPARPARTLTGAVRRGGENTSVDASGNSCDLSTKLLHLAWHPTENSIACAAANSLYMYYA

SEQ ID NO: 7456 - protein, 138 aa, Zea mays
GAVYERRVTDLLLEDFLSYGPQKESCKVSKPLLRRAGDGRVLNWTTEDDDSLCTLQEAFQRVSPRLGFNIELKFDDSIMYHRKDLQCALKAVLQVVFEHARNRPVFFSSFHPDAAQMMRELQSLYPVIFETPVLCLKL

SEQ ID NO: 7457 - protein, 183 aa, Zea mays
CYRNDPETSKMLGTRMWPPEGEVYKTDIVAVGQGRPGSCNCLYPGSFLCRQLHTNEARDQLRSELGRVFTMWQFDSMGEEVSKLWSRDEQLKFDALEQLVPVMDQKTYWAVVSKNFASKPRIDLIKYYLNVFLMRRVLYQCRLGLLEIDSDEDDVEEEEDEDQPEGSSSLQRTQDAQDLKKVP

SEQ ID NO: 7458 - protein, 355 aa, Zea mays
MFVIHKYNSTTERMQKKKKKKKKKKKKKEVFKPKTMEPVRKSVCVTGAGGFVASELVKLLLSRGQYAVRGTVRDPGASKNAHLKVLEGAEERLQLLKADLMDYNSIASAVAGCEGVFHVASPVLSHRPSNPEVEVIAPAVIGTTNVLKACYEAKVRRVVVVSSCGAVYANPIYPKGKVFDEDCWSDEDYCRKKEDWYLVSKTLSEREALAFAAKTGLDVVTVCPSLVFGPLMQPTVNLSSEMILKYFTGDRETVENILRNMVDVRDVADALLLAYEKPEASGRYICSSHAIKVADMINILKTLYPSYPYPKNFVEDDVNSVYSSEKLQKLGWSFKPIEESLRDTVESYKAFGILN

SEQ ID NO: 7459 - protein, 320 aa, Zea mays
  misc_feature (20)..(20): Xaa can be any naturally occurring amino acid
  misc_feature (29)..(29): Xaa can be any naturally occurring amino acid
  misc_feature (49)..(49): Xaa can be any naturally occurring amino acid
MEAEAAAKRTRESGEDAAAXGISAVIPGXWFSEISPMWPGEAHSLKVEXKVLFQGKSDYQNVMVFQSSTYGKVLVLDGVIQVTERDECAYQEMITHLPLCSIKDPKKVLVIGGGDGGVLREVSRHSSVEQIDICEIDKMVVDVSKQFFPHLAVGFEDPRVSLHIGDGVAFLKNAPEGTYDAVIVDSSDPIGPAQELFEKPFFQLVARALRPGGVVCTQAESIWLHMHIIEDIVVNCRQVFKGSVNYAWTTVPTYPSGVIGFMLCSTEGPAVDFQHPVFNIEEDEHPMKSKGPLKFYNSEIHTASFCLPSFAKRVIESKAN

SEQ ID NO: 7460 - protein, 282 aa, Zea mays
MYNNYRNPPGTHMPPQNSQPVQFDNPLYGASSGLIRSGIGVYGEKFLGSSSEFMQSNINRYFSNPQYYFHVNDQYVRNKLKVILFPFFHRVVFPCNIVISSTSSQGHWTRISEPVGGRLSYKPPIYDINAPDLYIPFMAFGSFIILSGFTLGFMGKFTPEAINLQFTRALIGWGFQLTVLKGLLYSMGGGEVPLLDLVAYGGYLFAGLSLAVVARLMWAYSYYVMMPWMSLCMGVFLVRTMKRVLFTEMRSSERHSSRQHYFLLFMAIVQFPLFFWLGSIGV

SEQ ID NO: 7461 - protein, 196 aa, Zea mays
  misc_feature (47)..(47): Xaa can be any naturally occurring amino acid
  misc_feature (165)..(165): Xaa can be any naturally occurring amino acid
  misc_feature (177)..(177): Xaa can be any naturally occurring amino acid
PILSGSYNPGAGTATKRSGHSLGDADLKGKNVFALRRPLRLLVDRRXHKITDDTAIHAFDRTIKGLLENASKGILASHLRRAQGITPYYRLNPVVSRLTELLAAEVAIANDRIAEEVEKLAAVFSEGGVLLLDNGRFYKEEEKNEPECAKKLPSVDDLYVNDAFXGTLHRVHASTVXVTKRLKPAVDDSLMHQELD

SEQ ID NO: 7462 - protein, 153 aa, Zea mays
SFDPLNLTAMACPALPLCPLAQTEAERGILPILKRIRAVFNKVGIKDSESVVVRITGCPNGCARPYMAELGFVGDGPKSYQIWLGGTPNQSTLAESFMDKVKLDDIEKVLEPLFTYWNGTRQEGESFGSFTNRTGFDKLKEVVNKWAESPSAA

SEQ ID NO: 7463 - protein, 656 aa, Zea mays
  misc_feature (575)..(575): Xaa can be any naturally occurring amino acid
MPPSHAAMLRSPSSLRLLLHLSRRLLSRNPLLPSSALSARPRFLSSSSSSSPGGAGWATYDPLSDSLSASAALSSASISDSEPPAVSDAWGVYDPVLGRIVKQGSPPPSSSITVEEDDEEGEEAGKLEEEKAGVKEKGKRRVTAVGVNGHVRWSSVAAARRPAGKGGKERSSYVCSNCGEGDSQWWGKCRHCNAMGTVDKYVGVAGPESGGVDVEWSHHIGRSWMPQKAKEVVPQSLQEVNKGVDQAQWRIPLWGSFGMEISRVLGGGIVPGSLILVGGDPGVGKSSLMLQLASNILEGFKAKESSPVVYVSGEESIEQIGNRADRMSITSSNLYLYSGTDIEDILDKIQPLSPRALIIDSIQTVYVRSFAGSAGNLSQVKECTSALLRFAKLTNIPVFLIGHVTKTGDIAGPRLLEHIVDVVLYMEGERCSSHRLLRSVKNRFGSADELGVFEMAEFGLQAVLNPSQMFLTEHDSDSEIMAGLAVAVILDGSRTFALEVQALCVSGYHRSGQVVGIPQSRADVIISVLIKQAGLKLQDNIVFLNVVSGFKLTETAGDLAIAASICSRNLLFFLXSFLEFPIPNDVAFIGEVGLGGELRTVPRMDKRVIAISKLGYKKCVVPKTSEKLLRPLDIDIEILPCSNLKQLINTVFRPQG

SEQ ID NO: 7464 - protein, 388 aa, Zea mays
  misc_feature (156)..(156): Xaa can be any naturally occurring amino acid
ITQFTFVYSVCLLLAAYLMGVMLLEDLVDLSQSVTVLLTIVLIIFLLVPIVIPVLLSFFSDDDETLHALLLPSPRKEEPSASTSSEEQQEVILSEVEDEKPKDVDLLPASERQKRIAELQTRLFQAAADGAVRVKRRKGPRRGEDFTLMQALIKAXGFWLLFFSLLLGSGSGLTVIDNLGQMSQSLGYEETHIFVSMISIWNFLGRIGGGYFSEIIVKDYAYPRAIALAIAQVLMAIGHFNFAMAWPGTMYIGTLLVGVGYGAHWAIVPAAASELFGVKNFGALYNFLTVANPAGSLVFSGVIASGIYDSEAAKQAQQRHNSTSLAMSGRVAGMVSGAAPSLKCEGAVCFFLSSLIMSGFCIIAFGLSLILVYRTKIVYTSLYGKPRT

SEQ ID NO: 7465 - protein, 592 aa, Zea mays
PSSRSSALNTQIFSFQSFCPSCHCIANKGAILLPRRFLCIILHWHKCHRTWCVFSALRISTRPKRRTAFQVMGYCVCVAKGAAEILKLNMALILLPVCRNTLTTLRSTALSHVIPFDDNINFHKVIALSIAIATAIHTLAHVTCDFPRLISCPTDKFMATLGSNFHYKQPTYLGLLESTPGVTGILMIIIMSFSFTLATHSFRRSVVKLPSPLHHLAGFNAFWYAHHLLVLAYVLLVVHSYFIFLTREWYKKTTWMYLIVPVLFYACERVIRKFRENNYHAGIVRAAIYPGDVLSIHMKKPQGFKYKSGMYLFVKCPEVSPFEWHPFSITSAPGDDYLSVHIRTLGDWTSELRMLFGKACQAQVTSKKATLTRLETTVVADAQTEDTRFPKVYIDGPYGAPAQNYRKYDILLLIGLGIGATPFISILKDMLNNLKSNEEVGSIHGSEIGSFKNNGPGRAYFYWVTREQGSFEWFKGVMNEVAGSDHSNVIEMHNYLTSVYEEGDARSALIAMVQSLQRAKNGVDIVSGSKIRTHFARPNWRKVFCDLASAHKNSRIGVFYCGSPTLTKQLKDLSKEFSQTTTTRFHFHKENF

SEQ ID NO: 7466 - protein, 518 aa, Zea mays
REVDAEAVLLLARCCPLLGDVAFLDCGTVDEAALAGIHSVRFLSVAGCRNLKWATAPPRRPQLPSLIALDVSRTDVPPSAVSRLISHAKTLKLICTLNCISVEEEQLHNPAVFSNSKGKVVLTINSDIFKSFETMFPVVDVKAHASGVFHQCNWSHKDKIPGDTTTWLEWILSQSLLRIAESNPQGMDGFWLQKGTTLLLRLLKSLQEDVQERAATALATFVVMDDETANVDPARSEAVMQNGGIRMLLDLARCSRESAQSEAAKAIANLSVNTKVAKAVADEGGITILINLAKSMNRLVAEEAAGGLWNLSVGEDHKAAIAVSGGIKALVDLIFRWPAGTDGVLERAAGALANLAADDKCSLEVAKAGGVHALVTLARSCKLDGALEQAVIKKISGLANLAAHGDNNDNNAAPRLRAGALEALVQLTGSQNEGVRQEAAGALWNLSFDDRNREAIAAVGGVEALVALVQQCLNASEGLQERAAGALWGLSVSEANSIAIGQGGGVAPLLPGVGTLRG

SEQ ID NO: 7467 - protein, 339 aa, Zea mays
MAGGGATVCVTGAGGFIASWVVKLLLSRGYTVHGTVRHLSDEKTGHLKRLENAAGNLRVFKADLLDYDAMAAAVVGCQGVFHVATPVPSEDLTDPELQMLGPAVTGTTNVLKAASSANVQRVVVVSSMVAVEISPKDWPEGKVRDERCWSDREFCRSIESWYPVAKIISEEAALAYGQQTGLDVVTINPGLVFGPMLQPTVNTTIQFLIYFLKGGPDPVKNKLWHIVDVRDVADAMLLLYEVPEATGRHICAPHVISARDLLDLLKSMYPDYPCIANESILDRDHPAPMTSDKLKKIGWSCRPLEETIVDTVECCLRAGFLDDVGGETSCRFPPLLNQI

SEQ ID NO: 7468 - protein, 680 aa, Zea mays
  misc_feature (217)..(217): Xaa can be any naturally occurring amino acid
MARPLFLVYQLVSLCLRLTNLCSGDDQQFVYSGFTGTNLSTDGVAAITSDGMLELTNGTLQRKGHAFYPEPVRLREPANGTARSFSTSFVFGILSDHVELSAHGMAFVVAGSRDFSGALPSGYLGLLNVQSNGNSSNRLFAVELDTMQNDEFQDINDNHVGVDVNSLHSVQSYYAGYYGGGGFRNLTLISGEAMQVWVDYDAEVAQINVTMAPLSMXKPARPLVSARYNLSKVLTDDGPAFVGFSAATGGTLKSRHYVLGWSFSIDRPAPAIDLSNLPKLPRVSAKDRTRTLEIVLPVATAAFLLAAGMAILLLVRRHRRYAELHEDWELEFGPHRFSYKDLFHATDGFKNSNLLGIGGFGRVYKGVLPASRTEIAVKRVSHESKQGMKEFISEIVSLGRLQHRNLVQLLGYCRRKGELLLVYDYMPNGSLDKCLHDREGRQHALDWALRVQIIKGVASGLSYLHLDWEKVVIHRDIKASNVLLDGDMNGRLGDFGLARLYDHGGADGPKTTHVVGTIGYIAPELGRTGKASPLTDIFAFGIFVLEVACGRRPINKQLTQDGGALLLVDWVLSHWQNGSLTETVDIRFQGDYDSDEASMVLKLGLLCSHPFVDARPTSMRQVTQYLEGHVALPDFMPPCHILPSSMMIPEQSEGFLMYNNTSSQKFKASNGSMSSLSGGR

SEQ ID NO: 7469 - protein, 250 aa, Zea mays
MLVLINRYFRSRNSPAGGGDEMAPADRDHLCLPGCVPVRAKRAASTAAATVTTTARASRHNFVKAAASGLLAGAHFTNHESLPPLPDAYAEFVAAFPQYAHGALARADAIRGEEYQHLDRHVCLDYTGINLFSHAQMNSSLPSTSSAPPPSSAWQPPFFDIAYKSTSLRTQVQCGDAAAGGIGAAVTRRIMASLKIPEEEYAMVCTANRTTAFRLLAESYSFQPGKQLLPVYDYKSEAVGAMADSARRRA

SEQ ID NO: 7470 - protein, 330 aa, Zea mays
MMGGFLSRVLLLAFGYAYPAYECYKTVELNKPEIAQLIFWCQYWILVALLTVLERFGDFTISWLPFYSEAKLMFFVYLWYPKTKGTTYVYGTFFKPYISQHENEIDRNLLELRARATDTVVLYFQKAASAGQSTFFDVLKYVAAQSPSQKSTQRLHQESQQPPQQQQPQVQQAQPQKQAASVMRRASSIAARQAAMAQQSQETKPVSSSPKIKRQTSVRSGSVASIKPPVAASTPKPGGSPNKGEVKPAAGPVQTPTTGADSSKPEPSAPSLPGAEGVDKMAIDEASGDAPEGAEELDPALEEETPMEETIRVTRAKLRRRMATEDPAGN

SEQ ID NO: 7471 - protein, 257 aa, Zea mays
QSNLGNFQSAFIPFITAGDPDLVTTSKALKILNSCGSDVIEVGVPYSDPLADGPVIQASATRALKKGTTLDSVIEMLKGVTPELSCPIVLFTYYNPILKRGVGNFMSTIKQAGIHGLVVPDLPLEETALLRSEAIMHNIELVLLTTPTTPTDRMKGIAQASEGFLYLVSAVGVTGARSNVNLRVEHLLREIKKVTDKPVAVGFGVSTPEHVKQIVGWGADGVIVGSAIVKQLCEAATPEEGLERLEEYARSMKAAMP

SEQ ID NO: 7472 - protein, 161 aa, Zea mays
  misc_feature (140)..(140): Xaa can be any naturally occurring amino acid
RGEDLFSFFLSASTLRLASAASPASAVPLHPPRFRPNLCVRISRETVTAMAAAGGVSTDDVPILQAENLTSNVKSVYYSRTFLSIIGGVVAGIWGFTGLMGFVFYFLIMMVASIGLLAKSKFSVQAYFDSWTRISIEGVXFGGLMSFVLFWTFAYDIVHIF

SEQ ID NO: 7473 - protein, 142 aa, Zea mays
FRPNLCVRISRETVTAMAAAGGVSTDDVPILQAENLTSNVKSVYYSRTFLSIIGGVVAGIWGFTGLMGFVFYFLIMMVASIGLLAKSKFSVQAYFDSWTRISIEGVFGGLMSFVLFWTVGPFLLVLSLVLVWTFAYDIVHIF

SEQ ID NO: 7474 - protein, 230 aa, Zea mays
MAPSFTSLLSAANSAAAATASRLPSAAAGRASTFVRFPHHPTGWAGASVAAPRTARKRAPGVAYATAATEKSIYDYTVKDIDGKDVPLKKFKNKVLLIVNVASQCGLTTANYTELSHIYEKYKTQGFEILAFPCNQFGAQEPGSNTQIKQFACTRFKAEFPIFDKVDVNGPNTAPIYKFLKSSAGGFLGDLVKWNFEKFLVDKNGKVIERYPPTTSPFQIEKDIQKLLAA

SEQ ID NO: 7475 - protein, 399 aa, Zea mays
  misc_feature (363)..(363): Xaa can be any naturally occurring amino acid
  misc_feature (371)..(371): Xaa can be any naturally occurring amino acid
MASWDNLGELSNIAQLTGLDAVKLISLIVRAASTARLHKRNCRRFAQHLKLISGLLEQLRVSELRKYPETPEPLEQLEDALRRATGRSTTSASSRSSLVDNARIRDRLEYIERDCEYSFDEEDKKVQDALLNPDPCTNPTIVLKKTLPCSYPNLPFNEALRKESEKLQVELQRSQSNMDLGSCEVIQHLLGVTKTVESTIPEKETNVKAPEKKGSNYSESKGETAKSFDDDDDYPKKQNNEYPKKQKDTCSTQRCSSQVPYGHDLVSSRGSYSDEWHADLLGCCSEPALCLKTLFFPCGTFSRIASIAKDRPMTSGEACNDIMAYSLILSCCCYTCCVRRKLRQKLDIAGGCCDDFLSHLLCXCCALVQDXRGVEIRGAYSERPRLHHQHASIWSTEQL

SEQ ID NO: 7476 - protein, 233 aa, Zea mays
  misc_feature (174)..(174): Xaa can be any naturally occurring amino acid
MAPSFASLLSAANSAAAATASRLPSAAAGRASTFVRFPHHPTGWAGASVTAPRTARKRAPGVAYATAATEKSIYDYTVKDIDGKDVPLKKFKNKVLLIVNVASQCGLTTANYTELSHIYEKYKTQGFEILAFPCNQFGAQEPGSNTQIKQFACTRFKAEFPIFDKGDVNGPAGXIQSPIYKFLKSSAGGFLGDLVKWNFEKFLVDKNGKVIERYPPTTSPFQIEKDIQKLLAA

SEQ ID NO: 7477 - protein, 275 aa, Zea mays
MSEDPAGSRRWRCDLGGDERWLSGAAGDDQFDRLPDALLLVIFNRISDVKALGRCSLVSRRFHELVPLVDSVLVRVDCVIPDEPPSSSSSSSTPSSPTASVRARGVFSQIARIVLGGIVKPIQALGQILSPANSASGFPASAASSLSSSSSSSSPLPAGDVSHHSPSEVLRSFKELRHLRIELPAGELGMDDGVMLKWKADFGSTLGSCVILGASSASPSPSPSSAGSDSPSAAPSDDSGHTEPDECDDSGSIPESFYTNGGFKLRVVWSISSLI

SEQ ID NO: 7478 - protein, 511 aa, Zea mays
  misc_feature (55)..(55): Xaa can be any naturally occurring amino acid
  misc_feature (66)..(66): Xaa can be any naturally occurring amino acid
  misc_feature (108)..(108): Xaa can be any naturally occurring amino acid
  misc_feature (177)..(177): Xaa can be any naturally occurring amino acid
  misc_feature (431)..(431): Xaa can be any naturally occurring amino acid
  misc_feature (500)..(500): Xaa can be any naturally occurring amino acid
MMASQAMVPLRQLFVDGEWRPLALGRRLPVVNPTTEAHIGEIPAGTTEDVDPAVXASSRAALKRNXRGRDWARAPGAVRARDLRAIVAKGIERKQELAKLEALDCGKXYDEAAWDMDDVAGCFEYFADQAEALDKRQNSPVSLPMETFKCHLRREPIGVVGLITPWNYPLLMATWKXVAPALAAGCTAVLKPSELASVTCLELADICKEVGLPSGVLNIVTGLGPDAGAPLSAHPDVDKVAFTGSIETGKKIMASAAPMVKPVTLELGGKSPIVVFDDVDIDKAVEWTLFGCFWTNGQICSATSRLLIHTKIAKKFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTQYGLAGAXVISGDRERCQRLSEEIDAGCIWVNCSQPCFCQAPWGGNKRSGFGRELGEGGIDNYLSVKQVTEYISDEXPWGWYQSPSKL

SEQ ID NO: 7479 - protein, 288 aa, Zea mays
MANRGAAAGKLTVAETFSNLREQGKSAFIPFITAGDPDLATTSKALKILNSCGSDVIEVGVPYSDPLADGPVIQASATRALKKGTTLDSVIEMLKGVTPELSCPIVLFTYYNPILKRGVGNFMSFIKQAGIHGLVVPDLPLEETALLRSEAIMHNIELVLLTTPTTPTDRMKGIAQASEGFLYLVSAVGVTGARSNVNLRVEHLLREIKKVYFLVSMTCGASGIQMVIFLALQVTDKPVAVGFGVSTPEHVKQIVGWGADGVIVGSAIVRQLCEAATPEEGLERLEEY

SEQ ID NO: 7480 - protein, 178 aa, Zea mays
MASSMISSPAVTTVNRAGAGMVAPFTGLKSMAGFPTRKTNNDITSIASNGGRVQCMQVWPPIGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 7481 - protein, 502 aa, Zea mays
MATANGSSKGSFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGVVGHIVPWNYPTTMFFFKVGPALAAGCAVVVKPAEQTPLSALFYAHLAREAGVPAGVLNVVPGFGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 7482 - protein, 503 aa, Zea mays
MLMSHSQQMANSRKPPGLRLLGGAGSLRTYQTLVLVLTFLAYTCFHMTRKIPSIVKSALDPQTKVGFSHWGRLHASRNALTTGWLPFNTADGSALLGEIDVAFLAAYSVGMFFAGHIGDRMDLRVFLTVGMAGTAVFTTLFGAGYWLNVHSFYYFLVIQMVSGLFQSVGWPSVVAVVGNWFGKSKRGLIMGIWNAHTSVGNIAGSLLAAFLLKFGWGWSFAVPSLIMALVGLMVYVFLPVSPEAMEIDSDGGELNCEKDAVKEPLLEPGQEVRHSAVGFLEAWRIPGVAPFALCLFFSKLVAYTFLYWLPFYISHTRIGGEYLSDATAGSLSTIFDVGGVLGGVLAGHISDRLNARAITAASFTYCAIPALFLYRTYGSMSMAWNVSLMFVTGMFVNGPYALITTAVSADLGTHSSLNGNSRALATVTAIIDGTGSVGAAIGPLVTGYVSSRSWSAVFTMLMAAALLAGLLLSKLVCAELQGKTHSSVSKDAGGEHGAYSDEV

SEQ ID NO: 7483 - protein, 196 aa, Zea mays
MTKIVGTLGPKSRSVDTISACLKAGMSVARFDFSWGDAAYHQETLENLKLSIKSTKKLCAVMLDTVGPELQVVNKSETPISLEENGTVVLTPHRGQDASSSLLPINFSGLAKAVTPGATILVGQYLFTGSETTSVWLEVSEVKGDDVVCIIKNTATLAGSLFTLHCSQIHIDLPTLSDEDKDVRNYSRNCDLYILV

SEQ ID NO: 7484 - protein, 259 aa, Zea mays
MASLQSFLAVKPTTAARRELSAASLAVVDGEARYLVSTYKRSRVVFEHGRGCKLYDTDGREYLDMAAGIAVTALGHADPDVCATIAEQAGKVVHVSNVFYTKPQVELAKRLVEVSFADRAFFASTGTEANEAAIKFSRKFQRAAHPESGDPPTEFLAFSSSFHGRTMGAVALTSKSQYREPFAPVMPGVTFVDYGDLEAAKKFVRSGRVAAVFVEPVQGEGGIHSATREFLQGLRDACDEAGALLVFDEVRCCINLSAI

SEQ ID NO: 7485 - protein, 69 aa, Zea mays
PGVKKVVTKPVVVGFGISNPEPVKQIAPWGPSGVILGSPMVRHLGETAFSKQGLRRLEEFSRGMKNALP

SEQ ID NO: 7486 - protein, 98 aa, Zea mays
SDDKKGSSSGSEGSIWPKFEITLSNREKEEDFLVFKGSKLPQRPKKKAKVIQRTVNFVCPGTWLCDLTLERYEVREKKVSKKRPRGLKAMHDMDSDSE

SEQ ID NO: 7487 - protein, 130 aa, Zea mays
  misc_feature (128)..(128): Xaa can be any naturally occurring amino acid
MEVPMNTTQSGPHFPVQHRSLSLDIKGNKTDIVINKYEDTFLVIVTQIGCMGTILAAKKDESVFSDPTYNVSVLFGKRDEPLLLACARQLIEHISGSGSARSLVISLGLKDHSQGTLKDITVAVIDNXLW

SEQ ID NO: 7488 - protein, 153 aa, Zea mays
  misc_feature (126)..(126): Xaa can be any naturally occurring amino acid
METADYSGKLFVGGISWETDEDRLREYFGRFGEVTEAVIMRDRSTGRARGFGFVVFADATVAERVTIEKHMIDGRMVEAKKARPRDDHSIVSKSNTSSIGSPGPGRTRKIFVGGLPSNVTEADFRXYFEQSGVITDAGGVCPSTETRALDHHH

SEQ ID NO: 7489 - protein, 310 aa, Zea mays
MDGGGGGVGGGGVGAGVMVGGGVGPGGGVGVGVGGDVELVSKTLQFEHKLFYFDLKENPRGRYLKISEKTSATRSTIIVPVDGVAWFLDLFDYYIRTDERDAFSKELRLQTKVFYFDIGENKRGRFLKVSEASVNRNRSTIIVPAGSSGEEGWEAFRSVLLEINNEATRLYVLPNHPNQQHMEPPERLPGLSDDVGAGFIAGHGSQSASGPEVDVERLVDLPPQEEISGMGMSKVIRADQKRFFFDLGSNNRGHYLRISEVAGADRSSIILPLSGLKQFHEMVGHFVDIMKDRLEGMTGANVRTVEPSQR

SEQ ID NO: 7490 - protein, 186 aa, Zea mays
MERERLTAEMAFRGADEARREGGDPAPSIVIKIRRRLPDFARNIKLKYVKLGIRHGGSPTSLLPALCVPAVAAAAYSFVRLDVIYYSVDLLSVMVGGGVGPGGGVGGGGDVELVSKTLQFEHKLFYFDLKENPRGRYLKISEKTSATRSTIIVPVDGVAWFLDLFDYYIRTDERDAFSKELRLQTK

SEQ ID NO: 7491 - protein, 204 aa, Zea mays
MATLSSCSRLSSGTGAAAIRRQPKPTLLLDVNARLLIDLQTPSRVSVSLPTWAEFELGRAPVYWKTSNGLPSSPGEGLTLFYNPAASKMAPNDVFGVAFNGGFNQPIMCGGEPRQMTLQVRGKADPPIYTIRIRVPQHATSLIFSFTNGAEWDGPYTLKFRVPKPWQKKPLSFFNEGLADELNREGACDLAIYPDENIAITRGT

SEQ ID NO: 7492 - protein, 117 aa, Zea mays
RRARWPPLESTPAVFNQFVWSLGVPEDDVEFHDVYGLDADALDMVPQPVLAVVLCFPDPPQDASYPSEQLLISGEKDQVYFIKQIESLGNACGTIALLHAVGNASSKINLVENSCLD

SEQ ID NO: 7493 - protein, 234 aa, Zea mays
MTAAATMTWHEDLATLVGDTGVRLPGAGGHAPAPANVAAAGAGWYGEEEEVRAEEGWAQQAKGFAESTAEMLRELGRGLWDVAAQSLAGAEDSEVARRLRKRAAATGKRLSFMNEYLPEERDPVRCWLTVAAVAFVSLLVLGFGSGNETPVELPKKLIIGPPSADRIQLPDGRHLAYQEQGVSANRARFSLIYPHSFLSSRLAGIPGISASLLEEFGVRLVTYDLPGFGESHPH

SEQ ID NO: 7494 - protein, 378 aa, Zea mays
MATLNPFELLGADDNDDPTQLIAAAAAAAQKAEAKKSAVAPAGKAAQPAATTKFPTKPAPPSQTVRDARGGGSSARGGFGRGERGRGRGGRGYGQNRGFSGDNGSDFQGGYGGGGYGDGAVTGGSEGERERDTRPPYRGGGRRGGYRNVEFADDSERPPRRNYERHSGTGHGYEMKRDGAGRGNWGTATDELIAQDAEDSPKMEEAAPVAEKQGEQNDAPAADENKDNKDATANEEEEKEEDKEMTLEEFEKIREEKRKALLALKAEERKVEVDKDLQSLQPLSNKKENDEVFIKLGSDKDKKKENAERDERAKKSVSINEFLKPAEGERYYGGRGRGRGRGDRGGFRGGYGGGYSRGPAAAAPSIEDQAQFPSLGGK

SEQ ID NO: 7495 - protein, 109 aa, Zea mays
MDVLLGSGRFLARRPPLALVPRCSRGSPDKSGSDKGETSADWDKAWSAFKKKGKRTLFSDFSPDKYVTWNPRRSEYPLSEEVDPIKRTERSNLMLWTSPQFTLVGAIII

SEQ ID NO: 7496 - protein, 263 aa, Zea mays
TRGGSDEWTPPPEYETRDRSRRKNNTDEIFKQAKKKGAKQGPFEARPRSSSRNFTGTGRLLTGETVERNASQPPEEITHNIHFWRNGFTVNDGPLRSFDDPANAPFLKSIKDSDCPTELVPADEKSIVNVNLVRTEEEFTEPVKRAAPFEGERRNLMEPSDNNTSNAAAAAAASSSATASRTITVDDSLPSTSLQIRFADGSRLVARFNTSHRISDVRAFIDATRPGASDYTLQAGFPPKPLEDTAKTIEEAGVANSVIIQSV

SEQ ID NO: 7497 - protein, 441 aa, Zea mays
MNRVLACASSLLTCREVLQEQVSSTRSRLGMFVIEDKGGAIALMLASLLFLGTWPAVLTLLERRGRLPQHTYLDYSITNLLAAVLIALTFGQLGDSRRGMPNFFTQLGQDNWPSVLFAMAGGVVLSVGNLSTQYAWAYVGLSVTEVISSSMVVVIGTTLNYFLDNRINRAEILFPGVACFLVAVILGSAVHSSNAADNEQKLGASTNAYKLGTSGTVEPSKQAVDRDAPKDLEESGASGIRQPDKAEAGTAEYLIELEERRSIKVFGSNTFIGLGIVFFAGVCFSLFSPAFNLATNDQWHTLRDGVPHLVVYTAFFYFSISCFVVGVGLNVLFLYRPMAGVPRSSFGAYLRDWDGRQWALLAGLLCGFGNGFQFMGGQAAGYAAADAVQALPLVSTFWGVLLFGEYRKSSRKTYVLLGFMLFMFVAAVAVLMASSGHRSTE

SEQ ID NO: 7498 - protein, 247 aa, Zea mays
MATLSSCSRLSSGTGAAAIRRQPKPTRAGVLFTSRRGSSASIRASAAAAAPAAVEQQNTGVSVSLPTWAEFELGRAPVYWKTSNGLPSSPGEGLTLFYNPAASKMAPNDVFGVAFNGGFNQPIMCGGEPRQMTLQVRGKADPPIYTIRIRVPQHATSLIFSFTNGAEWDGPYTLKFRVPKPWQKKPLSFFNEGLADELNREGACDLAIYPDENIPITSCAMDGYLEEGGGSVPASSRKRMNKASVRS

SEQ ID NO: 7499 - protein, 694 aa, Zea mays
MGHTSSGNEVPLKYSSGKAFPLGVSQVDDGLNFAIFSQHASSVTLCLNFPERGNQDDVDIVEFALDRQRNKTGDIWHVSVEGLPASGVLYGYRINGPQGWQQGHRFDDSVILLDPYAKLVYGRKHFAVEKEKPSQLFGTYDFDSSPFDWGDNYKLPNLPETDLVIYEMNVRAFTADESSRLAPAIRGSYLGVIDKIPHLLELGVNAVELLPVFEFDELELKRFPNPRDHMVNTWGYSTINLFAPMSRYASAGGGPVAASKELKQMVKAFHNSGIEVILDVVYNHTNEADDVNPYMTSFRGIDNKVYYMLDLNNSAQLLNFSGCGNTLNCNHPVVKELVLDSLRHWVKEYHIDGFRFDLASVLCRGPDGSPLDAPPLIKEIAKDSVLSRCKIIAEPWDCGGLYLVGRFPNWDRWAEWNGKYRDDIRRFIKGDPGMKGVFATRVSGSADLYQVNNRKPYHSVNFVIAHDGFTLCDLVSYNSKHNDANGEGGRDGCNDNYSWNCGIEGETNDLNVLSLRSRQMKNFHVALMISQGTPMMLMGDEYGHTRYGNNNSYGHDTHINNFQWGQLEERKDGHFRFFSEMIKFRHNHPILRRDRFLNKNDVTWHENRWENQDSKFLAFTIHDHSSGGDIYLAFNAHEYFVDAVIPPPPHHKSWSRVVDTNLESPKDIVPEGVPFTGSGYRIAPYSSILLKAKP

SEQ ID NO: 7500 - protein, 379 aa, Zea mays
  misc_feature (349)..(349): Xaa can be any naturally occurring amino acid
  misc_feature (369)..(369): Xaa can be any naturally occurring amino acid
KDVALNFLRKSLNKLENPNDVLALLLAAKICSKERHLASEGVEYARRVIACAESSDPHLKSVGLHFLGSCLGNKSKVVSSDYQRSLLQTETLKSLAESIGLNRYNADLIFDMGVEYAEQRNMNAALRCAKEFIEATGGSVSKGWRLLALILSAQQRFSEAEVATDAALDETAKLDQGSLLRVKAKLKVAQSSPMEAVEAYRALLALVQAQKNSPGGSCKSATEDADGSVSEFEIWQGLANLYSSLSYWRDAEICLNKARALKLYSAATLHAEGYMHEARDQTTDALAAYVNAFSTELEHVPSKVAIGAMLSKQGPRFLPAARCFLSDALRVEPTNRMARLYLGQVHRSXDGRISDAADCFQAAVMLEDXDPVESLSSLL

SEQ ID NO: 7501 - protein, 257 aa, Zea mays
  misc_feature (180)..(180): Xaa can be any naturally occurring amino acid
MATPSSSLCSSFASLRTASIGHPRGIASSTPRKAFHVRASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQIKSLGAKAGVVLNPATPLTAIDYVLDXFIESQVKKIAELRRLCAEKGVNPWIEVDGGVGPKNAYKVIEAGANAIVAGSAVFGAPDYAEAIKGIKTSQRPLAVAA

SEQ ID NO: 7502 - protein, 428 aa, Zea mays
  misc_feature (386)..(386): Xaa can be any naturally occurring amino acid
MSYHCRVLVPVPFHYPPGAGARVGAGAGSPFPSASRALRLPRPRASVEKREQVAAMEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFVGSCRSCDSCGKGDDNYCAGIVLTSNGVDHAHGGAPTRGGFSDVLVASEHYVVRVPDGLALDRTAPLLCAGVTVYSPMMRHGLNEPGKHLGVVGLGGLGHVAVKFGKAFGMKVTVISTSASKRQEAIENLGADEFLISRDEDQMKAATGTMDGIIDTVSAWHPITPLLALLKPLGQMVVVGAPSKPLELPAYAIVPGGKGVAGNNVGSVRDCQAMLEFAGKHGIGAEVEVIKMDYXQHGHGAAREERRPLPLRHRRRRQPRLCRLGMAAKVSIRAQPQ

SEQ ID NO: 7503 - protein, 388 aa, Zea mays
WYPANLEDSSLHGLQAYRVFISIALILGDGLYNFIKVLIRTIAGFISMVQQNSKSMLPVSDNGSSMSSMEAVSFDDERRIENFLKDQIPKSVAYGGYVAVAAISIGTLPQIFPQLKWYYILVAYVVAPVLAFCNAYGSGLTDWSLASTYGKLAIFVFGAWAGLSHGGVLVGLAACGVMMSIVSTASDLMQDFKTGYLTLASPRSMFISQVIGTGMGCVIGPCIFWLFYKAFGDIGESGTEYPAPYAIVYRNMAILGVDGFGSLPKNCLTLCYIFFAAAITINLVRDLTPYKVSRFIPLPMAMAIPFYIGSYFAIDMFLGSAILFVWERLNKAKADAFGPAVASGLICGDGIWTLPQSILALAKVQPPICMKFLSRSTNAKVDSFLGLS

SEQ ID NO: 7504 - protein, 242 aa, Zea mays
  misc_feature (133)..(133): Xaa can be any naturally occurring amino acid
  misc_feature (200)..(200): Xaa can be any naturally occurring amino acid
MAANLEDVPSLDLMHELLRRMKCSSKPDKRLIVIGPPGSGKGTQSPIIKDEYCLCHLATGDMLRAAVAAKTPLGIKAKEAMDKGELVSDDMVVGIIDEAMKKPSCQKGFILDGFPRTVTQAQKLDEMLAKQGXNVDKVLNFAIDDAILEERITGRWIHSASGRTYHSKFAPPKSPGVDDVTGEPLIQRRDDTAEILKSRXLEAFHRQTEPVIEYYSKRGLVVNLPAEKPPKEVTAEVLKALS

SEQ ID NO: 7505 - protein, 241 aa, Zea mays
LRKLFTRPGDSRPGYLAFLLGRTVVALAIQFPHLNRHSAARQLHCRRRWRSLRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMGVSGGEEGARNGPSLMPGGSFEAYKYYVEDIVLKVAAQVPDSGPCVTYIGKGGSGNFVKMGHNGI

SEQ ID NO: 7506 - protein, 174 aa, Zea mays
  misc_feature (73)..(73): Xaa can be any naturally occurring amino acid
  misc_feature (156)..(156): Xaa can be any naturally occurring amino acid
  misc_feature (165)..(165): Xaa can be any naturally occurring amino acid
MALTRIGLAGLAVMGQKLALNIAEKGFPISVYNRTTSKVDETVQRAKAEGNLPVYGFHDPASFVKSIQKPRVXIMLVKDGAPVDQTIATLAAHLEQGDCIIDGGNEWYNNTERRENVMKERGLLYLGMGVSGGEEGARNEPSLMPGGSIEAYKYVXDIDLKEDAXVPDRGPCVT

SEQ ID NO: 7507 - protein, 217 aa, Zea mays
  misc_feature (112)..(112): Xaa can be any naturally occurring amino acid
MATAVRALVAARPARPLLPSRRLPSSSSIRPARQRAGVGCVRCMARRPDSSYSPLRSGQGGDRAPTEMAPLFPGCDYEHWLIVMDKPGGEGATKQQMIDCYIQTLAQVVGEXSEEEAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQSYQR

SEQ ID NO: 7508 - protein, 300 aa, Zea mays
  misc_feature (278)..(278): Xaa can be any naturally occurring amino acid
  misc_feature (293)..(293): Xaa can be any naturally occurring amino acid
HWVPRKTKGYIRFATPTPRCHTPARRWYIIIVKKKRSCFWDGCIYAGTLLPAATTGWKEGGVVVKPGRCGWLVQRRQAAVRAMSAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAASIISTEQGEELRKQIGAVAYIECSSKTQRNVKAVFDTAIKVVLQPPRRREVTRNXMKARSNQSLRRYLCXGSGCFTS

SEQ ID NO: 7509 - protein, 493 aa, Zea mays
  misc_feature (77)..(77): Xaa can be any naturally occurring amino acid
  misc_feature (188)..(188): Xaa can be any naturally occurring amino acid
  misc_feature (220)..(220): Xaa can be any naturally occurring amino acid
  misc_feature (236)..(236): Xaa can be any naturally occurring amino acid
TLGLSGPTFPAPFPTASPPPTRPRAHGPQPKPANPSSTFALYSHALKVALGADQSRLALLGVACDVGENLGLLPGAXNRLHPALLLIIGAGACLLGYGTAWLLVSGVAPALPYWLIWFGLCLATNGGAWLATAVLVTNMRNFPLSRGAVAGILKGYSGLSAAVYTEIYTGVLRDSPINLLLSLALGIXAVCLLAMYFVQPCEPSLVETNAEQVHFMFAQXASVLLGVYLVGAILPXMIIDVLLAEGEGKPKRRRRRGEDFRFREAILKADFWLLFAICFVGIGSGITVLNNLAQIGIAAGAVDTTISLSVFSFCNFFGRLGGGAVSEYLVRSRTLPRSVLVICTQVVMIITYLLFALGRLATLYVSVALLGLCYGVLLSVVISTSSELFGLKHFGKIYNFITLANPVGAYLFNTLAGYVYDLEVERQHAAAAAAGSDVVACHGPSCFRLTFCVLAGAACLGTLLSTVLTVRVRPVYQMLYAGGSFSQPRNSAH

SEQ ID NO: 7510 - protein, 184 aa, Zea mays
HWDPRGRPGLTSEHSTSVREEVCRIRNEHPGDPSAISKDRVKGSLKVTRAFGAGFLKQPKWNDALLEVFRIDYVGSSPYITCNPSLYHHRLSTRDRFLILSSDGLYQYFTNEEAVAQVEMFIATTPEGDPAQHLVEEVLFRAANKAGMDFHELIEIPHGDRRRYHDDVSVIVISLEGRIWRSCV

SEQ ID NO: 7511 - protein, 530 aa, Zea mays
MALEAAYDYLHVAVVQCTPTQAAAVLGVLLLLAIRLAAAARSSSATSPKWKQHRLPPTPPGKLPIIGHLHLIGSHPHVSFRDLHAKYGHNGLMLVQVGAVPTIVVSTPQAAEAVLRTHDHVLASRPRNPVADIIRYNCTDVAFAPYGEYWRTARKVVNTHLLSAKMVFSKRREREEEVRLVVARIRDAAEASPGTALDMTELLGGYASDFVCRAVLGESHRKQGRNKLFRELTETSAALLGGFNVEDYFPKLADVDLFLRIICAKAKGVSKRWDSLFNELLSEYALSGGKQGDHNSEDFVHLLLSLQKDYGLTTDNIKGILVNMFEAAIETSFLVLEYSMSELMNNRHVLAKLQKEVRTATPDGRMVMEEDLSRMPYLKATIKESMRIHPPAPFLLPHFSTHDCEINGYTIPAGTRVIVNAWALARDPTCWDKAEEFFPERFLEQGRDAEVDMYGKDIRFVPFGAGRRICAGATFAIATVEIMLANLIYHFDWEMPAEMERTGAKVDMSDQFGMTLRRTQKLYLVPRIPK

SEQ ID NO: 7512 - protein, 595 aa, Zea mays
MAAMNGEVLGECGRNINSLKRKRESPAAYAAGVFCTSELHQHTVNDSAVRFHLDKDRKAKIVCHFNKQVLQSYKKFMSSAPPKRILLRQGAVWKDFPEKIVKLAQADFRAKKMITETGYQNQLFLLDFAHMTFIDTKTGFQRPIAWIDENEKCYFPESFIQDQKLFMKKDFGNGNHEYISEERNGTRETNHQFGASESSAESSNFESSIGDVSSPKRARAEKNFIVKKYCDMGEAIGENEPCTLLPTACNLLPHQANLGEVSRAQRTIEAVEKLLLQGMGSVIESKDIIGIYRTPLLDDHGQVRYHIHQKQVQVTGCHRGNANVRYAWLPCSKSTVHVMMLNGVLQVDKPPNKCAAYGEGTLLTPANRSDACVKYSDVDENGIVRMMLCRVIMGNVEIVHPGSKQCQPSNKYFDSGVDDLKNPRHYVVWDMNLNSHIYSEFVVTVKLPSKTKDSFVSQENCQNSSDLSLVLNSSSPDCISQEMNLEAPPALGGGCAAPMLGDSMEKAPSSPWMPFSMLFAAISTKVSPENMDVIIGCYEEFKSKKISRGELVKKLRHVVGDRVLISTIMRLQDKLPPVDKREEPDTSASKVVAEP

SEQ ID NO: 7513 - protein, 355 aa, Zea mays
  misc_feature (278)..(278): Xaa can be any naturally occurring amino acid
MHPKARIHADPVREVDHFDCLPDSLVLLILNKVEDVRSLGRCYAVSKRLCGLVPLVHDVYVKIDRVVAVDGDAEDALNLSSPKPRNIFSHFLKLMLFTIIKPFHNMRNPNGTGRSLFPQLSHHSPAQVLRNFTHIRNLRIELPSGDVGTEEGVLLKWRAEYGSTLQSCVILGGTRVDRKPVGGEHEQSLEDNGSMPESFYTNGGLKLRVVWTISSLIAASTRHYLLRSIINDHSTLLSLVLTDADGQGTLCMGAEQLKEFRENQLSASACSNRTQVPXACNMKLKYAPYLELPGGMALQGATLVAIKPSPDGSNGSHPNRKEADAFVFGAFDGPFKAAVKALMKRRTYLLEMNGF

SEQ ID NO: 7514 - protein, 168 aa, Zea mays
MEYGQQGQRGHGATGHVDQYGNPVGGVEHGTGGMRHGTGTTGGMGQLGEHGGAGMGGGQFQPAREEHKTGGILHRSGSSSSSSSEDDGMGGRRKKGIKEKIKEKLPGGHKDDQHATATTGGAYGQQGHTGSAYGQQGHTGGAYATGTEGTGEKKGIMDKIKEKLPGQH

SEQ ID NO: 7515 - protein, 50 aa, Zea mays
SIYLVYVAAYRKRKSDDYILEFDDDKEDGALPQRAVPFYRVVALPEGHRQ

SEQ ID NO: 7516 - protein, 584 aa, Zea mays
MTLLDLSKRTGAYISTLQGILADLGEKVESEFDSISIDLAELVTMELGVNSRRMHTGEGKNEPRPAVVTVMGHVDHGKTSLLDALRQTSVAAKEAGGITQHIGAFVVEMSSGASITFLDTPGHAAFSAMRARGAAVTDIVVLVVAADDGIMPQTLEAMSHAKAANVPIVVAINKCDKSGADPERVRIQLGSEGLLLEDMGGDVQVVEISAVTKSGLDKLEEALLLQAEMMDLKARIDGPAQAFVVEARVDRGRGPLATAIVKYGTLVSGQHIVVGAEWGRIRSLRDTAGNITQSAKPAMPIEIEGLKGLPMAGDDVVVVDSEERARMLSHGRKKKQEKDRLPKIDEGMAEELEIKEETPERVEMTIIVKADVQGSVQAVTDALRSLNSAQVFVNVVHVGVGPISQHDIDLAQACGAYIVGFNIRSPPSPITQAAARANIKVLLHKVIYHLLEEMGKAIVEKAPGTAETQVSGEAEVLNIFELKGRSKSKGPDVKIAGCRITDGHFSKSGTMRLLRSGDVVFEGPCESLKREKKDAETVEKGNDCGLVIQDCDDFQVGDIIQCVEQVIRKPKFISTQSGSVRIEC

SEQ ID NO: 7517 - protein, 263 aa, Zea mays
  misc_feature (237)..(237): Xaa can be any naturally occurring amino acid
  misc_feature (253)..(253): Xaa can be any naturally occurring amino acid
  misc_feature (255)..(255): Xaa can be any naturally occurring amino acid
MSGGTAASGSLRTAFSYCVQQVRSYDYHNYLCLLHLPPAMRKAAFTFRAFNVETAKAMDVVSDPRKGLMRLLWWKDVVDKVCAGKKVEHPVALALSSVLSEQKVSKHWLKRSLEARINDGNRDEDAIPENVPELERYAEDTQSTILYMTLQAGGIQSTVADHAASHIGKASGLLLLLKALPHHVSKQGKIPYIPASVAEECGLLAREGGRTEVRMGDALPDAVFKVASVAEAHLQKXRELAALCPAEAVPVLXPXVPAPGLLD

SEQ ID NO: 7518 - protein, 122 aa, Zea mays
MAPFTPRGGARGGRGGARGGGRGGFGGDRGGFGGGRGGARGGRGGGRGGFGDRGGRGGRGGRGGAPRGGRGGAAGAKGGAKVIVEPHRHPGVFVVRGGKEDGLATRNTTPGESVYGEKRISV

SEQ ID NO: 7519 - protein, 389 aa, Zea mays
MDGGAGEEGKQERHLVLAHKLFLLSHPSVDDLSKVALRAEVLDTVKSDDMATLFESLVAAGVLEGDAALLAEMRGRIDEEIRKLDEKIADAEENLGESEVREAHLAKSLYFIRVGEKEKALEQLKVTEGKTVAVGQKMDLVFHTLQIGFFYMDFDLISKSIDKAKNLFEEGGDWERKNRLKVYEGLYCMATRNFKKAASLFLDSISTFTTYEIFPYDTFIFYTVLTSVITLDRVSLKQKVVDAPEILAVIGKVPHLSEFLNSLYNCQYKSFFVAFSGLTEQIKLDRYLQPHFRYYMREVRTVVYSQFLESYKSVTMEAMATAFGVTVDFIDQELSRFIAAGKLHCKIDKVAGVLETNRPDERNAFYQATIKQGDFLLNRIQKLSRVIDL

SEQ ID NO: 7520 - protein, 170 aa, Zea mays
PASAPRPPTRPPTRPPTRPPTRPAPEILAVIGKVPHLSEFLNSLYNCQYKSFFVAFSGLTEQIKLDRYLQPHFRYYMREVRTVVYSQFLESYKSVTMEAMATAFGVTVDFIDQELSRFIAAGKLHCKIDKVAGVLETNRPDERNAFYQATIKQGDFLLNRIQKLSRVIDL

SEQ ID NO: 7521 - protein, 224 aa, Zea mays
SLFEEGGDWERKNRLKVYEGLYCMATRNFKKAASLFLDSISTFTTYEIFPYDTFIFYTVLTSVITLDRVSLKQKVVDAPEILAVIGKVPHLSEFLNSLYNCQYKSFFVAFSGLTEQIKLDRYLQPHFRYYMREVRTVVYSQFLESYKSVTMEAMATAFGVTVDFIDQELSRFIAAGKLHCKIDKVAGVLETNRPDERNAFYQATIKQGDFLLNRIQKLSRVIDL

SEQ ID NO: 7522 - protein, 173 aa, Zea mays
  misc_feature (10)..(10): Xaa can be any naturally occurring amino acid
  misc_feature (121)..(121): Xaa can be any naturally occurring amino acid
  misc_feature (132)..(132): Xaa can be any naturally occurring amino acid
  misc_feature (135)..(136): Xaa can be any naturally occurring amino acid
  misc_feature (149)..(150): Xaa can be any naturally occurring amino acid
  misc_feature (152)..(153): Xaa can be any naturally occurring amino acid
LRPPSGYGIXDVHDIVYNPSYDLLYQEELDPSLTGYERGVLTNLGAVAVDTGIFTGRSPKDKYIVRDDTTRDTFWWADKGKGKNDNKPLSPETWQHLKGLVTRQLSGKRLFVVDAFCGANXDTRLSVRFITXVAXXAFVKNMFIRPSDXXLXXFKPDLSYAIDYRLRGLTRGT

SEQ ID NO: 7523 - protein, 169 aa, Zea mays
  misc_feature (134)..(134): Xaa can be any naturally occurring amino acid
MAALPLATAEVCDANPHLIMNGELRALQPIFQIYGRRQVFAGPIVTLKVYEDNVLVREFLEEKGHGRVLVVDGGGSMRCAILGGNPVQQAQNNGWAGILVNGCIRDVDEINGCDIGVRALSSHPMKANKKGMGXEKHVPVNIAGTRICDGEWLYADPDGIRVSRTELTV

SEQ ID NO: 7524 - protein, 209 aa, Zea mays
MQGGNHMLLEEPVRLASVLAPAKPKVFPSLTKIVGTLGPNSHSVEVIEECLTAGMSVARFDFSWKDATYHQETLDNLRKAAQNVKKLCPIMLDTVGPEIQVHNSTGGAIELIGGNHVTITPDLSKAPSADILPIKFGDLAKVVKKGDTLFIGQYLFTGSETTSLWLEVTETSGAEVICYVKNTATLSGPHFTLHVSPVHISMPTLSEYD

SEQ ID NO: 7525 - protein, 199 aa, Zea mays
  misc_feature (89)..(89): Xaa can be any naturally occurring amino acid
LPGRWRLLYCTGRHIGLTLRQPSPRVLISAVYLTVSSESVDQVFSLTSDVGFRIMPEPNWPHDKSGSEGVLSVTASARIAAGRIYINEXASKEDMVTSSMRYLHGNKWRKFSQIKELPSSLPAVNIAMDEIHVSISCTSTMTVNSAQKALKEIRTQTPPEMFDLSKIVCGTYIDARLMILRGVNGSALLFTRANPMIDT

SEQ ID NO: 7526 - protein, 146 aa, Zea mays
LLDIPFCFKRVDAMLYRANFDGEINYLRKSFQTLEGACDDLKGSRLFLKLLEAVLQAGNRMNVGTNRGQARAFKLDTLLKLADVKGADGKTTLLHFVVQEIIRSEEDARTTSERAAEDEARKIARDETFRSKQGLKVVSGLSGELG

SEQ ID NO: 7527 - protein, 520 aa, Zea mays
VDPRVRNAAGAEAGVGAAVTRRIMASLKIPGDEYAMVCTANRTAAFRLLAESYSFQPGKQLLPVYDYESEAVGAMADSARRRGAEVASATFAWPSMRIHGADLRKRLARGRRRGGGGRGLFVFPLASRMTGARYPYLWMSAAHQQGWHVALDACALGTKDLDTLGLSLIRPDFIVCNFFKVFGENPSGFAGLFVKRSSGLAALERSVIARSIGIVSIVPARRWSLHDGYSTELEHSRSFPKLAADPALDDADVETKSSFSGPLSSTAITRSRTLQSDAAENGDAHAHAPEIREVGSTAENGFYSEEPRAEETERLAKEEQDGEGRESVMEVECRGLDHADALGLIAIGNRLRCISNWLVVALQKLRHPHADNGHPLVRLYGPRVKFDRGPSLAFNVFDWKGERVSPLLVQKLADRHNISLTCGFLCNIWFSDKHEAERAVVLEHRVAGDPVAAGSAGGKRRKDAGGGDVGILVVNASLGFLSNFEDAYRLWAFVAKFLDADFVEKERWRYTALNQKTVEV

SEQ ID NO: 7528 - protein, 360 aa, Zea mays
HGGTPSSDEELRLRLYTGELTQLGPAEQFLRTIIDIPYLYQRLDVLLFMSTLPRVRANAEQSFKTLEVACHELRNSRLFKKLLEAVLKTGNRMNDGTFRGGAQAFKLDTLLKLSDVKGVDGKTTLLHFVVQEIIRSEGVRAVRAAKEQSNSSISSVTSDDLTEDVSDDTEHYKQLGLGVVSSLGDDLQNVRKAAILDADALTISVASLGHKLVKANEFLNTGMKSLDEDSGFHRKLGEFIEQSQVRVTQLLEEEKKLRALVRTTVDYFHGSTGKDEGLRLFVVVRDFLGILDKVCREVKEAAAKAAANNKKPSAAGSGSKGRQPSQSSSSFRDPRQQLVPAIKDRRSAAARSSSSSSDSD

SEQ ID NO: 7529 - protein, 308 aa, Zea mays
  misc_feature (101)..(101): Xaa can be any naturally occurring amino acid
TSLRAGKRTRTDTLEGGWHEHPNSRLFKKLLEAVLKTGNRMNDGTSRGGAQAIKLDTLLKLSDVKGVDGTTTLLHFDDQEIIRPEGVRAVRADKEQSNSSXAARACDDLTEDVSDDTEHYKQLGLGVVSSLGDDLQNVRKAAILDADTLTISVASLGHKLVKANEFLNTGMKSLDEDSGFHRKLGEFIEQSQVRVTQLLEEEKKLRALVRTTVDYFHGSTGKDEGLRLFVVVRDFLGILDKVCREVKEAAAKAAANNKKPSAAGSGSKGRQPSQSSSSFRDPRQQLVPAIKDRRSAAARSSSSSSDSD

SEQ ID NO: 7530 - protein, 188 aa, Zea mays
  misc_feature (112)..(112): Xaa can be any naturally occurring amino acid
MAGAGVTTTGSPCGACKFLRRRCAAECVFAPYFCAEDGASQFAAIHKVFGASNAAKLLQQVAPGDRSEAAATVTYEAQARLRDPVYGCVAHIFALQQQVAALQAQVAHARTXGAAGGAATAMHPLLQQQLQQQAWQVAAAADQHDHQSMTSTQSSSGCYSGAHQRSDGSSLHGAEMYCGYGEQEEGSY

SEQ ID NO: 7531 - protein, 96 aa, Zea mays
NWTTEDDDSLCTLQEAFQRVSPRLGFNIELKFDDSIMYHRKDLQCALKAVLQVVFEHARNRPVFFSSFHPDAAQMMRELQSLYPVIFETPVLCLKL

SEQ ID NO: 7532 - protein, 407 aa, Zea mays
MKPLHLRSSGSFKRLLLLSIGHRSPPTTNPPVADADARESPEEPGSPRCSSSGPAWRCFSYDEVDRATGGFHERNLVGRGGSSEVYRGELPGGRAVAVKRLLGASACERRERDFLAELGTVGHARHPNVCGLLGCCVDRDLYLVFDLSRRGSVAANLHDEALPAMGWAARYGIAVGTARGLEYLHKGCRRRIIHRDIKASNVLLTDDLQPQISDFGLAKWLPSEWTHRAIAPIEGTFGCLAPEYYTHGIVDEKTDVFAFGVFLLELVTGRKPVDGRHRSLLSWVTVARPLLSGDGKVEALVDPRLGGDYDGEQARRVTFVASLCVRAAATWRPSMTEVLELLEGGEIRQDRWAMPETAVANDDGEQQPWWFDVLDDFDDDDDDQDAGGEEFSTPSPSSSSSSSTTSN

SEQ ID NO: 7533 - protein, 197 aa, Zea mays
CVDVIKMGRKVSCMITHGPWVLIGIPKFVEAWNTKTGMKLRFQGPSSLVCSMAITDEMLFAGTGDGRIMAWRFPAKESNTEPVLILSGHQRPVISLSISARRLYSGSLDSIYQAWDLTTRQCVQTLSEHKAAVTSVLCWDEKLLSCSLDKTVKLWTLSESGNLQVKYTHAEENVRTALLPIMRYFCFVGCCILSIPK

SEQ ID NO: 7534 - protein, 287 aa, Zea mays
MARKKIREYDSKRLLKEHLKRLAGIDLHILSAQVTQSTDFAELVNQHPWLSTTKLVVKPDMLFGKRGKSGLVALNLDVAQVKEFVKERLGVEVEMGGCKAPITTFIVEPFVPHDQEYYLSVVSERLGSTISFSECGGIEIEENWDKVKTVFLPTEKPMTPDACAPLIATLPLEARGKIGDFIKGVFAVFQDLDFSFIEMNPFTMVNGEPYPLDMRGELDDTASFKNFKKWGNLEFPLPFGRVLSSTESFIHELDDKTSASLKFTVLNPKGRIWTMVAGGGASVIYAD

SEQ ID NO: 7535 - protein, 373 aa, Zea mays
CSVQASELATTAPDAPRLYSVLLSTPLKPGDATTLEVLYMLTHSLEPFPAEISQSESQLVYYRDSAVLLSPYHVLEQVTYIKMPSNRIESFTRVDPTTRAGSEVKYGTYSNQMPNSYLPVLVHYENNRPFAVVEELVRKVEISHWGNIQITEQYKLKHGGARHKGVFSRLEYQSRPSISGASSFKNLLARLPPRVHSVYYRDEIGNISSSHLRTDSHKSDLEIEPRYPLFGGWHCTFTIGYGLPLQDFVFESVDGRRYINLTFGCPLLDTVVDDLTVKVVLPEGSKNPEHVVPFVTEKHLETSYSYLDVVGRTTVVLKKKNVVGEHNVPFQVYYEFNPIFMLAEPLMLISAVLLFFVAFIAYLHMDLSIRKSS

SEQ ID NO: 7536 - protein, 313 aa, Zea mays
MSSSSNGGKKPAPGGGRRGPAIRTLADISRGPTGFPGAGGGDSGSDDDEPQEYYTGGEKSGMLVQDPTRRNDVDAIFEQARQAGIKGMPPLLGGESSSSRSFTGTGRLLTGETISSAAPQEPVPIRIRHNIHLWNNGFTVDDGPLRYYDDPENEEFLESLKMSKCPKELVPTDGEHVDASVIRRMEDYREPVRPRSAFQGVGRTLGGGPSPDESATAAPASAAPAASRSAGVVVDDSQPFTSIQLRLADGTRMVARFNMHHTVGDIRSFIDAARPGAARPYQLQTGFPPKQLADPTQTVEQAGLANSVIMQKM

SEQ ID NO: 7537 - protein, 200 aa, Zea mays
MDQEAKDSRPSRSPSEPNLFLQWGSRKRLRCVKTRDDGSPSPSPSQGLRRAIPRATRPLLGADIATFRSPRRPSTLNRRKSDLLVNEYKHTMALSPEKDKYYTTRGSPFPFEGNGFDFGTITEDKGTTSLPRFFIALSNKEKEEDFMAMKGSKLPQRPKKRPKLMQKCLLMVSPGAWLSDLSHERYEVREKKSSKKVPCI

SEQ ID NO: 7538 - protein, 200 aa, Zea mays
MDQEAKDSRPSRSPSEPNLFLQWGSRKRLRCVKTRDDGSPSPSPSQGLRRAIPRSTRPLLGADIATFRSPRRPSTLNRRKSDLLVNEYKHTMALSPEKDKYYTTRGSPFPFEGNGFDFGTITEDKGTTSLPRFFIALSNKEKEEDFMAMKGSKLPQRPKKRPKLMQKCLLMVSPGAWLSDLSHERYEVREKKSSKKVPCI

SEQ ID NO: 7539 - protein, 341 aa, Zea mays
MAPPDAGAAAACGARWVRRDTLLGLALGQFVSLLITATGFASSELARRGINAPTSQSLLNYVLLAVAYGGVLLYRRQPLTIKWYYYLILGIIDVEANYIVVKSYQYTSLTSVMLLDCWSIPCVILLTWVFLKTKYGARKFLGVGVCVLGLILVVFSDVHASDRAKGPNPLKGDLFVILGSMLYACSNVTEEFVIKKSNRVELMAMLGLFGALISAIQISVLEREELHSITWTSGAVLPFLGFAVAMFLFYSAVPVILKLCGATMLNLSLLTSDMWAVLIRIFAYHEKVDWIYFVAFAATAGGIVLYSYKGSNEVEETAQVAGASDEHGKGRDEEAGTRNPA

SEQ ID NO: 7540 - protein, 554 aa, Zea mays
LDARIWEKKKKNPSRSDPSTMALQAAYEYLQQAVGHGAWSSTQTLTLLLIAVPTVLLLLASLAKSTSSSGRGKPPLPPSPPGTLPIVGHLHHIGPQTHISLQELVAKYGHNGFLFLRAGAVPTLIVSSPSAAEAVMRTHDHIFASRPWSMASHILRYNTCDVAFSPLGEYWQQTRKLMNTHLLSNKKVYSFRHGREEEVCLVVDNLREAAAKSPSTAVDMSEVLAAYTNDVVSRSVLGSTHRKKGRNTLFREMTMTNVDLLVGFNLEYYIPRWPLTDLLFRLVCWKVTRHLKRWDALLEEVIHEHVEMRKLSGDKEKESDDFIDIFLSRYEEYGFTMDNVKSLLMNVFEAAIETSYLVLESAMAELMNHRRVMKKLQAEVRAYGAEKKLDMIREDDLSSLPYLKASMKEALRLHPPGPLLLPHYSTADCQIDGYHIPANTRVLVNGWAIGRDPAVWEKPEEFMPERFMRDGWDKSNSYSGQDFRYLPFGSGRRICPGANFALATMEIMLANLMYHFDWEVPNEKEDGGGKVSMDETFGLMLRRNEPLYLVPRAV

SEQ ID NO: 7541 - protein, 354 aa, Zea mays
MPDPAPGGTRSPTHPLLPLAIRVSAAAAAAPPVSPAGLSSLHLPSEAPVAAAAMYGHRGAMLGSGGVSDGYEGSKRPRMMESNPYFAVNAGSPLDVSKRARMMEPGPPYFAGMGSSAGGSGSGFYPTYGGNMAGAAGVNSGIQNFPAVRLRGLPFDCEDVDISKFFAGLDIVDCLLVHKNGRFSGEAFVVFPSSMQAEFALHRNRQNMGRRYVEVFRCKKQDYYSAIAAEVNQGGPLLEPEHRHTSPPLRSRRLSEDKGSMEYTEVLKLRGLPYSATTEDIIKFFLEYELAEENVHIAYRTDGKATGEAFVEFPTAEVAKTAMCKDKMTIGTRYVELFPSTPEEASRAKSRGRH

SEQ ID NO: 7542 - protein, 111 aa, Zea mays
QGANVDKVLSFAIDDAILEERITGRWIHSASGRTYHSKFAPPKSPGVDDVTGEPLIQRRDDTAEILKSRLEAFHRQTEPVIEYYSKRGLVVNLPAEKPPKEVTAEVLKALS

SEQ ID NO: 7543 - protein, 159 aa, Zea mays
MDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLAGVTIAHGGVLPNINPVLLPKKTAEKASSGGSKEAKSPKKAAKSPKKA

SEQ ID NO: 7544 - protein, 159 aa, Zea mays
  misc_feature (140)..(140): Xaa can be any naturally occurring amino acid
MDSTAAGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLSGVTIAHGGVLPNINPVLLPKKTAEKASXGGSKEAKSPKKAAKSPKKA

SEQ ID NO: 7545 - protein, 159 aa, Zea mays
MDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLAGVTIAHGGVLPNINPVLLPKKTAEKASSGGSKEAKSPRKAAKSPKKA

SEQ ID NO: 7546 - protein, 118 aa, Zea mays
VKLQSSLSEVNEIVKGVRSDVSNVVSADEFEYKDPVDGSISSHQGIRYLFEDGSLLVFRLSGTGSEGATIRLYIEQYEKDPSKTGRLSHEALAPLVEVALKLPKMQEFTGRSAPTVIT

SEQ ID NO: 7547 - protein, 287 aa, Zea mays
MNRGRETGGNLRESGLFSGCDGDGGAGMDRKRIKDVLEKHLERSSPSTSRGVVSKERERLAAGKLPASLGKAEKVSDGEEFETDSEDEDSDISGSESEGTSWISWFCTLRGNEFFCEIDDDYIQDDFNLCGLSMQVPYYDYALDLILDIESSDGEIVERKEFIELSAEILYGLIHARYILTSKGLAAMLEKFKNRDFGGCPRVYCCGQPCLPAGQSDVPRSSTVKIYCPKYEELNYPISMYQGSIDGSYFGTTFPHLFLMTYPHLKPQKPPQQYTPRVFGFKHHKPS

SEQ ID NO: 7548 - protein, 285 aa, Zea mays
MAVPMSAQIAAAVTPARSMLQRRPLTVSVVHNEAFEKVKRTPKANQLYQNSEFWRAWDRIPPSDSHVRKISKHHEEKHRSLESRGADFDAERRLYSHAFKKSSSLLSRLMKHKFGWVFNKPVDPVALGLHDYFTIIKHPMDLGTIRGRLSRGQYRNPKEFAEDVRLTFHNAMTYNPKGQDVHFMAEQLSGIFEAQWPEIEAEVNYLASCPPLPKKFPPPPIDLHFLERSDSMRHHMALDTNSRPISHTPTYTRTPSMKKPRAKDPNKRDMTIDEKRKLSENLQAC

SEQ ID NO: 7549 - protein, 265 aa, Zea mays
  misc_feature (194)..(194): Xaa can be any naturally occurring amino acid
  misc_feature (243)..(243): Xaa can be any naturally occurring amino acid
MSIRTVELKPFQDQKPGTSGLRKKVKVFQQEHYSEAFVTSILLSIPEGVEGSFLVVGGDGRYWNPEVTQAIAKIGAAYGVKKLLIGHNGIMSTPAASHLIRIRKATGGILLTASHNPGGPEEDFGIKYNLANGAPAPESVTNKIYETSRTLTSYKIADIPDIDLSTIGTQKYGELEVEIVHSTEDYLKMLKDIXFDFDLIKSFLKQHPDFKVLFDGLSGVTGSYGVDIFEKELGIPNSTQNCXPQPDFGGHHPRSNSSQVAGRCR

SEQ ID NO: 7550 - protein, 381 aa, Zea mays
FGSRKLDAQQKAHVSLPMDTFKSYVLKEPIGVVALITPWNYPLLMATWKVAPALAAGCAAILKPSELASVTCLELAEICKEVGLPPGVLNILTGLGPEAGAPLAAHPDVDKIAFTGSSATGSKIMTAAAQLIKPVSLELGGKSPIIVFEDVDLDKAAEWTIFGCFWTNGQICSATSRLIVHESIATEFLNRIVKWVKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGLGSAVISNDLERCERITKAFKAGIVWINCSQPCFTQAPWGGIKRSGFGRELGEWGLDNYLSVKQVTQYISDEPWGWYQSPSRL

SEQ ID NO: 7551 - protein, 129 aa, Zea mays
MAAAAAAGAGGVAAGVAGSPCGACKFLRRRCVAECVFAPYFSSDQGAARFAAIHKVFGASNAAKLLAHLPLADRCEAVVTITYEAQSRLRDPVYGCVAQIFALQQQVRRLVPFFFFFFFFHLPPCRSLL

SEQ ID NO: 7552 - protein, 466 aa, Zea mays
FGSSTPAASHIIRIRKATGGILLTASHNPGGPDEDFGMKYNLANGAPAPESVTNKIYETSKTLSSYKIADIPDIDLSTIGTQKYGSLEVEIVHSTEDYLKMLKDIFDFDLIKSFLKQHSDFKVLFDGLSGVTGSYGVDIFEKELGIPNSTQNCVPKPDFGGHHPDPNLVYAKSLVDAVDKNGVHFGAASDGDGDRNMIYGANSFVSPGDSLAIIAHHAELIPYFKKQGIYGLARSMPTSGAIDLVAKKKGVECYEVPTGWKFFCGLFDSNKMNICGEESFGTGSNHIREKDGLWAVVAWLNILAGVGQQTGTTPSIASIQKDFWKTYGRTFFTRYDYEGCETEGANKVTSHMKELITTKKDEFIGSTVAGRKVVEADDFSYTDLDGSVSKNQGIFVKFDDGSRIVVRLSGTGSSGATIRLYIEKHTSDESTYDMDAQDYLKDNVKLATDLLKLQEYVGRTEPDVKT

SEQ ID NO: 7553 - protein, 258 aa, Zea mays
SVPLLPVYDYESEAVGAMADSARRRGAEVTSASFAWPSMRIHGTDLRKRLARGCRRGAGRGLFVFPLASRMTGARYPYLWMSAAHEQGWHVALDACALGTKDLDTFGLSLIRPDFIVCNFFKVFGENPSGFAGLFIKKSSLAALERSVIARSIGIVSIVPARRWSLHDGYSTELEHSRSFPKLADPALDDGDVETTSSFSGPLSSTAVTRSRTLQSDAAENGDADAPEIREVDITPENGFYTGEPRAENGHETEQGYR

SEQ ID NO: 7554 - protein, 308 aa, Zea mays
SQASSCPPVYDYESEAVGAMADSAHRRGAEVASATFAWPSMRIHGADLRKRLARGRRRGGGGRGLFVFPLASRMTGARYPYLWMSAAHQQGWHVALDACALGTKDLDTLGLSLIRPDFIVCNFFKVFGENPSGFAGLFVKRSSGLAALERSVIARSIGIVSIVPARRWSLHDGYSTELEHSRSFPMLAADPALDDADVETTSSFSGPLSSIAITRSRTMQSDAAENGDAHAHAPEIREVGSTAENGFYSEEPRAEETERLAKEEQDGEGRESVMEVECRGLDHADALGLIAIGNRLRCSSNWLVVALQ

SEQ ID NO: 7555 - protein, 441 aa, Zea mays; identical to SEQ ID NO: 445

SEQ ID NO: 7556 - protein, 150 aa, Zea mays
MDVSGAGGKAKKGAAGRKAGGPTKKSVSRSARAGLQFPVSRVGRYLKKGRYAQRVGTGAPVYLAAVLEYLAAEVLELAGNAARDNKKTRIIPRHVLLAIRNDEELGKLLAGVTIAHGGVLPNIHTVLLPKKVAEKAAKEPKKAAKSPKKA

SEQ ID NO: 7557 - protein, 131 aa, Zea mays
LPRQADVFPDRDNFGRIFYNQAKMSSDGIPQIAVVLGSCTAGGAYIPAMADESVIVKGNGTIFLAGPPLVKAATGEEISAEDLGGASVHCKVSGVSDHFAQDEIHGLELGRIIVKNLHLADTRIKYSEFCL

SEQ ID NO: 7558 - protein, 800 aa, Zea mays
  misc_feature (265)..(265): Xaa can be any naturally occurring amino acid
MPSPRQFLQLLLPTLLATCCVDGANGPHAPATARRQLHQPFFVPDQPGQPSAPPPFFPAIPVTPPPPVPTGQDQPTYPALVFPSNGSSGATPPAGNSHGSKKASPSSGEEEFYSPRGSSIKTSSSRRTLATAVQAALEARDRSRTPSPGSVLSTPSYPSSPGATLSPAPASPPAFSSPGESGRRSVKSRSESARVVVLPPVPPTPPPPPPFAPTLPPPPPPRRKPPSPSPPCSPLNDKPALRSSTDTSAGNPFAQPPSLPTSTHXHGHLRLQEPPPPPPPPPPPPVGYWESRVRKPDTSKETRSPALSPPSFRSVPAPTDAFPSRLPESSEQGDKSEDTTPRPKLKPLHWDKVRASSDRVMVWDQLKSSSFQVNEEMIETLFICNPANAPAKEATRRPVLPTPKAENKVLDPKKAQNIAILLRALNVTKEEVSDALCEGNTENFGADLLETLLKMAPTKEEEIKLREFKEESSPVKLNPAEKFLKAVLDVPFAFKRVDAMLYIANFDAEVNYLKKSFETLEAACDELRSSRLFLKLLEAVLKTGNRMNVGTNRGDAHAFKLDTLLKLVDVKGTDGHTTLLHFVVQEMIRTEGARESASTQTTPRTQANPLREELECKKLGLQAVAGLASELSSVKKAAGMDSDVLSSYVTKLAGGIEKVTEVVLRLKNEGTESRDGAWRFHDRMQRFLKKADDEIIRIQCQESVALSLVKEITEYFHGDSAKEEAHPFRIFMVVRDFLAVLDQVCREVGRVNERTIASSARHFPVPVNPTTPQLFPRLHALRAGFSDDDDESSAASVSSP

SEQ ID NO: 7559 - protein, 244 aa, Zea mays
MGFLEDFQASVEALPSMLHRNYSLMRELDKSLHGVQLENEQRCQQEIEDIKHGLESGSITYDPAKLKFSEEAMEEQKHCVRIADEKVALATQTYDLVDAHIQQLDQFMRKLEEIRQGKEAAAAVTAGTAVATTATPTVNAGATTADANPKSGRSGERGRGGRKKAKSVPVPVPLPPIDLELPVDPNEPTYCLCNQVSYGEMVACDNPNCKIEWYHYGCVGVKEQPKGKWYCPNCIGFQKKRKGK

SEQ ID NO: 7560 - protein, 260 aa, Zea mays
MSAGGGGGGTSTLGGGGPSGSGSGGPGGSGGGGPCGACKFLRRKCVSGCIFAPYFDSEQGAAHFAAVHKVFGASNVSKLLLQIPAHKRLDAVVTICYEAQARLRDPVYGCVAHIFALQQQVVNLQAELTYLQAHLATLELPAPPPLPAPPQMPMPGPFSISDLPSSTSVPTTVDLSALFDPPPPQWAAAQQPHHHHQQPPQHHQLRQPAPYGAGASVRPGGGPGMAESSGGDELQSLARELQDRHRSGGVKLEHPPPHSR

SEQ ID NO: 7561 - protein, 180 aa, Zea mays
MRGAEEERSGAATDAGGEEEKRERSVGLMAGLMDKAKGFVVEKVTQIPKPEAALDHVSFRSISREGVELHSHVDISNPYSHRIPICEITYTFKSAGKVIASGTMPDPGWIAASGSTKLDLPVKVPYDFIVSLMKDLGGDWDIDYMMEVGLTVDLPAIGAFTIPLTTEGEIKLPTFRDLLF

SEQ ID NO: 7562 - protein, 350 aa, Zea mays
MAAKQRHRQLPLLPLLAAAVAWSLLRAAAAAGTGTGTLGLRHKPARQHNSTRHGGGRRAQRGGAPGTGMASCNLFQGSWVYDDTLPMYDAAGCPFVEPEFDCQKYGRPDKLYLKYRWRPASCELPRFNGQDLLRRWKGKKILFVGDSISLNQWESLACMLRAAAPASSRVAYARGNPVSSVTFQDYGVSVAYYRSTYLVDIVEESVGRVLKLDSITGDAWLGADVLVFNTWHWWTHTGRDQPWDYVQDGGQVMKDMDRLTAFSKGMSTWARWVDSSVDTSRTKVYFQGISPTHYNGADWGEGSRSCAQQTQPVAGPAYPAGPVPAQAAVRAALAAMSKPVYLLDVTLLSQ

SEQ ID NO: 7563 - protein, 181 aa, Zea mays
MAKPVSIQVWNPSGKYRVVSTKSMPGTRWIRLLTDNDCRLEICTEHKTILSVDDILALIGDRCDGVIGQLTEDWGDVLFSALKRAGGTVFSNMAVGYNNVDVEAANRNGIAIGNTPGVLTETTAELAASLSLAAARRIVEADQFMRAGLYDGWLPHLFVGNLLKGQTVGVIGAGRIGSAYA

SEQ ID NO: 7564 - protein, 168 aa, Zea mays
MSGAGKKVADVAFKASRTIDWEGMAKVLVTDEARREFSNLRRAFDEVNTQLQTKFSQEPEPIDWDFYRKGIGSGIVDMYKEAYDSVEIPKYVDNVTPEYKPKFDALLVELKEAEQKSLKESERLEKEIIDVQEISKKLSTMTADEYFEKHPELKKKFDDEIRNDYWGY

SEQ ID NO: 7565 - protein, 192 aa, Zea mays
  misc_feature (72)..(72): Xaa can be any naturally occurring amino acid
  misc_feature (102)..(102): Xaa can be any naturally occurring amino acid
  misc_feature (105)..(106): Xaa can be any naturally occurring amino acid
  misc_feature (109)..(109): Xaa can be any naturally occurring amino acid
  misc_feature (111)..(112): Xaa can be any naturally occurring amino acid
  misc_feature (121)..(121): Xaa can be any naturally occurring amino acid
  misc_feature (125)..(125): Xaa can be any naturally occurring amino acid
  misc_feature (130)..(130): Xaa can be any naturally occurring amino acid
  misc_feature (133)..(133): Xaa can be any naturally occurring amino acid
  misc_feature (138)..(139): Xaa can be any naturally occurring amino acid
  misc_feature (141)..(142): Xaa can be any naturally occurring amino acid
  misc_feature (145)..(145): Xaa can be any naturally occurring amino acid
  misc_feature (148)..(149): Xaa can be any naturally occurring amino acid
  misc_feature (151)..(151): Xaa can be any naturally occurring amino acid
  misc_feature (154)..(155): Xaa can be any naturally occurring amino acid
  misc_feature (157)..(157): Xaa can be any naturally occurring amino acid
  misc_feature (160)..(161): Xaa can be any naturally occurring amino acid
  misc_feature (164)..(164): Xaa can be any naturally occurring amino acid
  misc_feature (166)..(167): Xaa can be any naturally occurring amino acid
  misc_feature (169)..(171): Xaa can be any naturally occurring amino acid
  misc_feature (173)..(173): Xaa can be any naturally occurring amino acid
  misc_feature (175)..(176): Xaa can be any naturally occurring amino acid
  misc_feature (178)..(179): Xaa can be any naturally occurring amino acid
MVGVSPKIAPSMLSSDFANLAAEAKRMIDLGANWLHMDIMDGHFVSNLTIGAPVIESLRKHTNAYLDCHLMXTNPMDYVDQMAKAGASGFTFHVEVAQENWXELXXKIXAXXMRPGVALKXGTPXEQLYXLLXRRTKXXLXXVLXILXXPXFGXXKXMPXXMDXRXXIXXXSXHXXHXXARHSPPPRPLGIP

SEQ ID NO: 7566 - protein, 562 aa, Zea mays
MSEGDATQLALEKGLPQVSNDDGSSSPATMHKLKVDTEDAGSKIESPTPEKLESRSKGVVVSSLARNLLAERYKDRFANQFLEDEGDIDDEDYNDSISPGMSRSQRSRSIELLEKHKDLLNLFNRMESSIRLLRLRKRMATFNNIATQVEILAKRKLSYCHLAQMKYLFPEAIQIKRVLLHDEKSLCMYADMEIILVMDVVEYTSTDHSPSMTICDAFYSKLLTFLDAHHKGTDIPEAILPEPFNLRSRGQLNLEASHNGHAAEPHLQGTTKDGFSNASHFPQSFRKLMSQKVITDGAERTQLLLDPTKLSSVSAYDTEGTNRSPKKQDKHASVTVNSEISATPSRHLISRCQEGTPKQETLESPLLAQTPATQTPKRQLPTPLEKLEATCGHISEPRSASSARRSLNTSLKFEGGSPSYHDRMEHVATSKIGILSEDSSSFNKSLEENGPVFFTDRDKINLADPVGVQEKMASLRSTFGIVCDISHSIKNSLITKQELFHNILANNLEIEQMGEIEEQLHILEDLAPNWISKKVINGEEILYSFETIADQNSVWERLVEAV

SEQ ID NO: 7567 - protein, 213 aa, Zea mays
  misc_feature (99)..(99): Xaa can be any naturally occurring amino acid
  misc_feature (120)..(120): Xaa can be any naturally occurring amino acid
  misc_feature (143)..(143): Xaa can be any naturally occurring amino acid
  misc_feature (163)..(163): Xaa can be any naturally occurring amino acid
IRTLPALLAQRLNLKPRHREEVRRRRGGVRRFGVAVILGGELLRAGVSHLRQCRVAVLPGLCDVDLARTEFGFTFPSDLRAVLALDVLLGPGFSDWRGXGRSPRRLRPPHGRGGALDHQXAHCGLWLQCWSQRSTDPNHALRXTRYAIRHAQVLMPLFDMPRXSPIFFVADDRVLCYGLDLLYFFTRDSSLRCHVRSGYTCIFQIKHTAKKKK

SEQ ID NO: 7568 - protein, 339 aa, Zea mays
MASAIKAASTSSRWSSSPAAVHSSPLSKRLPAAVAMPGRRRSVATVRAVAAVAPAAPAAPAKLTAGAGGRCLPVSQTMSRLRAQGKTAFIPYITAGDPDLATTAEALRLLDACGADVIELGVPFSDPYADGPVIQASAARALASGTTPDGVLAMLKEVTPELSCPVVLFSYFNPIVRWGLADFAAAVKEAGVHGLIVPDLPYGNSCALTLRTEAIKNNLELVLLTTPSTPADRMEEITRASRGFVYLATVNGVTGPRANVNTRVQSLIQEVKQVTDIPVAVGFGISKPEHVKQIAEWGADGVIIGSAMVRQLGEAASPKEGLKRLEKYARSMKNALPCQ

SEQ ID NO: 7569 - protein, 73 aa, Zea mays
MIEVVLNDRLGKKVRVKCNEDDTIGDLKKLVAAQTGTRPEKIRIQKWYNIYKDHITLKDYEVHDGMGLELYYN

SEQ ID NO: 7570 - protein, 73 aa, Zea mays
MIQVVLNDRLGKKVRVKCNEDDTIGDLKKLVAAQTGTRPEKIRIQKWYNIYKDPIPLKDYEVHDGMGLELYYN

SEQ ID NO: 7571 - protein, 262 aa, Zea mays
  misc_feature (204)..(204): Xaa can be any naturally occurring amino acid
  misc_feature (229)..(229): Xaa can be any naturally occurring amino acid
MASPALISDTDQWKALQAHVSAIHKTHLRDLMTDADRCKAMTAEFEGVFLDYSRQQATTETVDKLFKLAETAKLKEKIDKMFKGEKINTTENRSVLHVALRAPRDAVINSDGVNVVPEVWAVKDKIKQFSETFRSGSWVGATGKPLTNVVSVGIGGSFLGPLFVHTALQTDPEAAECAKGRQLRFLANVDPVDVARSIKDLDPXTTLVVVVSKTFTTAETMLNARTIQXRGLSLLLDLRLFPKHMIAGRTNLRLGQEFRNLT

SEQ ID NO: 7572 - protein, 167 aa, Zea mays
  misc_feature (8)..(8): Xaa can be any naturally occurring amino acid
ITAALAQXGLLEPKDVDLLNITSMACPALPLCPLAQTEAERGILPILKRIRAVFDKVGIKDEESVVVRITGCPNGCARPYMAEVGFVGDGPNSYQIWLGGTPNQTTLAETFMNKVKLQDIEKVLEPLFSYWNSTRQEGESFGSFTNRMGFEQLKEVVNKWEGSASAA

SEQ ID NO: 7573 - protein, 188 aa, Zea mays
  misc_feature (57)..(57): Xaa can be any naturally occurring amino acid
  misc_feature (94)..(94): Xaa can be any naturally occurring amino acid
  misc_feature (133)..(133): Xaa can be any naturally occurring amino acid
MSSDGEKVPKRAESPVADSENDGGNTDGLHRRLNNRQVQLLSIGGTVGTGLFIGIGXGLAKSGPGSLLVCTALYAMVLGLTNNSIAEMNTYMPXSGGFIRLAGHWVDDALGFMVGWNFFLYEALLIPFEIVAXNLVVSFWSDNVTQAGPTAGFIIAGIIAYGVLNLLAVGVFGEAEFWLALGKALLIF

SEQ ID NO: 7574 - protein, 217 aa, Zea mays
  misc_feature (169)..(169): Xaa can be any naturally occurring amino acid
  misc_feature (174)..(174): Xaa can be any naturally occurring amino acid
  misc_feature (203)..(203): Xaa can be any naturally occurring amino acid
MEDGVSTYTVDEALVSMGFGKFHAFVLAYSGMAKISEAMEMMLLSFVGQSVQAEWGLSAHEESLITSVVFVGMLVGAYAWGIVSDNYGRRVGFNFTAIVTGGAGLLSAFAPNYLSLIVLRFMVGVGLGGGPVLGSWFLEFIPAPNRGTWMVMFSAFWTVGTIMEASLAXAVMPXFGWRWLLALSSLPSFGLLLFYPVTLESPXYLCMKGRIAEAVHV

SEQ ID NO: 7575 - protein, 527 aa, Zea mays
MHSTNLLLEEPIRMVSILEPSKPNFFPAMTKIVGTLGPKSRSVEAISACLKAGMSVARFDFSWGDAAYHQETLENLKLAIKATKKLCAVMLDTVGPELQVVNKSEVTISLEENESVVLTPHQGQEASSKLLPINFAGLAKAVKPGATIFVGQYLFTGSETTSVWLEVSEVQGDDVVCVIKNSATLAGSLFTLHCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKQTVKYVGEPMTHLESIASSAVRAAIKVKASVIICFTSSGRAARLIAKYRPTMPVLSVVIPRLKTNQLRWSFTGAFEARQSLIVRGLFPMLADPRHPAESTSNTNESVLKVALDHGKACGVIKSHDRVVVCQKVGDSSVVKIIELDD

SEQ ID NO: 7576 - protein, 527 aa, Zea mays
MHSTNLLLEEPIRMASILEPSKPSYFPAMTKIVGTLGPKSRSVDTISACLKAGMSVARFDFSWGDAAYHQETLENLKLSIKSTKKLCAVMLDTVGPELQVVNKSETPISLEENGTVVLTPHRGQDASSSLLPINFSGLAKAVTPGATIFVGQYLFTGSETTSVWLEVSEVKGDDVVCIIKNTATLAGSLFTLHCSQIHIDLPTLSDEDKDVIRKWGTPNKIDFLSLSYTRHAEDVRQAREFLSKLGDLSQTLIFAKIENVEGLNQFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYFKQTVKYVGEPMTHLESIASSAVRAAIKVKASVIICFTSSGRAARLIAKYRPTMPVLSVVIPRLKTNQLRWSFTGAFEARQSLIVRGLFPMLADPRHPAESTSNTNESVLKVALDHGKACGVIKSHDRVVVCQKVGDSSVVKIIELDD

SEQ ID NO: 7577 - protein, 254 aa, Zea mays
  misc_feature (172)..(172): Xaa can be any naturally occurring amino acid
  misc_feature (181)..(181): Xaa can be any naturally occurring amino acid
  misc_feature (187)..(187): Xaa can be any naturally occurring amino acid
  misc_feature (202)..(202): Xaa can be any naturally occurring amino acid
  misc_feature (208)..(208): Xaa can be any naturally occurring amino acid
  misc_feature (234)..(235): Xaa can be any naturally occurring amino acid
MARKFFVGGNFKMNGSKSSIKEIVENLNNADLDKNAEVVVSPPALYLPLVRETLRKEIEVAAQNVYDKPNGAFTGEISVSQLKDSDINWAILGHSERRTIIGESDEVISSKTKYATENGLKVIWCCGESLETREAGKTIEFVSAQIESLKSQISDWSNIVIAYEPIWAIGTXGKVATTEQXAQEVHXRIRDLLRSISDKVAXETRILXYGGRVNEKNCGELSRQADIDGSLVGXXSQPAFVDIITLPAVTINSK

SEQ ID NO: 7578 - protein, 347 aa, Zea mays
MADNSIEQALIENPPNVLKWKPSERAKRFRRCRSTPSDPTDQKPAENGSVLKAKELFKEKRPSFMLVGLLLFAYLLVGVIIFYLFMDQLSGKTTNRVLDALYFVIVTMTSVGYGDLFPNSDTTKLLACAFVFTGMAIIALFISKAADYLVEKQEVLFFKALHMNMKGSEAKMLGAMETNRIKYKFYTVALLLAMVIDAGTVFLWKVEKLSLVDSFYCVCATITTLGYGDKSFSSKLGRVFAVFWITTSTLIMAQFFMYLAELYTERRQKILTKWVVNRRITTMDLEAADIDDDRQVGAAEFVLYKLKELGKISQEEISCFLEEFDKLDVDQSGTLSTYDLTLGQTIQ

SEQ ID NO: 7579 - protein, 101 aa, Zea mays
MDPSAAINTARDSPPCLPSAPRPGAAALRARAAKLPPGVEAPRVQPKLSEPFLGFTQTAEIWNSRACMIGLIGTFIVELVLNKGILQMIGVEVGKGLDLPL

SEQ ID NO: 7580 - protein, 115 aa, Zea mays
  misc_feature (71)..(71): Xaa can be any naturally occurring amino acid
MAARCSLSSSSLSVHGPLRRNKPSKRLAPCLPSSPRPGAAALRARAAKLPPGVEAPRVQPKLSEPFLGFTXTAEIWNSRACMIGLIGTFIVELVLNKGILQMIGVEVGKGLDLPL

SEQ ID NO: 7581 - protein, 116 aa, Zea mays
MAARCSSLSSPSLSVHGPLRRNKPSKRLAPCLPSAPRPGAAALRARAAKLPPGVEAPRVQPKLSEPFLGFTQTAEIWNSRACMIGLIGTFIVELVLNKGILQMIGVEVGKGLDLPL

SEQ ID NO: 7582 - protein, 116 aa, Zea mays
MPARCSSLSSPSLSVHGPLRRNKPSKRLAPCLPSAPRPGAAALRARAAKLPPGVEAPRVQPKLSEPFLGFTQTAEIWNSRACMIGLIGTFIVELVLNKGILQMIGVEVGKGLDLPL

SEQ ID NO: 7583 - protein, 122 aa, Zea mays
MNSRRDFRSHRAALFDGIEEGGVRAPAYSSREIHEHENDQALDSLHDRVSVLKRLTGDIHEEVENHNRMLDRMGNDMDASRGFLSGTVDKFKMVFETKSSRRMATTGASFIAVFLLIYYLTK

SEQ ID NO: 7584 - protein, 390 aa, Zea mays
MKGVSEGLIIGTTVGVVIGVLLALGTLLCLRRRRRSQTQIRSSSSRRASTVPIRTNGVNACAMLSNSTTGQESPTPRELEERGSSLWIQGPGRKSVISASGVPRYAYKELQKATSNFTTLLGQGAFGPVYKADMSSGEVLAVKVLSNNSRQGEKEFQNEVLLLGRLHHRNLVNLVGYCADKGQHMLLYAYMPNGSLASHLYGEDSAPLKWDLRVSIALDVARGLEYLHDGAVPPVVHRDIKSPNILLDQAMHARVADFGLSREEMVTRGDGAANNIRGTYGYLDPEYVSTRSFTKKSDVYSYGVLLFELIAGRNPQQGLMEYAELAAINADDGRRTGWEEIADARLGGAFDADELNDVAAVAYRCVSRASRKRPAMRDVVQALARVARRG

SEQ ID NO: 7585 - protein, 225 aa, Zea mays
MDLSSDDVKAANMRPAVAAADGTSTLLRGWREFMRSGAPARFLCYEDGKWIGITGEAVPQLRQAFQERRAMADASYGGKAYLFDFLRMIRIDEVTGEETGLAWIDDRGDCFFPAPDCGGRKRKRDDEPAEDEAESSSGVDVRSGERHGVDAKKMKAWENAAVRLEENDMYYQVVSKLFLSYGMAQRGAAITEVRKIAPGARTVAFREQGQRLAYARCTATGTAKF

SEQ ID NO: 7586 - protein, 394 aa, Zea mays
  misc_feature (353)..(353): Xaa can be any naturally occurring amino acid
FVPNIHEINLVFGRKTVLLLSTLLTSGLGLLSALSINYLCLLVLRFFVGIGVGSGHVFSSWFLEFVPAGNRGTWMVIFSFFWTIGTVLEASLAWAVLSALSWRWLLALSSLPCFLLLLFFRITPESPRYLCAQNRMTDARFVLERMAIANQAALPMGVLTYHQETKTECITHVSEDEHLIPVREKEHTDRNAISSKSGAVAVLHKLLSHNLLKSTLLLWFVYYASSFAYYGITLLTSQLSDVNRSCKSDLVFEVHQNNGNLYKDTFITSLAEIPGLILSALLVDRFGRKATMSCLMFACCAFLGPLVLHQNELLTTTLLFGARACGTGATTTLCLYAPEVRFNFLMATCILIXFILFLRSCHQMEAVLVFELVLFLAGVSCILFPVETKGREMD

SEQ ID NO: 7587 - protein, 220 aa, Zea mays
  misc_feature (208)..(208): Xaa can be any naturally occurring amino acid
SGSRFRENPNPASNPMAASAGSKIRNAKLVLLGDVGAGKSSLVLRFVKGQFVEFQESTIGAAFFSQTLAVNDETVKFEIWDTAGQERYHSLAPMYYRGAAAAIVVYDISNQASFTRAKKWVQELQAQGNQNTVVALAGNKADLLEAREVQIEEAKTYAQENGLFFMETSAKTATNVNDIFYEIAKRLLQGQAAQNPQAAGMVLSQRPXERVVSAASCCSS

SEQ ID NO: 7588 - protein, 115 aa, Zea mays
MPCLNVSTNVNLEGVDTSAVLADASSTVATIIGKPEAYVMVVLKGSVPMAFGGTQEPAAYGELVSIGGLNADVNKKLSAGIASILESKLSIPKSRFYLKFHDSKRSDFGWNGSTF

SEQ ID NO: 7589 - protein, 125 aa, Zea mays
NLGGDKLVTVEDIVLQHWATYGRHYYTRYDYENVDAEAAKELMANLVKMQSSLSDVNKSIKEIQPTVADVVSADEFEYKDPVDGSVSKHQGIRYLFGDGSRLVFRLSGTGSVGATIRIYIEQYEK

SEQ ID NO: 7590 - protein, 174 aa, Zea mays
  misc_feature (131)..(131): Xaa can be any naturally occurring amino acid
  misc_feature (154)..(154): Xaa can be any naturally occurring amino acid
MALLKAARVADVPTLDVVVPDHLAAAAARVLDAEAASMVKKQRGAGRRFAVIGHRGKGMNALASPDRRMQEVKENSVRSFNEAARFAVDYVEFDVQVTKDVCPVIFHDNFIITEEHGKISEKRVTDLQLEXFLQYGPQNKQGKNGKPLLREMNXDGRVLNCNAQTDDPLCPLQE

SEQ ID NO: 7591 - protein, 254 aa, Zea mays
  misc_feature (149)..(149): Xaa can be any naturally occurring amino acid
  misc_feature (178)..(178): Xaa can be any naturally occurring amino acid
MASSSTDLADDGFAAPRLFSQGVSYTYDDVIFLPGYIGFPADAVDLSTRLSRRIPLSIPCVASPMDTVSEAAMAAAMASLGAAAVVHCNTDPHAQAAIVRAAKSRRLPFVSSVPFFSPSSAPTLNDFAGSEYALVTERGDSLSRLVGVXAVAADAASREVPVSVSEYMRPTPRSASAXFDFEEAATFLADEGLDYAPLVSDDGEVVDLITAKDVERIRSYPKLGKPSLGANGKFVVAASIGTREDDKGRLGALV

SEQ ID NO: 7592 - protein, 239 aa, Zea mays
  misc_feature (84)..(84): Xaa can be any naturally occurring amino acid
  misc_feature (203)..(203): Xaa can be any naturally occurring amino acid
  misc_feature (206)..(206): Xaa can be any naturally occurring amino acid
  misc_feature (222)..(222): Xaa can be any naturally occurring amino acid
  misc_feature (224)..(224): Xaa can be any naturally occurring amino acid
  misc_feature (229)..(229): Xaa can be any naturally occurring amino acid
  misc_feature (232)..(232): Xaa can be any naturally occurring amino acid
  misc_feature (234)..(234): Xaa can be any naturally occurring amino acid
MASNSTYLAADGFAAPRLFSQGVSYTYDDVIFLPAYIGFPADAVDLSTRLSRRIPLSIPCVASPMDTVSESAMAAAMASLGAAXAVVHCNTDPHAQAAIVRAAKSRRLPFVSSVPFFSPYSAPTLNDFAGSEYALVTERGDSLSRLVGVAVAADAVSREVPVSISEYMRPTPRSASAAFDFEEAATFLADEGLDYAPLVSNDXEVXDLITAKDVERIRSYPXLXKPSLXANXKXVVAAS

SEQ ID NO: 7593 - protein, 223 aa, Zea mays
MASSSPDLADDGFAAPRLFSQGVSYTYDDVIFLPGYIGFPADAVDLSTRLSRRVPLSIPCVASPMDTVSEAAMAAAMASLGAAAVVHCNTEPHSQAAIVRAAKSRRLPFVSSVPFFSPSSSPTLNDFAGSEYALVTERGDSLSRLVGIAVAADAASREVPISVSEYMRPTPRSASSAFDFEEAATFLADEGLDYAPLVSDDGEVVDLITAKDVERIRSYPKLG

SEQ ID NO: 7594 - protein, 199 aa, Zea mays
  misc_feature (159)..(159): Xaa can be any naturally occurring amino acid
  misc_feature (162)..(162): Xaa can be any naturally occurring amino acid
  misc_feature (177)..(177): Xaa can be any naturally occurring amino acid
  misc_feature (189)..(189): Xaa can be any naturally occurring amino acid
MASSSTDLADDGFAAPRLFSQGVSYTYDDVIFLPGYIGFPADAVDLSTRLSRRIPLSIPCVASPMDTVSEAAMAAAMASLGAAAVVHCNTDPHAQAAIVRAAKSRRLPFVSSVPFFSPSSAPTLNDFAGSEYALVTERGDSLSRLVGVAVAADAASREXPVXVSEYMRPTPRSASAXFDFEEAATFLGXMKGLDYAPLD

SEQ ID NO: 7595 - protein, 203 aa, Zea mays
MAANAGNKIRNAKLVLLGDVGAGKSSLVLRFVKGQFVEFQESTIGAAFFSQTLAVNDETVKFEIWDTAGQERYHSLAPMYYRGAAAAIVVYDITNPASFTRAKKWVQELQAQGNPNTIVALAGNKVDMLDARHVAVEEAKTYAQENGLFFMETSAKTAINVNDIFYEIAKRLLQGQEAPSPQAGIVLNQRPDERMVSTSSCCS

SEQ ID NO: 7596 - protein, 250 aa, Zea mays
  misc_feature (89)..(89): Xaa can be any naturally occurring amino acid
  misc_feature (139)..(139): Xaa can be any naturally occurring amino acid
MNHIPPTEHGNGGSKQLEIPQPGSFSCGLISSEARPQFRHQPSNSMAANFGNKIRNAKLVLLGDVGAGKSSLVLRFVKGQFVEFQESTXIGAAFFSQTLAVNDETVKFEIWDTAGQERYHSLAPCYYRGAAAAIVVYDXGTNPASFTRAKKWVQELQAQGNPNTIVALAGNKVDMLDARHVAVEEAKTYAQENGLFFMETSAKTAINVNDIFYEIAKRLLQGQEAPSPQAGIVLNQRPDERMVSTSSCCS

SEQ ID NO: 7597 - protein, 897 aa, Zea mays
MAATEAATDTGSSRRSQDDTTTLVPHSGNLGEPIQKGVKTTRFKDDDEVVEITIVQRDSVAIEDVRVVDDGGSGHSNGFDGLSLVSPSSSRSGKLSSKIRQVKNGLKMKNSSTKAPQTQLGKNMRKRLDRSKSGAAVALKGLQFVTAKVGHDGWAVVEKRFNELQVDGVLLRSRFGKCIGMDGSDEFAVQLFDSLARKRGITKQVLTKDELKDFWEQLSDQGFDNRLQIFFDMVDKNADGRITEEEVKEIITLSASANKLSKLKERADEYTALIMEELDRDSLGYIELEDLKALLLQSPSQVVARSTTHSSKLSKALSMKLASNKDTGPFYHYWQEFMYFLEENWKRIWVMTLWLSICIGLFIWKFIQYRNRAVFHIMGYCVTTAKGAAETLKFNMALVLFPVCRNTITWIRSKTKIGAVVPFNDNINFHKVIAAGVAVGVVLHAGAHLTCDFPLLLHASDAAYEPMKPFFGDKRPPNYWWFVKGTEGWTGVVMVVLMTIAFVLAQPWFRRNKLKDSNPLKKMTGFNAFWFTHHLFVIVYALLIVHGTCLYLSRKWYKKTTWMYLAVPVLLYVSERILRLFRSHDAVRIQKVAVYPGNVLALYMSKPPGFRYRSGQYIFIKCSAVSPYEWHPFSITSAPGDDYLSVHIRTRGDWTSRLRTVFSEACRPPSDGESGLLRADPSKGITETNARFPKLLIDGPYGAPAQDYQEYDVLLLIGLGIGATPLISIVKDVLNHIQLGGSVAGTEPEGSGKAKKRPFMTKRAYFYWVTREEGSFEWFRGVMNEVAEKDKDGVIELHNHCSSVHQEGDVRSALIVMLQELQHAKKGVDILSGTSVKTHFARPNWRSVFKHVAVNHENQRIGVFYCGEPVLVPQLRQLSADFTHKTNTKFEFHKENF

SEQ ID NO: 7598 - protein, 567 aa, Zea mays
MASAALICGTEQWKALQAHVGAIQKTHLRDLMADADRCKAMTAEYEGIFLDYSRQQATGETMEKLLKLADAAKLKEKIEKMFKGEKINSTENRSVLHVALRAPRDAVINSDGVNVVPEVWSVKDKIKQFSETFRSGSWVGATGKPLTNVVSVGIGGSFLGPLFVHTALQTDPEAAECAKGRQLRFLANVDPVDVARSIKDLDPETTLVVVVSKTFTTAETMLNARTLKEWIVSSLGPQAVAKHMIAVSTNLKLVKEFGIDPNNAFAFWDWVGGRYSVCSAVGVLPLSLQYGFPIVQKFLEGASSIDNHFYSSSFEKNIPVLLGLLSVWNVSFLGYPARAILPYSQALEKLAPHIQQLSMESNGKGVSIDGAQLSFETGEIDFGEPGTNGQHSFYQLIHQGRVIPCDFIGVVKSQQPVYLKGETVSNHDELMSNFFAQPDALAYGKTPEQLHSEKVPENLIPHKTFKGNRPSLSLLLPTLSAYEVGQLLSIYEHRIAVQGFIWGINSFDQWGVELGKSLASQVRKQLHGTRMEGKPVEGFNHSTSSLLARYLAVKPSTPYDTTVLPKV

SEQ ID NO: 7599 - protein, 533 aa, Zea mays
  misc_feature (190)..(190): Xaa can be any naturally occurring amino acid
  misc_feature (215)..(215): Xaa can be any naturally occurring amino acid
MALEAAYDYLHVAVVQCTPTQAAAVLGVLLLLAIRLAAAARSSSATSPKWKQHRLPPTPPGKLPIIGHLHLIGSHPHVSFRDLHAKYGHNGLMLVQVGAVPTIVVSTPQAAEAVLRTHDHVLASRPRNPVADIIRYNSTDVAFAPYGEYWRTARKVVNTHLLSAKMVFSKRREREEEVRLVVARIRDARXGAAPPGTALDMTELLGGYASDFVCXRAVLGESHRKQGRNKLFRELTETSAALLGGFNVEDYFPKLADVDLFLRIICAKAKGVSKRWDSLFNELLSEYALSGGKQGDHNSEDFVHLLLSLQKDYRPSAVSVSGVLLNMFEAAIETSFLVLEYSMSELMNNRHVLAKLQKEVRTATPDGRMVMEEDLSRMPYLKATIKESMRIHPPAPFLLPHFSTHDCEINGYTIPAGTRVIVNAWALARDPTCWDKAEEFFPERFLEQGRDAEVDMYGKDIRFVPFGAGRRICAGATFAIATVEIMLANLIYHFDWEMPAEMERTGAKVDMSDQFGMTLRRTQKLYLVPRIPK

SEQ ID NO: 7600 - protein, 242 aa, Zea mays
METAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPAKYEQAKKFGCTD

SEQ ID NO: 7601 - protein, 248 aa, Zea mays
  misc_feature (224)..(224): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTLSEYTVIHVGCLAKINPEAPLDKVCVLSCGISTGLGATLNVAKPKKGSTVAIFGLGAVGLAAMEGAKMAGAAGIIXVVDLNPAKYEQAKKFGCTDFVNPK

SEQ ID NO: 7602 - protein, 248 aa, Zea mays
  misc_feature (230)..(230): Xaa can be any naturally occurring amino acid
  misc_feature (238)..(238): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPXKYEQAKKXGCTDFVNPLD

SEQ ID NO: 7603 - protein, 251 aa, Zea mays
  misc_feature (230)..(230): Xaa can be any naturally occurring amino acid
  misc_feature (236)..(236): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAWASRIIGVDLNPXKYEQAXEFGCTDFVNPKDTVA

SEQ ID NO: 7604 - protein, 353 aa, Zea mays
  misc_feature (225)..(225): Xaa can be any naturally occurring amino acid
  misc_feature (245)..(245): Xaa can be any naturally occurring amino acid
  misc_feature (296)..(296): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGESRFTINGKPIFHFVGTSTFSEYTVIHVGCLAKINPEAPLDKVCVLSCGISTGLGATLNVAKPKKGSTVAIFGLGAVGLAAMEGAKMSGASRIIGXVDLNPAKYEQAKKFGCTDFXVNPKDHTKPVPEVLGEMNNGGSHRPVECTGHLHALIPPHFLSELELKGALXGNYKPRTDLPNVVEMYMKKELELEKFITHSVPFSEINTAFDLMLKGESLRCIMRMED

SEQ ID NO: 7605 - protein, 235 aa, Zea mays
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTISGKPIFHFVGTSTFSEYTVIHVGCLAKINPSAPLDKVCVLSCGISTGLGATLNVAKPKKGFDGGNFRSWSCRPCCHAKGQDGWGIKDHPCGLEPCKYQQA

SEQ ID NO: 7606 - protein, 251 aa, Zea mays
  misc_feature (224)..(224): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGAKMSGASGIIXVVDLNPAKYEQAKKFGCTDFVNPRAHQ

SEQ ID NO: 7607 - protein, 239 aa, Zea mays
  misc_feature (191)..(191): Xaa can be any naturally occurring amino acid
  misc_feature (220)..(220): Xaa can be any naturally occurring amino acid
  misc_feature (230)..(230): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAXPKKGSTVAIFGLGAVGLAAMEGARMAGAXRIFGVDLNPXKYEQAKKFG

SEQ ID NO: 7608 - protein, 172 aa, Zea mays
MHPKARIHADPVREVDHFDCLPDSLVLLILNKVEDVRSLGRCYAVSKRLCGLVPLVHDVYVKIDRVVAVDGDAEDALNLSSPKPRNIFSHFLKLMLFTIIKPFHNMRSPNGTARPLLAQLSQHSPAQVLKNFTHVKNLRIELPFGDLGTGEGSLLEWPTKYWNPPWKWGDPG

SEQ ID NO: 7609 - protein, 159 aa, Zea mays
MLVYQDLLSGDELLSDSFTYKELENGVLWEVEGKWVTQGPVDVDIGANPSAEGGEDESVDDTAVKVVDIVDTFRLQEQPPFDKKSFVSYIKKYIKNLTAVLEPEKADEFKKGVEGATKFLLSKLKDLQFFVGESMKDEASVVFAYYKGWCTNPTFLYFS

SEQ ID NO: 7610 - protein, 942 aa, Zea mays
  misc_feature (282)..(282): Xaa can be any naturally occurring amino acid
  misc_feature (339)..(339): Xaa can be any naturally occurring amino acid
  misc_feature (568)..(568): Xaa can be any naturally occurring amino acid
  misc_feature (608)..(608): Xaa can be any naturally occurring amino acid
MLLHAGPSFLLAPPPRFAAAPSSASPRRSRTPQSSPPTSHFARPADPVAQRVRPVAPRPPMATAEEGASSDVGVAVAESAQGFLLDARAYWVTKSLIAWNISDQKTSLFLYASRNATMCMSSQDMKGYDSKVELQPENDGLPSSVTQKFPFISSYRAFRIPSSVDVATLVKCQLAVASFDAHGNRQDVTGLQLPGVLDDMFAYTGPLGTIFSEEAVSMYLWAPTAQDVSVSFYDGPAGPLLETVQLNELNGVWSVTGPRNRWLTSWLCFIPYRNNKLRLCSXNETLFDIISLKTPMDLSIDERCRINHLYTSMIALSQGIPFFHAGDEILRSKSPTATXDFSAHDSTVDCPFRGGFCAFTFQDSVGIEHLKKLSDAGLTHVHLLPSFQFGGVDDIKSNWKCVDEIELSKLPPGSDLQQAAIVAIQEEDPYNWGYNPVVWGVPKGSYASNPDGPSRIIEYRLMVQALNRLGLRVVMDVVYNHLYSSGPFAITSVLDKIVPGYYLRRDSNGQTENSAAVNNTASEHFMVDRLIVDDLLNWAVNYKVDKARFDLMGHIMKKTMIRAIYNKXCYRGSKIYGTFLYRGKPPYFPGTGIGSFNDRIRDAINGGXPFKNPLQQGFSTGLFLEPNGFYQGNETETRLTLATYADHIQIGLAGNLKDYVVISHTGEARKGSEIRTFDGSPVGYASSPIETINYASAHDNETLFDIISLKTPMDLSIDERCRINHLEPLEPALSQGIPFFHAGDEILRSKSLDRDSYDSGDWFNKIDFTYETNNWGVGLPPREKNEGSWPLMKPRLENPSFKPAKHDIIAALDKFIDILKIRYSSPLFRLTTASDIVQRVHFHNTGPSLVPGVIVMSIEDARNDRHDMAQIDETFSCVVTVFNVCPYEVSIEIPDLASLRLQLHPVQVNSSDALARQSAYDPATGRFTVPKRTAAVFVEPRC

SEQ ID NO: 7611 - protein, 526 aa, Zea mays
  misc_feature (18)..(18): Xaa can be any naturally occurring amino acid
RGEWLNNLRFGVFGLGNXQYEHFNKVGKVVDQLLAEQGAKRIVPVGLGDDDQCIEDDFNAWKELLWPELDKLLRQEDDSSTAPTPYTAAIPEYRVVFVKPEDDMYINKSFALSNGHTVYDIQHPCRANVAVRRELHTPASDRSCIHLEFDIAGTGLKYETGDHVGVYAENCIETVEEAEKLLGYSPDTLFSIYADQEDGTPLCGGSLPPPFPSPCTVRTALTRYADLLNSPKKSALLALAAHASDSKEAERLRHLASPAGKKEYSQWIVTSQRSLLEVMSEFPSAKPPLGVFFAAICPRLQPRYYSISSSPRIAPTRIHVTCALVYGPTPTGRIHKGVCSTWMKHSTPLEDSKDCSWAPIFVRQSNFKLPADPTVPIIMIGPGTGLAPFRGFLQERLALKQAEVELGHAVLFFGCRNRKMDFIYEDELNNFVDAGALSELIVAFSREGPTKEYVQHKMAQKAAELWSIISQGGYIYVCGDAKGMARDVHRTLHTIVQEQGSMDNNSKAESYVKSLQMEGRYLRDVW

SEQ ID NO: 7612 - protein, 154 aa, Zea mays
  misc_feature (135)..(135): Xaa can be any naturally occurring amino acid
MALLKAARVADVPTLDVVVAPGLVAVAKARSAAAVGGRFSVIGHRGKGMNALASEDPRLRDVRENTVRSFNDAGRFPVDYVEFDVQVTKDGCPIIFHDNFIFTQDDGKISQKRVADIQLEEFLQYGLQNEQGKIXDGTMVNWEGQSEDALCTLQ

SEQ ID NO: 7613 - protein, 447 aa, Zea mays
  misc_feature (141)..(141): Xaa can be any naturally occurring amino acid
  misc_feature (256)..(256): Xaa can be any naturally occurring amino acid
MSAAATKVKRRVGKYELGRTIGEGTFAKVRFAKNTETGEPVAVKILDKEKVLRHKMAEQIKREISTMKLIKHPNVVRIYEVMGSKTKVYIVLEYVTGGELFDTIANQGRMREGEARSYFQQLINAVDYCHSRGVYHRDLKXNLLLDSYGNLNVSDFGLSALSQQIKDDGLLHTTCGTPNYVAPEVLEDQGYDGAMADLWSCGVILFVLLAGYLPFEDSNLMTLYKKISNAEYTFPPWTSFPAKRLNLLTRLVEQSXENSCDFRITIPEILEDEWFKKGYKRPEFDEKYDTPLDDVDAVFNDSEEHHVTEKKEEEPVALNAFELISRSAGLNLGNLFDSEQEFKRETRFTSKCPPKEIIRKIEEAAKPLGFGVQKKNYKLRLEKVKAGRKGNLNVATEILQVAPSLHMVQVRKAKGDTLEFQKFYKNLSKTLKDVVWKSEDLQMRAAS

SEQ ID NO: 7614 - protein, 468 aa, Zea mays
TASAVLCAPRTRLVGSSIQLPPDVDQLPILTTKVKRRVGKYELGRTIGEGTFAKVRFAKNTETGEPVAVKILDKEKVLRHKMAEQIKREISTMKLIKHPNVVRIYEVMGSKTKVYIVLEYVTGGELFDTIANQGRMREGEARSYFQQLINAVDYCHSRGVYHRDLKPENLLLDSYGNLNVSDFGLSALSQQIKDDGLLHTTCGTPNYVAPEVLEDQGYDGAMADLWSCGVILFVLLAGYLPFEDSNLMTLYKKISNAEYTFPPWTSFPAKRLLTRILDPNPMTRITIPEILEDEWFKKGYKRPEFDEKYDTPLDDVDAVFNDSEEHHVTEKKEEEPVALNAFELISRSAGLNLGNLFDSEQEFKRETRFTSKCPPKEIIRKIEEAAKPLGFGVQKKNYKLRLEKVKAGRKGNLNVATEILQVAPSLHMVQVRKAKGDTLEFQKFYKNLSKTLKDVVWKSEDLQMRAAS

SEQ ID NO: 7615 - protein, 273 aa, Zea mays
  misc_feature (242)..(242): Xaa can be any naturally occurring amino acid
TRSPPKNPQSAGRHLLPPSSSPLLRRRRWLSFPRARIVPDPNGARPPPPPCLEVNQANIFLTASLLQTGLSLAESAHTTNMETYTTDDALTTMGFGKLQGLVLVYAGMGWVAEAMEVMLLSFVGPLIREEWKISAQDESLLSSVVFLGMLIGACGWGYVSDKYGRRTGLLFSTLFTTGMGFLSALSPNYLCLMALRFLVGVGLGGSHVYSSWFLEFVPAQNRGFWMIIFSFFWTIGTVLEAXLAWIVVSHLTWRWVLALTAIPCFLLLPFFGS

SEQ ID NO: 7616 - protein, 99 aa, Zea mays
MALVRSLLGAKKILGRSLTAAASSTSKTTASAAPKGFLAVYVGESQKKRYVVPISYLSQPSFQALLSKSEEEFGFDHPMGGLTIPCPEDIFINLTSRLQ

SEQ ID NO: 7617 - protein, 404 aa, Zea mays
  misc_feature (217)..(217): Xaa can be any naturally occurring amino acid
  misc_feature (219)..(219): Xaa can be any naturally occurring amino acid
PAGVLQKKKKISNLEVDLPAMTAQKDKAVAGLTKGIEGLFKKNKVTYVKGFGKLSSPSEVSVDLIDGGSTVVKGKNIIIATGSDVKSLPGITIDEKKVVSSTGALCLSEIPKKLVVIGAGYIGLEMGSVWNRLGSEVTVVEFAPDIVPSMDGEVRKQFQRMLEKQKFKFMLKTKVVGCDTSGDDVKLTLEPAAGGEQNILEADVVLVSAGRTPFTSXIXLETLGVETDKAGRILVDKRLKFGTRGVYAIGDAIPGPMLAHKAEEDGVACVEFIAGKEGHVDYGTVPGVVYTHPEVASVGKTEEQVKALGIAYNVGKFPLLANSRAKAIDDAEGVVKVIAEKETDKILGVHIMAPNAGEIIHEAVVALQYGASSEDVARTCHAHPTVSEALKEACLQTFDKAIHI

SEQ ID NO: 7618 - protein, 322 aa, Zea mays
LQNITILMKAVNATADQIYAALLQGNGLSVQQLEALIKMAPTKEEVEKLESYDGDIGSLVAAERLVKVALTIPCAFARVEAMLYRETFADEVIHIRKSFAVLEDACRELMSSKLFLKLLEAVLKTGNRMNVGTARGGAMAFKLDTLLKLADVKGTDGKTTLLHFVVQEMVRSQKPPARAAEGPDIVTGLAAELNNVRKTATVDLDVLTTSVSSLSSGLSRIKALVGTDQLLAGDERGQRFVAFMAPFVSQAEEVIRELEDDERRVLAHVRDITEYYHGDVGKEEASPLRIFVIVRDFLAMLDRVSKEVRGARGCHGSNQTLP

SEQ ID NO: 7619 - protein, 220 aa, Zea mays
PQYRCRNPPRAKVYDGLYCMATRNFKKAASLFLDSISTFTTYELFTYDTFIFYTVLTSVISLDRVSLKQKVVDAPEILAVIGKVPHLSEFLNSLYNCQYKSFFIAFSGLTEPIKLERYLQPHFRYYMREVRTVVYSQFLESYKSVTMEAMAAAFGVTVDFIDQELSRFIAAGKLHCKIDKVAGVLETNRPDARNAFYQATIKQGDFLLNRIQKLSRVIDL

SEQ ID NO: 7620 - protein, 118 aa, Zea mays
RKSRRQYKDVQDGGGEGGGSGRTGEAAAARVRPVETLLRAAPLGLCVAAMTVMLRNQQSNEYGAVAYSDLGGFKYLVYANGLCAAYSLVSAFYTAVPRPATVSRSWLVFLLDQVGSCL

SEQ ID NO: 7621 - protein, 148 aa, Zea mays
GTRLLPGEKKQKTIQRCPRWRRRVRPVETLLRAAPLGLCVAAMTVMLRNQQSNEYGAVAYSDLGGFKYLVYANGLCAAYSLVSAFYTAVPRPATVSRSWLVFLLDQVFTYLILALLPLSASYRLFSAYDAPPSSALGSKGVEIAAYPR

SEQ ID NO: 7622 - protein, 192 aa, Zea mays
  misc_feature (24)..(24): Xaa can be any naturally occurring amino acid
  misc_feature (34)..(34): Xaa can be any naturally occurring amino acid
  misc_feature (48)..(48): Xaa can be any naturally occurring amino acid
  misc_feature (69)..(69): Xaa can be any naturally occurring amino acid
  misc_feature (79)..(79): Xaa can be any naturally occurring amino acid
  misc_feature (87)..(87): Xaa can be any naturally occurring amino acid
  misc_feature (99)..(99): Xaa can be any naturally occurring amino acid
  misc_feature (123)..(123): Xaa can be any naturally occurring amino acid
  misc_feature (160)..(160): Xaa can be any naturally occurring amino acid
MLHYPDLLSGDQLLSDSFTYKELXNGSLRDVERXWVPQGPVDVDIVAXPSSEDDEDQSVDDTAVKAVDXIVDTFRLQDXPPFDKKSXESYIKKYIKNLXAVLQPEKENESRKGVEGATKFLLXQLKDLQLFVGESMKDDASVTIRLLLVMRAANPTFLYXSHALKETQGYVCGDKYLPMSGTIYALLLCPRL

SEQ ID NO: 7623 - protein, 243 aa, Zea mays
MISPDAARNVVGIIGNVISFGLFLSPVLTFWRICKARDVEEFKPDPYLATLLNCMLWVFYGIPVVHPNSILVVTINGVGLVIEAIYLTIFFLYSDGPKRRKAFGILAVEILFMVAVVLGVILGAHTHEKRSMIVGILCVIFGSMMYASPLTIMSRVIKTKSVEYMPFLLSLVSFLNGCCWTAYALIRFDLYVTIPNALGAFFGLIQLILYFCYYKSTPKEKNVELPTVSSNAGGGNVTVSVER

SEQ ID NO: 7624 - protein, 490 aa, Zea mays
  misc_feature (264)..(264): Xaa can be any naturally occurring amino acid
MSMDYLAAAVPVTLALGVGSILLVLRWTYCRRRTSAEEVRLPPGSRGLLFLGETLHYLAASSTPGVLPPFFQRRLERYGPIFRTNLVGEDLVVSLDAELNAHVLKQEERGFQIWYPPSFMRVFGADNITAKLGVLHHYMRTLVLRLFGHQTVRSVLLHDVQRSARDELRSWLGRPDVEVRTATSRMIFGVTAKKLISHDDAASGETLWRCFHDWTSGLLSFPVSIPGTTFYRCMQGRKKVMTMLKQQLVERRRNAAERETEDFXDLVIDELNKPDPMMDESTALDLLFTMLFASHETTSMVLTVILKYLTDNPKALQELTEEHERILESRANPGSDLTWEEYKSMKFTSHVVHESLRLANIALAMFRKANQDVHINGYTIPKGSKIMMCPLASHLNTEVYEDPSVFNPWRWKDIPEPVGTSKDFMAFGGGLRLCAGADFSKMQMAMFLHYLVTNYRWKPVGGGTMLFYPGLQFPEGFHIQLLPKIPNVVP

SEQ ID NO: 7625 - protein, 212 aa, Zea mays
  misc_feature (93)..(93): Xaa can be any naturally occurring amino acid
SSRTRVSVSLPTWAEFELGRAPVYWKTSNGLPSSPGEGLTLFYNPAASKMAPNDVFGVAFNGGFNQPIMCGGEPRQMTLQVRGKADPPIYTIXIRVPQHAVSLIFSFTNGAEWDGPYTLKFRVPKPWQNKPLSFFNEGLADELNREGACDLAIYPDENIAITSCAMDGYLEEGGDRCKLDIVSGCTDPSSDMFDPLATVDDGSCPLESDSEE

SEQ ID NO: 7626 - protein, 495 aa, Zea mays
MESAALSRIGLAGLAVMGQNLALNIAEKGFPISVYNRTASKVDQTVDRARNEGSLPLTGQYTPRDFVLSLQRPRSVIILVKAGSPVDHTIAALSDHLDPGDCIIDGGNEWYENTERRMNLVADKGLLYLGMGVSGGEDGARHGPSLMPGGSHHAYSNVQDILHKIAAQVEDGPCVTYIGEGGSGNFVKMVHNGIEYGDMQLISEAYDVLKHVGGLSNSELAEIFVEWNRGELESFLIEITADIFKVKDEDGEGFLVDKILDKTGMKGTGKWTVQQAAELSIAAPTIAASLDCRYLSGLKEERESAAAVLKEAGLSDELGRVNVSGVDKKRLIDDVRQALYASKICSYAQGMNLLRAKSNEKGWNLNLGELARIWKGGCIIRAVFLDRIKKAYQRNPNLASLIVDPEFAREMVQRQAAWRRVVGLAVSAGISTPGMCASLAYFDTYRRARLPANLVQAQRDLFGAHTYERVDRPGAFHTEWTKLARNSGAGVGALN

SEQ ID NO: 7627 - protein, 508 aa, Zea mays
  misc_feature (376)..(376): Xaa can be any naturally occurring amino acid
MASNGCNGNGNGKAAPAGVVVPEIKFTKLFINGEFVDAASGKTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVQAARSWKVGDPFDVTSNMGPQVDKDQFERVLKYIEHGKSEGATLLTXGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 7628 - protein, 160 aa, Zea mays
  misc_feature (45)..(45): Xaa can be any naturally occurring amino acid
  misc_feature (60)..(60): Xaa can be any naturally occurring amino acid
  misc_feature (91)..(91): Xaa can be any naturally occurring amino acid
  misc_feature (150)..(150): Xaa can be any naturally occurring amino acid
MAGGGVDVGVEGDEKLGRKTLQCEHEVLYFDVHDNACGRYCLDLXEKTSATCSTIIASVXHGASCLLDLFDYYIRTDDRDGFRKEVRVHTXAIYFDIGENHMSRFAAGLRGLLSMRNRQIPYIVPAGSSDDKGWEAFTSVLLDIYNDATXMRVLPNHPRP

SEQ ID NO: 7629 - protein, 157 aa, Zea mays
MAAGRGLPLLLVLAALLVGLASASSFISDGVFQAGAGSTTGRTLLQAKRDCPVNFEFQNYTVITSRCKGPKYPPKDCCDSFKEFACPFNNYINDESNDCASTMFSYINLYGKYPPGLFAHECREGKLGLSCEGVPQKDVVASGVQRARSSSLALITL

SEQ ID NO: 7630 - protein, 337 aa, Zea mays
MGKDDVVQSGAGGGEFAAKDYTDPPPAPLVDAAELGSWSLYRAVIAEFIATLLFLYVTVATVIGYKHQTDASASGATADAACGGVGVLGIAWAFGGMIFVLVYCTAGISGGHINPAVTFGLFLARKVSLVRALLYMVAQCLGAVCGVGLVKAFQSAYFDRYGGGANSLASGYSRGAGLGAEIVGTFVLVYTVFSATDPKRNARDSHVPVLAPLPIGFAVFMVHLATIPVTGTGINPARSLGAAVVYNKDKPWDDHWIFWVGPLLGAAIAAFYHQYILRAGAIKALGSFRSNASVAFVPACVMSRAKERPSLDCVLEQRRSIDLAWGEADRRAREGGE

SEQ ID NO: 7631 - protein, 340 aa, Zea mays
  misc_feature (87)..(87): Xaa can be any naturally occurring amino acid
MTVGDDAAAPGRGQTVCVTGAGGYVGSWIVKLLLERGYAVRGTVRNPDDAKNAHLLALPGAAERLALCKADLLDYGALRAAVAGCHXVFHAASPVTDDPEEMVEPAVRGTRYVIDAAAEAGTVRRVVLTSSIGAVAMDPRREPDAVVDESCWSDLDFCKKTKNWYCYGKAAAERAAWEAAAARGVDLVVVVPVLVQGPALQPSVNASLMHVLKYLNGSAKTYANAVQAYVHVRDAADAHVRVFEAPRAAGRYICADAVLHREDVVRTLRKSFPGYPVPERCSDEVNPRKQPYKISNQRLRELGLEFTPAAQALYDTVVCFQEKGILPLPVPAPTPASPDA

SEQ ID NO: 7632 - protein, 341 aa, Zea mays
  misc_feature (237)..(237): Xaa can be any naturally occurring amino acid
MTVGDDAAAPGRGQTVCVTGAGGYVGSWIVKLLLERGYAVRGTVRNPDDAKNAHLLALPGAAERLALCKADLLDYGALRAAVAGCHGVFHAASPVTDDPEEMVEPAVRGTRYVIDAAAESGTVRRVVLTSSIGAVAMDPRREPDAVVDESCWSDLDFCKKTKNWYCYGKAAAERAAWEAAAARGVDLVVVVPVLVQGPALQPSVNASLMHVLKYLNGSAKTYANAVQAYVHVRDAAXDAHVRVFEAPRAAGRYICADAVLHREDVVRTLRKSFPGYPVPERCSDEVNPRKQPYKISNQRLRELGLEFTPAAQALYDTVVCFQEKGILPLPVPAPTPASPDA

SEQ ID NO: 7633 - protein, 332 aa, Zea mays
  misc_feature (197)..(197): Xaa can be any naturally occurring amino acid
MMGGFLSRVLLLAFGYAYPAYECYKTVELNKPEIAQLIFWCQYWILVALLTVLERFGDFTISWLPFYSEAKLMFFVYLWYPKTKGTTYVYGTFFKPYISQHENEIDRNLLELRARATDTVVLYFQKAASAGQSTFFDVLKYVAAQSPSQKSRQRLHQDSQQPPQQQQPQVQVQQAQPQKQAAPVMRRASSIAARQAXMAQQSQETKPVSSSPKIKRQTSARSGSVASTKPPVAASALKPGGSPKKGEVKPAADPVQTPTTGADSPKPEPSAPSLPGAEGVDKMAIDEASGDAPEGAEELDPALEEETPMEETIRVTRAKLRRRTATEDPAGN

SEQ ID NO: 7634 - protein, 72 aa, Zea mays
  misc_feature (48)..(48): Xaa can be any naturally occurring amino acid
MGFGASFVRFSRFYRQSKEVEREASNADREHGAESDSEEERRRRKAKXFGKSRAPERSSFKGAPPSKKPKFR

SEQ ID NO: 7635 - protein, 247 aa, Zea mays
  misc_feature (76)..(76): Xaa can be any naturally occurring amino acid
  misc_feature (100)..(100): Xaa can be any naturally occurring amino acid
  misc_feature (197)..(197): Xaa can be any naturally occurring amino acid
VPRGRPGPPGSSEPSKSKPSPRRIAAAGSASLDPDPGDMPRNDDRYGNTRLYVGRLSPRTRSRDLEYLFSKYGRFXSVFYTTMEVWWKGALDGIGGHSSXIREVELKRDYAFIEFSDPRDADDAQYNLDGRDVDGSRIIVEFAKGVPRGSGGSRDYNGRGPPPGTGRCFNCGVDGHWARDCQAGDWKNKCYRCGERXHIERNCQNSPRNLRRERSYSRSPSPRRGRGRSRSYSRSRSYSRSRSPSIS

SEQ ID NO: 7636 - protein, 320 aa, Zea mays
LSPPRIVGHSPKSKPSPRRIAAAGSASLDPDPGDMPRNDDRYGNTRLYVGRLSPRTRSRDLEYLFSKYGRIREVELKRDYAFIEFSDPRDADDAQYNLDGRDVDGSRIIVEFAKGVPRGSGGSRDYNGRGPPPGTGRCFNCGVDGHWARDCQAGDWKNKCYRCGERGHIERNCQNSPRNLRRERSYSRSPSRSLSYSRSASPRRSVSPVKEKERSRTPDGSRSPSPRDKVSPPPKDNGAHNGSDREDSPGGREMSKRSRSSSDGYRSPVGNGRSPSRSPSPKVNNGDDPSPKGNNGDDPSPKGNNGDDEHRGSPRGSQSP

SEQ ID NO: 7637 - protein, 206 aa, Zea mays
  misc_feature (21)..(21): Xaa can be any naturally occurring amino acid
  misc_feature (54)..(54): Xaa can be any naturally occurring amino acid
  misc_feature (116)..(116): Xaa can be any naturally occurring amino acid
  misc_feature (135)..(135): Xaa can be any naturally occurring amino acid
MMVHHDLLSGDELLPDSFTYXELENGVLRELQAKCCTQGPVDVDIGANPSAAGXMRTRAFDDTAAKEADIADTFRLHELPPFDKKSFVSYIRKYIKNLLLVCSSQRRRMISTRDVXGATKYLLSKLKDHRNYLVXESMKDDASEVFCYYKDAATKPTFLYFSHGLNDIKCYACGEIIYPCGYTIYVTSIICKTIVGLAELNSKGLD

SEQ ID NO: 7638 - protein, 354 aa, Zea mays
  misc_feature (67)..(67): Xaa can be any naturally occurring amino acid
HPASSEPSKSKPSPRRIAAAGSASLDPDPGDMPRNDDRYGNTRLYVGRLSPRTRSRDLEYLFSKYGXGFSVFYTTMEMMKLQVNVFEYFDSRQLIVCGNHFRRIREVELKRDYAFIEFSDPRDADDAQYNLDGRDVDGSRIIVEFAKGVPRGSGGSRDYNGRGPPPGTGRCFNCGVDGHWARDCQAGDWKNKCYRCGERGHIERNCQNSPRNLRRERSYSRSPSRSLSYSRSASPRRSVSPVKEKERSRTPDGSRSPSPRDKVSPPPKDNGAHNGSDREDSPGGREMSKRSRSSSDGYRSPVGNGRSPSRSPSPKVNNGDDPSPKGNNGDDPSPKGNNGDDDEHRGSPRGSQSP

SEQ ID NO: 7639 - protein, 228 aa, Zea mays
VLDSCQQLTVCGNYLRRIREVELKRDWKNKCYRCGESGHIERNCQNSPRNLRRDKSYSRSPSPRGGRGRSRSYSRSRSYSRSRSPSGSPRGGRRERDERRSRSLSYSRSASPRRSVSPAKEKERSRTPNGSRSPRSPSPRAEVSPPLKDNGARNGSDHEGNPGGGENSKRSRSPSDGYRSPVANGRSPSPRDDRSPSPKGNDRSPSPKGNNEDDERRGSPRGSQSPLN

SEQ ID NO: 7640 - protein, 351 aa, Zea mays
  misc_feature (30)..(30): Xaa can be any naturally occurring amino acid
  misc_feature (62)..(62): Xaa can be any naturally occurring amino acid
YGNTRLYVGRLSPRTRSRDLEYLFSKYGRXFRCFYTTMEVWWKGALDGIGGHSSNVCGGLWXRAPLVIREVELKRDYAFIEFSDPRDADDAQYNLYGRDVDGSRIIVEFAKGVPRGSGGSRDYNGRGPSPGTGRCFNCGVDGHWARDCQAGDWKNKCYRCGERGHIERNCQNSPRNLRRERSYSRSLSPRRGRGRSRSYSRSRSYSRSRSPSGSPRGGRRDRDERRSRSLIYSRSASPRRSVSPVKEKERNRTPNGSRSPSPRAEVSPPLKDNGARNGSDHEGSPGGGENSKRSRSPSDGYRSPVANGRSPSPRDDRSPSPKGNDRSPSPKGNNEDDERRGSPRGSQSPLN

SEQ ID NO: 7641 - protein, 559 aa, Zea mays
MGSSGFSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPNANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILNAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 7642 - protein, 561 aa, Zea mays
  misc_feature (55)..(55): Xaa can be any naturally occurring amino acid
  misc_feature (160)..(160): Xaa can be any naturally occurring amino acid
MGSSGFSWTLPDHPKLPKGKPVAVVVLDGWGEANPDQYNCIHVAQTPVMDSLKNXGAPEKWRLVKAHGTAVGLPSDDDMGNSEVGHNALGAGRIFAQGAKLVDQALASGKIYDGDGFNYIKESFESGTLHLIGLLSDGGVHSRLDQLQLLLKGVSERGAXKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 7643 - protein, 560 aa, Zea mays
  misc_feature (55)..(55): Xaa can be any naturally occurring amino acid
MGSSGFSWTLPDHPKLPKGKPVAVVVLDGWGEANPDQYNCIHVAQTPVMDSLKNXGAPEKWRLVKAHGTAVGLPSDDDMGNSEVGHNALGAGRIFAQGAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 7644 - protein, 558 aa, Zea mays
  misc_feature (223)..(223): Xaa can be any naturally occurring amino acid
  misc_feature (232)..(232): Xaa can be any naturally occurring amino acid
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLLLKGVSERGAKKIRVHILTDGRDVLDGSSVGFVETLENDLLELRGKGIDAQIASGGGRMYVTMDRYENDWDVVKRGWXDAQVLGEAXPYKFKSALEAVKTLRAQPKANDQYLPPFVIVDDSGKAVGPVLDGDAVVTINFRADRMVMLAKALEYADFNNFDRVRVPKIRYAGMLQYDGELKLPSRYLVSPPEIDRTSGEYLVKNGIRTFACSEAVKFGHVTFFWNGNRSGYFDETKEEYVEVPSDSGITFNVAPKMKALQIAEKARDALLSGKFDQVRVNLPNGDMVGHTGDIEATVVACKAADEAVKIILDAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 7645 - protein, 416 aa, Zea mays
MAMSASSSSRALLRRIGGALLRRSFSSSSAAAAAGYHVAGGPSYMRGAVFWEPGRPLTLEEFRMPRPKAGELLIKTKACGVCHSDLHVLKGELPFSTPCVVGHEITGEVVDHGTHTPAEIINRFPVGSHVVGAFIMPCGNCFYCVKGQEDLCESFFAYNRAKGTLYDGETRLFLRGNGKPVYMYSMGGLAEYCVVPANALAVLPDSLPYTESAILGCAVFTAYGALRHAAEMRPGDSVAVIGVGGVGSSCLQIAKAFGASQVIAVDVLDEKLQNATTLGATHTVNAAKADAVERIKEITDGRGVDVAIEALGKALTFSQCAKSVRDGGKAVMIGLAATNVMGEVDITRLVRRQVKIIGSYGARARQDLPQIVKLAESGAFNLQNTISRKCKFEEANGAYEDLNQGKIVGRAVVEIM

SEQ ID NO: 7646 - protein, 419 aa, Zea mays
RYYSDTDSVSACIDNAMRALFLLALFCVVHGEKAKSKDNDAKASGPGGSFDITKLGASGNGKTDSTKAVQEAWASACGGTGKQTILIPKGDFLVGPLNFTGPCKGDVTIQVNGNLLATTDLSQYKDHGNWIEILRVDNLVITGKGKLDGQGPAVWSKNSCVKKYDCKILPNSLVMDFVNNGEVSGITLLNSKFFHMNMYKCKDMLIKDVNVTAPGDSPNTDGIHMGDSPGVTITNTVIGVGDDCISIGPGTSKVNITGVTCGPGHGISIGSLGRYKDEKDVTDINVKDCTLKKTANGVRIKAYEDAASVLTASKIHYENIKMEDSGYPIIIDMKYCPNKLCTANGASKVTVKDVTFKNITGTSSTPEAVNLLCSAKIPCTGVTMDDVNINYSGTNNKTMAVCKNAKGSAKGCLKALACF

SEQ ID NO: 7647 - protein, 208 aa, Zea mays
  misc_feature (78)..(78): Xaa can be any naturally occurring amino acid
  misc_feature (104)..(104): Xaa can be any naturally occurring amino acid
MAAAAAAARRLLSRRASSNSLSAFLRRGAAPEQSLLRPAVVAAASRLGYGAGRDSRAQPTEMAPLFPGCDYEHWLIVXMDKPGGEGATKQQMIDCYIQTLAKVXLGSEEEAKKKIYNVSCERYFGFGCEIDEETSNKLEGLPGVLFVLPDSHVDAACKDYGAELLVNGEIVQRPPERQRRVEPVPQRAADRPRYNDRTRYARRRENQR

SEQ ID NO: 7648 - protein, 188 aa, Zea mays
RLLSRRASSNSLSAFLRRGAAPGQSLLRPAVVAAASRLGFPRGMARRPGGDDYEHWLIVMDKPGGEGATKQQMIDCYIQTLAKVLGSEEEAKKKIYNVSCERYFGFGCEIDEETSNKLEGLPGVLFVLPDSYVDPEYKDYGAELLVNGEIVQRPPERQRRVEPVPQRAADRPRYNDRTRYARRRENQR

SEQ ID NO: 7649 - protein, 187 aa, Zea mays
SARAPTRAEVADVSEAVRQRADALMLSGESAMGRYPDKALSVLRSVSLRIEKWWREEKRHEALELRSVSSSFSDKISEEICNSAAKMANGLGVDAVFVFTKTGHMASLLSRCRPDCPVFAFTTSTSVRRRLNLQWGLIPFRLAFSDDMESNLNRTFSLLKARGMIQSGDLVIALSDMLQSIQVMNVP

SEQ ID NO: 7650 - protein, 1081 aa, Zea mays
  misc_feature (289)..(289): Xaa can be any naturally occurring amino acid
  misc_feature (821)..(821): Xaa can be any naturally occurring amino acid
  misc_feature (953)..(953): Xaa can be any naturally occurring amino acid
METSISPPGTSKQSAVRKPSPGSSLKDLCLVSKQGSIAEVESALALLKKSGGNIDGRNAFGLSALHLATWRNHLPIVRRLLDAGADPDARDGESGWSSLHRALHFGHLCIAGVLLQFGASLALEDTKGRTPVDLISCPVSQANGDFPDAVATEVFSWGSGTNYQLGTGNAHIQKLPCKVEALHGSYIKTVAASKFHSVAVSSNGELYTWGFGRGGRLGHPDIHSGQTTAVITPRQVTVGLGRKRVNAVAAAKHHTVIATELGELFTWGSNREGQLGYPSVDTQPTPRRXVGSLKQRIISVAAANKHSAAVADTGEVFTWGCNKEGQLGYGTSNSASNCIPRMVEYLKGKVLRGVSAAKYHTIVLGADGEVFTWGHRLVTPRRVVVARCLKKGGNTNLKFHRMERLQVISVAAGTTHSTALTADGALFYWVSSDPDLKCQQIFSMCGRNIVNISAGKYWTAVATSTGDVFMWDAKKRKDETPIFTRVHGVKRATFVCVGETHMLVLSSIYHPEYPPKPKSQGLKSMLEWNGGTEELGEDILFDDVQPNSGLSGSSGEMSKGVPSLKSLCEKVAVEYLLEPKNAIQLLEIADSLEAKELKKHCEDLAIRNLDYIFTVGASSIMNASSEILVNLEKLLDEKSSEPWSQRRLPTMTATYPAVIDSDVEEDEAREFPKTRKCGKSASRPSAMSSDDSFLQKDCTAEQAVSKQIRALRKKLQQIEILEAKQLAGHQLDSQQVAKLESRAALEGELAELGIPSEIYSTSSACPAEGRTNRKPEVSKKQKRKNKQSTQTPSVKNEPGQQIPITELQVLQVNVSAEKGGXPLHPIKPMEAAAFSNTKDTASPPEKKPSQPTPSKKKNRKGGLSLFLSGALDDTPKPSLPAPAVPATPKPEGPAWGGVKITKGPASLRDIQTEHSRTNEPASAKAKDRHENSPDSAGRATRLSLFIPDARSNXVPSWAPARAAAAAPSSEGDRSTPPWSSSATSPNVSQPSLRDIQQMQQKRHHGGVSHSPKTQTSGFSIPPHSGAPEAAGGGGVKDNVPNRWFRPETDAPSSIRSIQIEEQAMKDFRRFYSSVRIVKPQV

SEQ ID NO: 7651 - protein, 231 aa, Zea mays
MHSTNLLLEEPIRMVSILEPSKPNFFPAMTKIVGTLGPKSRSVEAISACLKAGMSVARFDFSWGDAAYHQETLENLKLAIKATKKLCAVMLDTVGPELQVVNKSEVTISLEENESVVLTPHKGQEASSKLLPINFAGLARAVKPGATIFVGQYLFTGSETTSVWLEVSEVQGDDVVCVIKNSATLAGSLFTLHCSQIHIDMPTLSDEDKDVMKKWGAPNKIDFLSLSLYRH

SEQ ID NO: 7652 - protein, 227 aa, Zea mays
  misc_feature (185)..(185): Xaa can be any naturally occurring amino acid
MHSTNLLLEEPIRMVSILEPSKPNFFPAMTKIVGTLGPKSRSVEAISACLKAGMSVARFDFSWGDAAYHQETLENLKLAIKATKKLCAVMLDTVGPELQVVNKSEVTISLEENESVVLTPHQGQEASSKLLPINFAGLAKAVKPGATIFVGQYLFTGSETTSVWLEVSEVQGDDVVCVIKNSATXLAGSLFTLHCSQIHIDMPTLSDEDKDVMKKWGAPNKNDFLSL

SEQ ID NO: 7653 - protein, 211 aa, Zea mays
AGARCLILTPTISSSSAALRLPRIARRRPLSCSASPLAVFATMDSPPEGYRTNVGICLADPSLTKIFSASRIDIPTAWQMPQGGIDPGEEPRAAAVRELREETGVRSAEIVAEAPNWLTYDFPADVKDKLNARWGTNWKGQAQKWFLFRLTGGDEEINLMGDGSEKPEFSEWAWMTPQQVIEKAVDFKKPVYEETLKHFAPYLQSDPTASS

SEQ ID NO: 7654 - protein, 326 aa, Zea mays
VDLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTDCVMLSGETAAGAYPELAVQTMAKICLQAESCVDHAAIFKSIMASAPIPMSPLESLASSAVRTANSARAALILVLTRGGTTARLVAKYRPSMPILSVVVPELKTDSFDWACSDEGPARHSLIVRGVIPMLSAATAKAFDNEATDEAIGFAIENAKTMGLCNTGQSVVALHRIGISSVIKLLTVK

SEQ ID NO: 7655 - protein, 488 aa, Zea mays
  misc_feature (47)..(47): Xaa can be any naturally occurring amino acid
MAPPQTIPRRGLFIGGAWREPCLGRRLPVVNPATEATIGDIPAGTAXRHWSRAPGAVRANFLRAIAAKIKDRKSELALLETLDSGKPLDEASGDMDDVAACFEYYADLAEALDGKQQSPISLPMENFKSYVLKEPIGVVGLITPWNYPLLMATWKVAPALAAGCTTILKPSELASVSCLELGAICMEIGLPPGVLNIITGLGPEAGAPLSSHSHVDKVAFTGSTETGKRIMISAAQMVKPVSLELGGKSPLIVFDDIGDIDKAVEWTMFGIFANAGQVCSATSRLLLHEKIAKKFLDRLVAWAKNIKVSDPLEEGCRLGSVISEGQYEKIKKFISTARSEGATILYGGGRPQHLRRGFFLEPTIITDVSTSMQIWQEEVFGPVICVKEFRTESEAVELANDTHYGLAGAVISNDQERCERISKALHSGIIWINCSQPCFVQAPWGGNKRSGFGRELGEWGLDNYLTVKQVTKYCSDEPWGWYQPPSKL

SEQ ID NO: 7656 - protein, 153 aa, Zea mays
MKIQKANAGVLTNFEVLDFLRSRGAKIDPMGCLGAVAVSECKVYEYILKTPACNQTRESIYEFVKRSEGFRLAEADKLNVINWRPSSAADAYAMIEECGKRFSRDERGEACDEDERVQEFLDMVKEVLPAPPKAEVETAEAVEAEAEVEAMQE

SEQ ID NO: 7657 - protein, 127 aa, Zea mays
  misc_feature (8)..(8): Xaa can be any naturally occurring amino acid
  misc_feature (50)..(50): Xaa can be any naturally occurring amino acid
YAKDRPIXFSSLSAPYADATSCVKLQGTYPVYFLDETEGRSYYSDVRRNXLEEADKLCLAGGLQGIVSEALSIFRHPAAVPKIKEANLSLLTYGTLNKVPVVAYINRYMGLNWVIACLVLHVTEAFS

SEQ ID NO: 7658 - protein, 139 aa, Zea mays
  misc_feature (26)..(27): Xaa can be any naturally occurring amino acid
  misc_feature (91)..(91): Xaa can be any naturally occurring amino acid
  misc_feature (102)..(102): Xaa can be any naturally occurring amino acid
MSKSVVPAVVMKRNAALLAEMRGRIXXEIRKLEDKIADADENLDESEVRESHLGKSVYFIRDGEKENVLEQIKVTEGKTVTVEQKMDLVFXTLQIGFFYMEXDLISKSIDKAKNLFEEGGDCETNNRLQVYEGLYCMAT

SEQ ID NO: 7659 - protein, 127 aa, Zea mays
PAGLQMQKYGATGWLVNTGWSGGRYGVGKRIRLPYTRKIIDAIHSGELLTANYQKTEVFGLEIPTEINGVPSEILDPINTWTDKAAYKENLLRLGGLFKKNFEVFASYKIGDDSSLTDEILAAGPNF

SEQ ID NO: 7660 - protein, 142 aa, Zea mays
LYGPRVKFDRGPSLAFNVFDWKGERVSPLLVQKLADRHNISLTCGFLCNIWFSDKHEAERAVVLEHRVAGDPVAAGSAGGKRRKDAGGGDVGILVVNASLGFLSNFEDAYRLWAFVAKFLDADFVEKERWRYTALNQKTVEV

SEQ ID NO: 7661 - protein, 206 aa, Zea mays
TLGQDLPDGNLRSLQKKGNVNKDSFSKVMWYAVINYRTWIFVLLYGYCMGVELTTDNVIAEYMYDRFDLDLRVAGTIAACFGMANLVARPMGGIMSDIGARYWGMRARLWNIWILQTAGGAFCLWLGRASTLPVSVVAMVLFSFCAQAACGAIFGVIPFVSRRSLGIISGMTGAGGNFGAGLTQLLFFTSSTYSTGRGLEYMGIMI

SEQ ID NO: 7662 - protein, 499 aa, Zea mays
  misc_feature (173)..(173): Xaa can be any naturally occurring amino acid
MTSKGTRPWSRLSEAETAVNRAVAGSRVGRYFKLDARKSSFTKELRAGAATFLTMAYIISVNAAVLTDSGGPCTVRDCTPVPTNSTVAATPPGPECTVAGANNPGYQQCLARTKSDLVVATAVAAMAGSFAMGLFANLSLALAPGMGANAYFAYNMVGFHGSGPIGYSTALEXLQAHQGVGLVGASPSTLVTLTACSDVDTVTGACLGGTMRSPTFWLGAVGFLITATCLARDVKGSMIFGMLFVTVVSWIRGTSVTMFPDTPVGNAGFAYFKKVVDFHMIRNTAGQLSFGGFRHGNVWLALLTLLYVDVLDTTGTMYSMAEYGGFTDGAGGGFEGEYRAFLVDAGSTVLSAGLGSSTVTTYIESTAGIREGGRTGLTAITVAACFLASLFFGPLLMSVPPWAVGPSLVLVGAMMMRVAKDIEWGDMKEGVPAFVTMALMPLSFSIANGIIAGLGVYVALHWYDWARHGYGKVRNALDERRNQVAAAAGEVGPAAQDVV

SEQ ID NO: 7663 - protein, 222 aa, Zea mays
RGVKCLYTLQKEKSIRKCSNKPETLLTRKNAPNYSTVTRLLPHAGLAWLSIIAFKNKDNLGGDKLVTVEDIVRQHWATYGRHYYTRYDYENVDAGAAKELMANLVSMQSSLSDVNKLVKEIRSDVSEVVAADEFEYRDPVDGSVSKHQGIRYLFGDGSRLVFRLSGTGSVGATIRVYIEQYERDSSKTGRDSQDALAPLVGVALKLSKMQEYTGRSAPTVIT

SEQ ID NO: 7664 - protein, 168 aa, Zea mays
  misc_feature (53)..(53): Xaa can be any naturally occurring amino acid
MLTYRDLLSGDELLSDSFYYKELENCVLMEGPGRVDLRRGTVDVDIVVNPSAXGDAYESDDEQGENEYDIVDTFRVHEKTSFDQKTFVSYIPKYLKNLAAVVQPNKADEFNKGVEGANKFLLSQLNDLQIFVVDSMNDDASVVFGYYKDGATNPTFLYFSHGLKEIKR

SEQ ID NO: 7665 - protein, 185 aa, Zea mays
  misc_feature (106)..(106): Xaa can be any naturally occurring amino acid
AYHSFLGEPISCHAWDKDRTQIAICPNNHEVHIYEKSGNKWVQVHELKEHNGQVTGIDWAPDSNRIVTCGTDRNAYVWTLKGRTWKPTLVILRINRAARCVRWAPXEKKFAVGSGSRVISICYFEQENDWWVCKHIKKPIRSTVLSLDWHPNSVLLAAGSCDFKCRIFSAYIKEVEERPAPTPWG

SEQ ID NO: 7666 - protein, 171 aa, Zea mays
MQGGGGGVDQPPMQMVLRVRHPSSLGGSGADEDDSEGSSRSALSVFKAKEEQIERRKMEVREKVFAHLGRVEEESKRLAFIRQELEGMADPTRKEVESIRKRIDTVNRQLKPLSKSCVKKEKEYKEVLEAYNEKSKEKALLVNRLIELVSESERMRMKKLEELNKTVDSLY

SEQ ID NO: 7667 - protein, 151 aa, Zea mays
MCSVRFHQFHHEIRLYKSFLGVPSLSCASPDGTKRQTLLRSLLLVLTPQSEREGHPEEPVVLIGVSLPPFPRGENNLEKMAPISGATAVLVMAVVATLAAAANALAPAPAPATSDGTSVDQGIAYVLMLVALVLTYLIHPLDASSAYKQLF

SEQ ID NO: 7668 - protein, 227 aa, Zea mays
MAIRRQRRSFPLVPFLVSLLAVAAYGRLISDGMPATPSSSVLASPLSSAAIRLNSSSPATAAAEECEQTYGFLPCTTTVFGNMFLVLTYGFLMFKAATFLSAGSELLLEIMGPGLVGGLLLPILGALPDALLVLVSGLSGTKETAQSQVLIGMGLLAGSTVFLLTLLWGTCVVGGKCDVGEDGDDIDPTEADGFKLSGSGITPDAQTSYAARVMAVSVNTLWLCLIP

SEQ ID NO: 7669 - protein, 246 aa, Zea mays
  misc_feature (202)..(202): Xaa can be any naturally occurring amino acid
  misc_feature (221)..(221): Xaa can be any naturally occurring amino acid
MGRQFFVGGNFKMNGSIKSITDIVENLNKGKLDPNTEVVIAPPALYLLLTREHLRKGLEVAAQNIFDKPNGAFTGEISAEQLKDSGITWTLVGHSERRQILQENDDFIANKTKTATDNGLGVILCCGESLEQREAGETVSVVTKQLKAVADKVKDWSKIVVAYEPIWAIGTGKVATTEQAQEVHAALREWLKKEVSPEASEXARILYGGRVSEKTATSLPXEANIDGFLVGGASLKPAFVDIITLT

SEQ ID NO: 7670 - protein, 48 aa, Zea mays
MQVSAVGVTGARSNVNLRVEHLLREIKKVTDKPVAVGFGVSTPEHVKQ

SEQ ID NO: 7671 - protein, 232 aa, Zea mays
MFRSLAPRAAQRASRPVTRSTFCASNIYFQNRLRRGYASEAEEKDLVIIGGGVAGYVAAIKAGQAGMKVTCIEKRGSLGGTCLNVGCIPSKSLLNNSHLYHQILHDTKGRGIEVGDVKLNLPAMMKAKESSVSGLTKGIEFLFKKNNVEYIKGTGAFQDEHTIAVNLTEGGETTVRGKNILIATGSEATPFPGLTIDEQKVITSTGAIALQEVPKKMTVIGGGIIGLEMASV

SEQ ID NO: 7672 - protein, 202 aa, Zea mays
  misc_feature (48)..(48): Xaa can be any naturally occurring amino acid
  misc_feature (97)..(97): Xaa can be any naturally occurring amino acid
  misc_feature (124)..(124): Xaa can be any naturally occurring amino acid
  misc_feature (139)..(139): Xaa can be any naturally occurring amino acid
  misc_feature (154)..(154): Xaa can be any naturally occurring amino acid
  misc_feature (191)..(191): Xaa can be any naturally occurring amino acid
MNTTHAMEQVDDGQHTQEGVSTERAFEADPIPSLSETITARAIAASFXLGVALCAVAMKISLNSGFLPSLTVPAGLVGFYLVRAWIRAPRLLPPGAXQLPFTRQENTVIQTCVVACSAITFSGXGLAHYVLALSKTAAXEDVRGRKNIVEPSIXRTVAFLFLVSFSGMFILMPFRKVMIIRHRLTYPYGMXHGALINSFHTP

SEQ ID NO: 7673 - protein, 508 aa, Zea mays
  misc_feature (242)..(242): Xaa can be any naturally occurring amino acid
MVSERQQAAGKVAAFNLTEAGFGDGSDLLDDDGRERRTGTLVTASAHIITAVIGSGVLSLAWAIAQLGWVIGPVVLLAFSAITWFCSSLLADCYRAPPGPGQGKRNYTYGQAVRSYLGESKYRLCSLAQYVNLVGVTIGYTITTAISMGAIKRSNCFHSRGHGADCEASNTTNMIIFAGIQILLSQLPNFHKLWWLSIVAAVMSLAYSSIGLGLSIAKIAGKLMHGSYCTYVLSLILSRDFXLTAGGVHVKTSLTGAAVGVDVTAAEKVWKTFQSLGDIAFAYTYSNVLIEIQDTLRSSPPENVVMKKASFIGVSTTTAFYMLCGVLGYAAFGSDAPGNFLTGFGFYDPFWLIDVGNVCIAVHLVGAYQVFCQPIYQFVEAWARGRWPDCAFLHAELAVVAGSSFTASPFRLVWRTAYVVLTALVATVFPFFNDFLGLIGAVSFWPLTVYFPIQMYMAQAKTRRFSPAWTWMNVLSYACLFVSLLAAAGSVQGLVKDLKGYKPLFKVS

SEQ ID NO: 7674 - protein, 118 aa, Zea mays
MLSTASVPSTSFAAAFLSSRARRRRRAPWLRSVAAAAASGVGDGEVERFATSSSITDYLRYRRPELGCAGGAGGGGLPGGELQTAVVRFKKRFPWSLLHPFLHVDLVSTVHIADKEYF

SEQ ID NO: 7675 - protein, 336 aa, Zea mays
MGADYYKVLGVDRGASDDDLKKAYRKLAMRWHPDKNSTNKKEAETKFKEISVAYEVLSDPKKRAIYDQLGEEGLKGQPPPGAGGPGTSPFFPGGAHSTAHHFNPRSADDIFKEFFGSPGMGGMRTEPGFQRSMFGNDIFSSRFRAEGSTSMQQPLRKAAAIENPLPVGLADLYKGVTKKMKISRETIDASGRISNTEDILTIQVKAGWKKGTRITFPDKGNEAPNMKPADIVFIIDEKPHDVFTREGNDLVVTEKISLVEALTGYTARVTTLDGRSLSLHINSIIHPKYEEVMPGEGMPVPKDPTKKGNLRIKFNIMFPSRLTSDQKAGIKRLLGS

SEQ ID NO: 7676 - protein, 183 aa, Zea mays
  misc_feature (19)..(19): Xaa can be any naturally occurring amino acid
  misc_feature (37)..(37): Xaa can be any naturally occurring amino acid
  misc_feature (49)..(49): Xaa can be any naturally occurring amino acid
  misc_feature (104)..(104): Xaa can be any naturally occurring amino acid
  misc_feature (121)..(121): Xaa can be any naturally occurring amino acid
  misc_feature (154)..(154): Xaa can be any naturally occurring amino acid
MLVYLDLLSGDELLSHSFXYMSQTFLWEARKVPQGPXDEIGHPSAEGGXDERDDTAVKVVDIADSFRLQEQPPFDKKSFVSYITQYITNLTAVLQPDKAYEFTXGVEAATKSLLSKLKDLXLFVGESMNDEASVIFAYYHDAATNPTFLYFSRXLKEIECYTRYSCWRLYMIYCDSHNYSCPA

SEQ ID NO: 7677 - protein, 152 aa, Zea mays
MDAADVWGRSSSSSSSSAAAARRLQARYDLYMGIDDADAGLDEVTEPRGGAESYNCPFCGEDFDFVGLCCHIDDEHAVEAKSGACPICATRVGMDLIGHLTMQHGSYFKMQRRRRVRKVSSGSHSLLSLLRKDLRNGSLQSFLGGSSYMKSL

SEQ ID NO: 7678 - protein, 233 aa, Zea mays
MDAADVWGRSSSSSSSSAAAARRLQARYDLYMGIDDADAGLDEVTEPRGGAESYNCPFCGEDFDFVGLCCHIDDEHAVEAKSGACPICATRVGMDLIGHLTMQHGSYFKMQRRRRVRKVSSGSHSLLSLLRKDLRNGSLQSFLGGSSYVSNPPAAAPDPFVSSLICTLPVAEPSKDLHSDSSDNNFLLNKFPDEKPVERAEPSLSEKDQKERVQRSKFVRGLVLSTIFDDDNL

SEQ ID NO: 7679 - protein, 166 aa, Zea mays
YLLSGGEDDLVQVWSMDDRKIVAWENVMYRFGSIGQDTQLLLWDLALDEIAVPLRHPSGGSPTFSSGSPSAHWDNACPPTGVLQPSPRMRDVPKLSPLVAHRVHVDPLSGLEFTSESIVTICREGLIKIWARPIHSENNQQPDSSEQVIGSATAKDKMLTSSNKAE

SEQ ID NO: 7680 - protein, 234 aa, Zea mays
MAANLEDVPSVDLITEVLRRAKCSSKPDKRIILVGPPGSGKGTQSPLIKDEYCLCHLATGDMLRAAVAAKTPLGIKAKEAMNKGELVSDDLVVGIIDEAMKKPSCQKGFILDGFPRTVVQAQKLDDMLAKQGAKVDKVLNFAIDDAVLEERITGRWIHSASGRTYHSKFAPPKSPGVNDVTGEPLIQRRDDPVEVLKSRLEAFPKQTEPVIDYYSKKGLVVNLPAKKPPKEVNV

SEQ ID NO: 7681 - protein, 406 aa, Zea mays
MMDLRKSRPLHSDKLKPGSLHMKDEVIQLYLNNSAAVAAPREVCLLGALRCHGIGMIVGALGVSKEQLKDALLEGNVHGLGVEALQMLTQMVLSNEEELKIKYFKDDSLNRLCPVDVFLKAMLDVPFVFKRVDAMLYIASFYLEINRLRMSYATLEGACQEMRSSRLFHKVLEAVVNFGNFMSTNSGSPSSKGLEPNTVLKIADVKGADGKAALMQFIVQEIVKPEGYDVMQHGSGACKMSTNTLQCDAECRKHGLEVVAKLAAQLSNTKKAASIDIKRLSQSVSELGMGLGKVHDVVRLNSMVTSVDSARRFHNSMSTFLRHAEEEILKLQSQESICLSSVKEMAEWFIGESVNDEAHMFRIFAGVKEFLAMLDHICKEAGEVSSNNWVGATTASWMAAPMGMMP

SEQ ID NO: 7682 - protein, 187 aa, Zea mays
  misc_feature (147)..(147): Xaa can be any naturally occurring amino acid
MEETLVPKRPREEAQVERGLDFEEDYSSSKRHKPYNHILSLLDSEEEDSTQDLSPLMTTLQQEITCASKNTQDALLVCPTQENDQNTLTISSLEDNNATTSQVLKEEEENDKERVMRHLLQASDDELGIPNSGDGLWGFEDNEFTSXDGFSSLCDKMWELEDERANYYDFLQSELFLGGGGNINIRQ

SEQ ID NO: 7683 - protein, 378 aa, Zea mays
MASSTSEMAEGKEKLKRSGSLGSNDTYVRADKIDLTSLDIQLENQLTKTWGKANLKSQGPKEEWEIDLAKLEIRYVIAQGTYGTVYRGTYDGQDVAVKLLDWGEDGFATEAETAALRTSFKTEVAVWHKLSHPNVTKFVGASMGTTDLKIPSNNSNGAARTNLPARACCVVVEYLAGGTLKQYLIKNSRRKLAYKVVVQLALDLARGLSYLHSRKIVHRDVKSENMLLTPQRNLKIADFGVARVEAQNPKDMTGATGTLGYMAPEVLDGKPYNRKCDVYSFGICLWEIYCCDMPYPDLSFADVSSAVVHQNLRPDIPRCCPSAFANVMRKCWDANPDKRPDMDEVVQLLEALDTSKGGGMIPDGQSSGCLCFTKARGP

SEQ ID NO: 7684 - protein, 381 aa, Zea mays
  misc_feature (353)..(353): Xaa can be any naturally occurring amino acid
MAVERYNLQGSVSPEVLLFMSKFVVSDYDQQVTTRDVSGHLSPYHFSRRVQRDDDVTIKVLFCGLCHTDLHVIKNEFGNAKYPVVPGHEIVGVVTDVGSGVTSFKPGDTVGVGYFVDSCRSCDSCSKGYESYCPQLVETSNGVSLDDDDGGATTKGGFSDALVVHQRYVVRVPASLPPAGAAPLLCAGVTVFSPMVQYGLNAPGKHLGVVGLGGLGHLAVRFGKAFGMKVTVISTSLGKRDEALGRLGADAFLVSRDPEQMRAAAGTLDGVIDTVSADHPVVPLLDLLKPMGQMVVVGLPTKPLQVPAFSLVAGGKRVAGSAGGGVGECQAMLDFAGEHGITADVEVVGMDYXQYRHPAPREERCQVPLRCRRREQQDWRL

SEQ ID NO: 7685 - protein, 413 aa, Zea mays
  misc_feature (66)..(66): Xaa can be any naturally occurring amino acid
  misc_feature (373)..(373): Xaa can be any naturally occurring amino acid
MAGGKEAHGWAARDVSGHLSPYHFSRRVQRDDDVTIKVLFCGLCHTDLHVIKNEFGNAKYPVVPGXLYMFTNTQAIPFCKRGQGFTQTAAAKQQINHPRLAHPFGRRHEIVGVVTDVGSGVTSFKPGDTVGVGYFVDSCRSCDSCSKGYESYCPQLVETSNGVSLDDDDGGATTKGGFSDALVVHQRYVVRVPASLPPAGAAPLLCAGVTVFSPMVQYGLNAPGKHLGVVGLGGLGHLAVRFGKAFGMKVTVISTSLGKRDEALGRLGADAFLVSRDPEQMRAAAGTLDGVIDTVSADHPVVPLLDLLKPMGQMVVVGLPTKPLQVPAFSLVAGGKRVAGSAGGGVGECQAMLDFAGEHGITADVEVVGMDYXQYRHPALREERCQVPLRCRRRGQQDWRLGITIPSVLSIDV

SEQ ID NO: 7686 - protein, 140 aa, Zea mays
MSAIMLCTCSGDQSKFEDLPRSPESLATRDFSANCSSSKMASRETTPDDSQVNEVESDLKETLSLNYEEARALLGRLEHQRGNFDAALQVLQGIDIRSLRPRMTTAIAESVKPRMPPRSSDENLTSERDAYAYVHAFCKL

SEQ ID NO: 7687 - protein, 369 aa, Zea mays
MEPQAEPKPIPLMTPYKMGASLDLAHRVVLAPLTRQRSYGNVPQPHAAVYYGQRATPGGMLITEATGVSDTAQGYTDTPGVWTAEQAEAWRPVVDAVHAKGALFFCQLWHVGRVSKYGFQPGGAAPVSSTERMVGPQVRHDGSTEEFSPPRRLAAEEIPMIVDDFRKAARNAINAGFDGVEIHGGNGYLIEQFLKDSANDRDDGYGGNLENRCRFALEVVDAVAKEVGAHRVGIRLSPFMDYMDCHDSDPHALGLHMATKLNDHGILYLHMIEPRMALVDGRRVVPHRLLPYREAFKGTFIANGGYDREEGDKAVASGYADLVSFGRLFLANPDLPKRLELNAPLNKYNRLTFYISDPVVGYTDYPFLP

SEQ ID NO: 7688 - protein, 263 aa, Zea mays
  misc_feature (200)..(200): Xaa can be any naturally occurring amino acid
  misc_feature (221)..(221): Xaa can be any naturally occurring amino acid
MVSSMPLSSLLLLLSAASFGGGVRLGDGGYEDWRLGTATYVKEFQSHPLNDGGGACGYGDLDIFRYGRYTTGLSAALFGRGGACGGCYELRCVNHIQWCLRGSPTVVVTATDFCPANMGLADDDAGGWCNFPREHLELSEAAFLRVAKAKAGIVPVQFRRVSCDRAGGMRFTITGSAHFLQVLITNVAADGEVAAVKVKXVEDGVDPDGAELGPELAVRRXDLRAQPLSFEVTGGRGRTVTAYSVAPADWMFAQTFEGKQFAE

SEQ ID NO: 7689 - protein, 179 aa, Zea mays
  misc_feature (29)..(29): Xaa can be any naturally occurring amino acid
  misc_feature (51)..(51): Xaa can be any naturally occurring amino acid
  misc_feature (117)..(117): Xaa can be any naturally occurring amino acid
MLRYQDLLSGDELLSHSFTYKELQNDVLXEAEGKWGTQRPVDVDIGANPSXEGGEDESVDDTAVQGELIYDDTFRLQEQPPFDKKSFVSYIKKYIKNLTAVLEPEKLHEFTKGVEGXNQVYSLSKLKDLQFFVGEPMNDDASVRFTYYNDGATNPRFLYFSHGLNDIKCYARGEISYPC

SEQ ID NO: 7690 - protein, 514 aa, Zea mays
MPGGGFAVSAPSGVEFEAKITPIVIISCIMAATGGLMFGYDVGISGGVTSMDDFLREFFPAVLRRKNQDKESNYCKYDNQGLQLFTSSLYLAGLTATFFASYTTRRLGRRLTMLIAGVFFIIGVIFNGAAQNLAMLIIGRILLGCGVGFANQAVPLFLSEIAPTRIRGGLNILFQLNVTIGILFANLVNYGTSKIHPWGWRLSLSLAGIPAALLTLGALFVTDTPNSLIERGRLDEGKAVLKRIRGTDNVEPEFNEIVEASRVAQEVKHPFRNLLQRRNRPQLVIAVLLQIFQQFTGINAIMFYAPVLFNTLGFKSDASLYSAVITGAVNVLSTLVSVYSVDRVGRRMLLLEAGVQMFLSQVAIAVVLGIKVTDHSDNLGHGWAIMVVVMVCTFVSSFAWSWGPLGWLIPSETFPLETRSAGQSVTVCVNLLFTFVIAQAFLSMLCHLKYAIFVFFSAWVLVMSLFVLFFLPETKNVPIEEMTERVWKQHWFWKRYMDDDNHHIVNGKLTGASG

SEQ ID NO: 7691 - protein, 247 aa, Zea mays
  misc_feature (209)..(209): Xaa can be any naturally occurring amino acid
MDGGGGGGGGGGSTSGDDGKQEKHLVLAHKLFLLSHPDVDDLSKVDLRSDVLSAVKSDDMAPLFESLAAAGVLEPDAVLLSEMRARIDEEIRKLDEKIADAEENLGESEVREAHLAKSLYFVKVGEKEKALEQLKVTEGKTVAIGQKMDLVFYTLQIGLFYMDFDLISKSIDKAKKLFEEGGDWERKNRLKVYEGLYCMATRNFKKATXLFLDSISTFTTYELFPYDTVIFYTVLTSIISLYRVSLK

SEQ ID NO: 7692 - protein, 565 aa, Zea mays
MASVAGSGGGASAGAGGLKTYFKTPEGRHKLQYEKTHSPAVVHYSHNGKTVAQMTVAYLKEKPAGQGSTPSTPSAGSGMRSAAARLLGTGNGSRTLSFGSNGTSRAVSGSRRMGGGIGVSTSASGSQGMANYDGKGAYIIFNTADTLFISDLNSHDKDPIKSNHFSSSNPLCHAFDPEAKDGHELLVGVFSGDVYSMSLRHQVQDPGKKPVSYQHFVNKDKDKDKDPSQGRAASSRCTCVAWVPEREGIFVVSHADGNLYVYDKCKDGNTDWTFPTVKDQSQVLISHAKSSKSNPIARWHICQGAINDISFSPDGAYLATVGRDGYLRVFDFAKEQLIFGGKSYYGALLCCSWSADGKYLLSGGEDDLVQVWSMDDRKIVAWGEGHNSWVSAVSFDPYWSPPNSDETEENVMYRFGSIGQDTQLLLWDLALEEIAVPLRHPSGGSPTFSSGSPSAQWDNACPPAGVLQPSPRMRDVPKLSPLVAHRVHVDPLSGLEFTSESILTICREGLIKIWARPIHSESNQQPDSSEQVVGNATAKDKMLTSSNKAGAFSPSFKQPPSVLFT

SEQ ID NO: 7693 - protein, 260 aa, Zea mays
VSRHGFHTPEGAKLAKKQVKILGRYFMLSFFRGFFQWFFSGGDDCGFKNFPTLGLEAYKNRFYFDFSPTYVGVGMICPHIVNVSVILGGIISWGIMWPLIGKKKGSWYPASLPESSLHGLQAYRVFISIALILGDGLYNFVKVLIRTIAGFISMVHKNSKAMLPVSDNGSPTAEAMSFDDERRTELFLKDQIPMAVAYGGYAVVASISIGTLPQIFPQLKWYYILVAYVVAPILAFCMAYGSGLTDWSLASTYGKLAIFV

SEQ ID NO: 7694 - protein, 235 aa, Zea mays
MPRYDDRYGNARLYVGRLSSRTRSRDLEYLFSKYGRIREVELKRDYAFIEYSDPRDADEARYNLDGRDVDGSRIIVEFAKGVPRGSGGSREREYVGRGPPPGTGRCFNCGIDGHWARDCKAGDWKNKCYRCGERGHIERNCQNSPRSLRRERSYSRSPSPRRGRARSRSYSRSRSYSRSRSRSYSESPRGRRTERDERRSRSISYSRSPRRSLSPEAKDMDRSPTPDRSRSPRRS

SEQ ID NO: 7695 - protein, 423 aa, Zea mays
  misc_feature (106)..(106): Xaa can be any naturally occurring amino acid
  misc_feature (113)..(113): Xaa can be any naturally occurring amino acid
MAAVAVSGRLRTLGRGASGAVVSLAWDAASGELVAVKSAGASGAAALRREHAVLAGLRSPHVVRCVGGGEAAAAEEGSSYQLFLEYAPGGSLADEVARSGGSLGEXAVRAFAXDVLRGLAYLHARSVVHGDVKARNVLVGAGGRAMLADFGCARALSGSGSGSARRPIVGATPAFMAPEVARGEDQGPPADVWALGCTVVEMATGRAPFGGMGGAGVLAMVHRIAYTDAVPEVPAWLSPEAGDFLARCFARDAADRWTAARLLEHPFVAFARHDDKAPRPSPKSALDAAAFWESETESEDDADDASGSASASERIDSLACSAGALPDWDGEGGWIDVLGEHCGAPGKASSVLVAVPAGEMDVGGGLPSDDGLEADDVPFGGGDVPVPAADAYEKHCSSSDCHALSCQLVPCNLVFNAIKLWVP

SEQ ID NO: 7696 - protein, 501 aa, Zea mays
  misc_feature (131)..(131): Xaa can be any naturally occurring amino acid
MGEEANVPLLVPANNGDDDHLRLTVIHGDQGKAAAGDTGLLPAASSASAWPWAEVKGQLAFAAPMVATSMAYYAIPLVSVMFAGRLGDLQLAAATLGNSWGTVTGIALMTGLSGSLETLCGQGYGAKAYRXTMGVHLQASLLTSALASAVVSLLWIYSEPLLVFLRQDPETSRLAADFLRHSVPALFAYGFIQCALRFLQAQSVVAPLVAFSLLPLAAHVGVAHALVNVLGMGFAGAAVATSASLWLSFIMLAAYVMLSARFRETWPGLTTEAFRHVLPGMKLAIPSAVMVCFEYWSFEILVLFAGLMPDSQLSTSIIAMCQNTEAISYMITYGFAAVISTRVSNELGARNIANAKKALTVSLALSLMLGVAFLLLLGLGHDLWVRLFTTSEAVVSAFASMTPLLIGSVVLDSTQGVLCGVARGCGWQHLAAWTNLVAFYVIGLPLAILFGFTLAFQTKGLWMGQICSLLCQNCVLFFITLRTNWQELDLTMFNKDNDFVC

SEQ ID NO: 7697 - protein, 170 aa, Zea mays
  misc_feature (29)..(29): Xaa can be any naturally occurring amino acid
  misc_feature (107)..(107): Xaa can be any naturally occurring amino acid
  misc_feature (135)..(135): Xaa can be any naturally occurring amino acid
  misc_feature (153)..(153): Xaa can be any naturally occurring amino acid
  misc_feature (162)..(162): Xaa can be any naturally occurring amino acid
  misc_feature (164)..(164): Xaa can be any naturally occurring amino acid
YVVYQDLLSGDQLLSDSFTYKELENGVLXYVEGKRITPGPVDADIGANPSAEGAEDESADDTGAKVLDIVDTFRLQEQPPFDKKSFVAYIQKYIKNLTAELEAQKAXSSKRAVQGATKFLLSELKDLQFFVGESXMKDDASVLFAYYKDAATXNPTFLYFSXHXLKEIKC

SEQ ID NO: 7698 - protein, 178 aa, Zea mays
  misc_feature (90)..(90): Xaa can be any naturally occurring amino acid
  misc_feature (132)..(132): Xaa can be any naturally occurring amino acid
  misc_feature (162)..(162): Xaa can be any naturally occurring amino acid
HMVNTWGYSTINFFAPMSRYASAGGGPVAASKEFKQMVKAFHNAGIEVLQSTSLLAATCSKFQVHGETYMMEPHQFLDEFMRKTNCCPCXVYYILDLNNSAQLLNFSGCGNTLNCNHPVVKEHVLDSLRHWXIAKGSVLSRCKIIAEPWDCGGLYLVGRFPXNWDRWAEWNGKYRDDI

SEQ ID NO: 7699 - protein, 89 aa, Zea mays
  misc_feature (24)..(24): Xaa can be any naturally occurring amino acid
GGPVAASKELKQMVKAFHNSGIEXYNHTNEADDVNPYMTSFRGIDNKVYYMLDLNNSAQLLNFSGCGNTLNCNHPVVKELVLDSLRHWV

SEQ ID NO: 7700 - protein, 208 aa, Zea mays
VEEDEFVAGMKTWLNEAKQKVAASGAYSNKFVNDYHARTREEHDQLVDRSDEAVESVENPGWCIAKAVGYLILGATICAAFADPLVDAVHNFSNATHIPSFFVSFIGLPLATNSSEAVSAIIFASRKKQRTCSLTFSEVYGGVTMNNTLCLGVFLALIYFRELTWDFSSEVLVILLVCVIMGLFTSFRTSFPLWTCLVAYLLYPLTLA

SEQ ID NO: 7701 - protein, 716 aa, Zea mays
MAPHTTAGGGGGAEDEVSEAAAASPALRHRHAGKGEGLGGNGGAGADGQASVERVFADKAVPSWREQLTLRAFVVSALLAVMFSVIVMKLNLTTGIIPSLNVSAGLLGFFFVRMWTAAAERMGFLRQPFTRQENTVIQTCVVSAYGIAFSGGFGSYLFGMSDKIAKQATEAKDANNIKDPHLGWMIGFLFLVSFIGLFALVPLRKIMIVDYKLTYPSGTATAYLINGFHTPEGAKLAKKQVKTLGKYFVFSFFWGFFQWFYTAGDECGFKNFPTLGLEAYNNRFFFDFSPTYVGVGMICPYIVNVSVLLGGFLSWGLMWPLIAKKKGSWYPANLEDSSLHGLQAYRVFISIALILGDGLYNFIKVLIRTIAGFISMVQQNSKSMLPVSDNGSSMSSMEAVSFDDERRIENFLKDQIPKSVAYGGYVAVAAISIGTLPQIFPQLKWYYILVAYVVAPVLAFCNAYGSGLTDWSLASTYGKLAIFVFGAWAGLSHGGVLVGLAACGVMMSIVSTASDLMQDFKTGYLTLASPRSMFISQVIGTGMGCVIGPCIFWLFYKAFGDIGESGTEYPAPYAIVYRNMAILGVDGFGSLPKNCLTLCYIFFAAAITINLVRDLTPYKVSRFIPLPMAMAIPFYIGSYFAIDMFLGSAILFVWERLNKAKADAFGPAVASGLICGDGIWTLPQSILALAKVQPPICMKFLSRSTNAKVDSFLGLS

SEQ ID NO: 7702 - protein, 278 aa, Zea mays
ATSWSRHPVCGRRYHFIIRNEYKTCKHCDHCGLMAQSFGTRCPTCKYVISSDDPEDWDYRQLDNPRHLLHGIVHDNGFGHLVRINGREGGSSLLTGIQLMGFWDWLCRYLRVRKVSLMDVSKKYGTDYRILHAITTGHSWYGQWGFKLNKGSFGITSEEYLKAMDNLSLTPLSHFFPHSRYPRNQLQDTISFYRSLSKQPLTTIRELFLYVLGLATSKSSNMHYGSMHKEHSHTHVQDTWPDEEIKRATEIAIKVLRAVEKTRWVSMRTLKAAMYHSI

SEQ ID NO: 7703 - protein, 267 aa, Zea mays
MAAMNTGMGGLGGRPIHPQANPFGTALQGAGPGLIRTGLETYGGRILDSSSEFMQSNITQYLSDPQYYFQVNSQYVRNKLKVILFPFLHRGHWTRITEPVGGRLSYKPPVQDINAPDLYIPLMAFGTYIVAAGYALGVLGRFTPEALTLQFSKGILGWFLQVVLIKGLLYSLGSGEAPLLDIVAYAGYGFAGTSLAMVARIFWSYLYYFIMPWFCLCTGVFLVKTMKRVLLGGPRSYERHPGRNHYFLIFLAVVQFPMLFWLGNICG

SEQ ID NO: 7704 - protein, 379 aa, Zea mays
MATAGKVIKCRAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 7705 - protein, 441 aa, Zea mays
  misc_feature (220)..(220): Xaa can be any naturally occurring amino acid
  misc_feature (223)..(223): Xaa can be any naturally occurring amino acid
  misc_feature (245)..(245): Xaa can be any naturally occurring amino acid
  misc_feature (253)..(253): Xaa can be any naturally occurring amino acid
  misc_feature (269)..(269): Xaa can be any naturally occurring amino acid
  misc_feature (276)..(276): Xaa can be any naturally occurring amino acid
  misc_feature (374)..(374): Xaa can be any naturally occurring amino acid
MAAVAVSGGHWRRLRTLGRGASGAVVSLAWDAASGELVAVKSAGAIGAAALRREHAVLAGLRSPHVVRCVGGGDAAEEGSSYQLFLEYAPGGSLADEVARSGGSLGERAVRAFAADVLRGLAYLHARSVVHGDVKARNVLVGAGGRAMLADFGCARALSGSGSARRPIVGATPAFMAPEVARGEDQGPPADVWALGCTVVEMATGRAPFGGMGGAGGALXAVXWIGYTDAVPEVPAWLSPEAGDXLAHCFARXAADRWTAARLLEHPFXVAFARHXDKAPRPSPKSALDAAAFWESETESEDEASGSASERIESLACSAGALPDWDGEGGWIDVLGEHCGAPGKASSVLVAVPAGEMDVGGGLPSEDGLEAEEXPFGGGGVPVPVPAADASAGRHEKHCSSSDCHALSCQLVPCNLVFNAIKLWVPTKKKKKKKNNKKKKK

SEQ ID NO: 7706 - protein, 275 aa, Zea mays
IGYLEAGRPFTLKYQLPNEDLDSLISVSTDEDLDNLVDEYDRIAATSWPGGSSRTSRIRLFLFPAKPESSSSLGSLLDDSSKSENWFVDALNSAISGSLDGIPRGISTDSASVNCLLGLEDDSSVHSRSGVTNSAPTEDQRASQPKLQAGAAAAAVGTGRHPHDVQSVPDSPMLDKNSSFGSTSSAPSLSNLPPIRVRPEDRPSDARIMQPTAVEDHFAQMGISEQQLPMYMQAQQQVPIPAMTGMSPSEASSRLFSDDDKSDHGGGGGRKQQPT

SEQ ID NO: 7707 - protein, 370 aa, Zea mays
MAPVEAEQHRRRALALAAHDASGAVSPIRISRRDTGDDDVAIQILYCGICHSDLHTIKNEWKNANYPVVPGHEIAGLITEVGKNVKRFNVGDKVGVGCMVNTCQSCESCEGGHENYCSKIIFTYNSHDRDGTVTYGGYSDMVVVDERFVIRFPDGMPLDRGAPLLCAGITVYNPMKHHGLNEAGKHIGVVGLGGLGHVAVKFAKAFGMRVTVISTSPGKREEAMETLGADAFVVSSDANQMKAAKGTMDGIMNTASASMSMYAYLALLKPQGKMILLGLPEKPLQISAFSLVTGGKTLAGSCMGSIRDTQEMMDFAAKHGLTADIELIGTEEVNEAMERLAKGEVRYRFVIDIGNTISAASLGSSPVPAL

SEQ ID NO: 7708 - protein, 379 aa, Zea mays
  misc_feature (367)..(367): Xaa can be any naturally occurring amino acid
MSTTGQIIRCKAAVCWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIYHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKEHDKPVQQVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLXGESIRCIITMGA

SEQ ID NO: 7709 - protein, 139 aa, Zea mays
  misc_feature (97)..(97): Xaa can be any naturally occurring amino acid
MDSEHWISRLAAAKRFYAAQLGHIDDMSGMGMEEVDMDMEDDGEMDMEMEMQMEEARWPEVACPYCYEDYDLGSLCVHLEEDHPYEPHPAPCPICSXKITRDMLNHITMHHGYLFKALLGGGHSHRSRDTNAATTKYYA

SEQ ID NO: 7710 - protein, 167 aa, Zea mays
  misc_feature (49)..(49): Xaa can be any naturally occurring amino acid
MSGVKKVTDVAAKAGKAIDWDGLAKMLVSDEARKEFANLRRTFEDVNHXLQTKFSQEPKPIDWEYYKKGIGSKVVDMYKEAYDSIEIPKYVDTVTPEYKPKFDALLIEMKEAEKTSLMESERIEKEIAELKEMKKKISTMTADEYFAKHPELKKKFDDEIRNDYWGY

SEQ ID NO: 7711 - protein, 244 aa, Zea mays
GKRGKSGLVALNLDFSFLEMNPFTMVNGEPYPLDMRGELDDTAAFKNFKKWGGIEFPLPFGRVLSPTESFIHELDEKTSASLKFTVLNPKGRIWTMVAGGGASVIYADTVGDLGYASELGNYAEYSGAPNEEEVLNYSRVVLDCATADPDGRKRALLIGGGIANFTDVATTFNGIIRALREKESKLKASRMHIYVRRGGPNYQSGLAKMRKLGAELGVPIEVYGPEATMTGICKQAIECIMAAA

SEQ ID NO: 7712 - protein, 226 aa, Zea mays
  misc_feature (55)..(55): Xaa can be any naturally occurring amino acid
  misc_feature (76)..(76): Xaa can be any naturally occurring amino acid
  misc_feature (89)..(89): Xaa can be any naturally occurring amino acid
  misc_feature (92)..(92): Xaa can be any naturally occurring amino acid
  misc_feature (169)..(169): Xaa can be any naturally occurring amino acid
MRANLEDLPSCDLMYELLRRMKCSSQPHKRLILIWPLGSGKVTPPPIIQGDYCLXHLSTGDMLMAAVATKTPLCIXATEAMNTGELVSXDDXDVGIIDEAMKKPSCHIGFILDGFPKTVTQAQKLGEMLTKQGAHGDKGLNFASDDAALQPTITGRCIHSARGRTYHSXFAPPESPRVDDVTGEPLIHWIHDTADVLKTWLEAFHRHAEPVVDYYSETGLVVNLSA

SEQ ID NO: 7713 - protein, 229 aa, Zea mays
KDEGFDFSANRVTRSIDESLARLGLDYVDILHAHDIEFTHLEQIVNETIPALQKIKENGKARFIGITGLPLSIYPYVLDRVAPGSVDVILSYCHYGINDTSLVDLLPYLKSKGVGVISASPLSMGLLTDNGPPEWHPAPEELKSACKAAADHCRKKGKSITKLAMQYSLMNNEISTVLVGMNSLEQVEENVAAALELSTSGIDEELMREVEAILEPVKNLTWPSGIQQA

SEQ ID NO: 7714 - protein, 410 aa, Zea mays
MACTDNAMRALFLLVLFCIVHGEKEESKGIDAKASGPGGSFDITKLGASGNGKTDSTKAVQEAWASACGGTGKQTILIPKGDFLVGQLNFTGPCKGDVTIQVDGNLLATTDLSQYKEHGNWIEILRVDNLVITGKGNLDGQGPAVWSKNSCTKKYDCKILPNSLVMDFVNNGEVSGVTLLNSKFFHMNMYQCKNMLIKDVTVTAPGDSPNTDGIHMGDSSGITITNTVIGVGDDCISIGPGTSKVNITGVTCGPGHGISIGSLGRYKDEKDVTDINVKDCTLKKTMFGVRIKAYEDAASVLTVSKIHYENIKMEDSANPIFIDMKYCPNKLCTANGASKVTVKDVTFKNITGTSSTPEAISLLCTAKVPCTGVTMDDVNVEYSGTNNKTMAICTNAKGSTKGCLKELACF

SEQ ID NO: 7715 - protein, 127 aa, Zea mays
FRPNLCVRISRETVTAMAAAGGVSTDDVPILQAENLTSNVKSVYYSRAFLSIIGGVVAGIWGFTGLMGFVFYFLIMMVASIGLLAKSKFSVQAYFDSWTRISIEGVFGGLMSFVLFWTFAYDIVHIF

SEQ ID NO: 7716 - protein, 233 aa, Zea mays
  misc_feature (121)..(121): Xaa can be any naturally occurring amino acid
  misc_feature (177)..(177): Xaa can be any naturally occurring amino acid
MAALAASSTAAFAAKPRLPRARLTVACSATGGDGNGSSSSVSLASSVKTFSAALALSSVLLSSAATSPPPAAADIAGLTPCKESKAFAKREKNSIKKLTASLKKYAPDSAPALAINATIEXTKRRFENYGKFGLLCGADGLPHLIVSGDQRHWGEFVTPGLLFLYIAGWIGWVGRSXYLIAISGEKKPAMREIIIDVELATRLLPRGFIWPVAAYRELINGDLVVDDKDIGYY

SEQ ID NO: 7717 - protein, 414 aa, Zea mays
  misc_feature (213)..(213): Xaa can be any naturally occurring amino acid
NEGANAERVMQELSQIGIMPEMWGGDTPMIEISALTGDNVDELLETVMLVAELQELKANPHRNAKGTVIEACLDKAKGPLATLVVQNGTLNKADIIVCGEAYGKIRALYDDCGKLVDKAGPSNAVQVIGLNNVPLAGDEFEVVDNLDVARERANGRAEALRIERISAKAGEGKVTLSAIAASVSSAKQVGIDTHELNVILKVDFQGSIEAIRXQAIQTLPQENVSLRFLLQGPGDVSVSDVDLAVASEGIIFGFNVRAPGSVKNYAKKKGVEIRMYKVIYDLIDDLRKAMEGLLEPAEEEVPIGSAKVRAVFSSGSGKVAGCMITTGKVVQDCNVRVLRKGKEVYVGSLDSLRRVKETVKEVGAGLECGIGVDDFDEWEEGDIIEAFNTVNKARTLEEASATVTAALKDAGVQL

SEQ ID NO: 7718 - protein, 155 aa, Zea mays
MDASATVATGKGKKGVAGRKAGGPRKKSVSRSVKAGLQFPVSRIGRFLKKGRYAQRVGSGAPVYLAAVLEYLAAELLELAGNAAKDNKKSRIIPRHLLLAIRNDEELGKLLAGITIAHGGVIPNINPVLLPKKTAEKSPKEPKSPKKTAKSPKKA

SEQ ID NO: 7719 - protein, 158 aa, Zea mays
  misc_feature (140)..(140): Xaa can be any naturally occurring amino acid
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGXEPKSPKKATKSPKKTTKA

SEQ ID NO: 7720 - protein, 351 aa, Zea mays
MAPPARWLRREVLVGLALGQFVSLLITSTGFASSELARRGVNAPTSQSLLNYILLALVYGGTLLYKRQNMTIKWYYYLILGIVDVEANYIVVKAYQYTSLTSVMLLDCWSIPCVIVLTWIFLKTKYGLRKFIGVGVCVAGLILVVFSDVHASDRAKGPNPLKGDLLVIGGSMLYAISNVTEEYFVKKSNRIEVMAMLGVFGAIISGIQISILEQKELRSTHWTAGAILPFIGFALAMFLFYSTVPIILKICGATMLNLSLLTSDMWAVLIRIFAYKEKVDWMYFVAFAGTATGLVIYSYRGSRQISEETAQVTQAIDEEAATANSAAQVPGVGDDGPASNKDFSLAATASR

SEQ ID NO: 7721 - protein, 174 aa, Zea mays
  misc_feature (162)..(162): Xaa can be any naturally occurring amino acid
MAAKRELVVSFGEMLIDFVPTVAGVSLAEAPAFVKAPGGAPANVAIAVARLGGGAAFVGKLGDDEFGRMLAKILRDNGVDAGGVVFDSGARTALAFVTLRADGEREFMFYRNPSADMLLTADELKVDVIKRAAVFHYGSISLIAEPCRTAHLHAMKVAKERXPRLLSYEPNLRE

SEQ ID NO: 7722 - protein, 183 aa, Zea mays
  misc_feature (34)..(34): Xaa can be any naturally occurring amino acid
  misc_feature (119)..(119): Xaa can be any naturally occurring amino acid
  misc_feature (122)..(122): Xaa can be any naturally occurring amino acid
MRRSTPRGLSSIGTAMGKPLATDEEHKEFANLRXTFNDGNHPRSRPRSSTTPTPLSARTTKKELTSEEAHMYKNAFESIDIPNYVDAVSPLHEPQFDAEIAEFHEDDKEHQKDLHLFEXRLXETEDVRNKFITMTADDYCEKHPGLREKFDDEIRSDPSPILERCYVTLMMPFPCAGRNNNFP

SEQ ID NO: 7723 - protein, 568 aa, Zea mays
MAASRRQHRRGFPLVPLLLSLLAAAAYGRLISDGGPPAPLLPVIRLAAPPAEAECEQTYGFLPCTTTVLGNLFLVLAYGFLMFKAATFLSAGSELLLEIMGPGLVGGLLLPILGALPDALLVLVSGLSGSKEEAQSQVLIGMGLLAGSTVFLLTLLWGTCVVVGKCDLGPGREAVDVTDTKGFSLKGTGVTTDVQTSYAARIMGLSVIPFIIAQFPKMLKTHHGQRLAMLLALVVSFALVLAYCLYQVFQPWIQRRKLAYAKHKHVISGILRHAQMQSLGRLLNDDGTPNEQVIRKLFRKIDMDESRSLSRAELHALIVGINFEEVDFDRTDAVDKVMDDFDTSRNDVVEEEEFVQGMRKWLDEARRSVPVGGAFSSKFIHEYHERTRQEHDELVDRSDEAVESVENPGWCIAKAVALLLLGSAAAAAFADPLVDAVHGFSNATRIPSFFISFIALPLATNSSEAVSAIIFASRKKQRTCSLTFSEVYGGVTMNNTLCLGVFLALIYFRNLTWDFSSEVLIILLVCVVMALFTSFRTTFPLWTCLVAYMLYPLSLIIVYILDYVFGWS

SEQ ID NO: 7724 - protein, 512 aa, Zea mays
MTIDMSIPGSSGLLNAAGKRDMKFFSNPYVLALTGAAGIGGFLFGYDTGVISGALLYIRDDFPAVKDNYFLQETIVSMALVGAMIGAAGGGWINDAYGRKKSTLLADLMFALGSLVMCAAAGPYILIIGRLLVGLGVGVASVTAPVYIAEAAPSEIRGGLVSTNVLMITGGQFFSYLINLGFTEVPGTWRWMLGVAAVPAIIQFFVLMLFLPESPRWLYWKDEKAKAIAVLERIYESDRLEEEVELLATSSMHEFQSNNTGSYLDVFKSKELRLAFFAGAGLQAFQQFTGINTVMYYSPTIVQMAGFSSNRLALLLSLIVAAMNAAGTIVGIYLIDRCGRRRLALTSLAGVVVSLAILATAFILQSSSGLCMSAASGTGTCQGALGWFAVAGLALYIAFFSPGMGPVPWAVNSEIYPEAYRGMCGGMSATVNWVSNLVVAQTFLSIVGLVGTGPTFLIVAGIAVLAFVFVATYVPETKGLTFEQVEQMWRERAWGNSGGNCESLLAGTASAP

SEQ ID NO: 7725 - protein, 453 aa, Zea mays
MAASARDSTDAAERVVDDHDGWASDAEMDVEMDVVEGDADRRDGGADGDDEYLLLTRIRDTSAAEARAGKDIQGIPWERIHIARQDYRKARLEQYKNYENFPQSGELMDKLCKQVEKSSKYYEFQHNTRSVKPSILHFQLRNLLWATSKHDVYFMSNSTVSHWSSLSHKLSEVLDFSGHVAPAEKYPGSLLEGFSGVQVSTLAVNEGLVVAGGFQGELIGKDVEGCSVKFCMRTTLSDNAITNAIDMHRSISGSLHITVSNNDCGVREYDMERYQLVNHYRYNWPVNHTSVSPDKKLLAVVGDDRDALLVDSRNGKVTSTLVGHLDYSFATAWHPDSRTFATGNQDKTCRIWDTRNLSTSLAVLRGNIGAIRCIRYSSDGRFLVFSEPADFVHVYSVAADYKKRQEIDFFGEVSGITLSPDDESLFIGVCDRVYASLLQYRMIRGFDYLDSYV

SEQ ID NO: 7726 - protein, 148 aa, Zea mays
  misc_feature (34)..(34): Xaa can be any naturally occurring amino acid
  misc_feature (48)..(48): Xaa can be any naturally occurring amino acid
  misc_feature (85)..(85): Xaa can be any naturally occurring amino acid
  misc_feature (134)..(134): Xaa can be any naturally occurring amino acid
MTEHLFEDTFYAATLDPDAEQSDRVSRVACRREXLNMYMQLNGATHVXPMHVVDTYSMHIVPTVNQDRTLDILATSTHLWRKTLXDNHRNAMRGEDDTTISQDTSYSHHAIVPLYVSLVALLMLIMGEPIHCRXSQLDQKVFLLIRKA

SEQ ID NO: 7727 - protein, 1281 aa, Zea mays
MKASAQESIQPAKVVLLLLIHVSVPSSSADVGHQFIYQGFAASDLALNGLAAVTPGGLLALTNATFQAKAHAFRPAPVHFLNASSSAAAATARARARSFSTCFVFAIVSAYEGLSDHGLAFVVAPTTSFSAAKAGQYLGILGAINGTASDPVLAVELDTILNPELSDIDSNHVGVDVNSLVSEQAMPAGYYDDAAGGAIRELQLNSRKPMQVWIDYDGQAGRLDVTLAPVRVPKPSRPLVSTAVDLSTIVGRGGPMYVGFSSATGVVATHHYVLGWSFGLDGPAPPLDMSKLPVLPRVGPKPRSKVLDVLLPLATALVVAAALAAISFAMWRRRRFAEVREDWEDEFGPHRFSYKDLFHATNGFDAVNLLGVGGFGRVYKGVLPASPALEIAVKKVSHGSRQGVREFVAEVVSIGRIRHRNLVQLLGYCRRRGELILVYDYMANGSLDKYLYDQHVPALSWHERYRIIKGVAASLLYLHEDWEQVVIHRDVKASNVLLDHEMNGRLGDFGLARLYDHGTDPQTTHVVGTMGYLAPELVRTGKATPSTDVFSFGVFLLEAACGRRPIDRDRQVVLVDWVIEHHRDGSVLDVVDPRLVGKYEAEEATLVLKLGLMCAHPLPNVRPSMRRVVQYLDSDQAVPDLSPNYTSYSIMSLIQNDGFDSYITSSHPYMTNSIVVSSATKSLDVEGSTDQELQCGAAQSRAVMATVLLPLLLLLGSAVTLLTCAGAGASFPVNVWPKPTSMSWAEPHAAVPVSPSFHIVASSGNPYLASAAERYAKLLFRETYRPIVRPAVNVTAGNALEKLTVAVSDLAAPLQHGVDESYTLEILPTGAATVTAATAWGAMRGLETFSQLSWRAGRGDLLLVAAGVRVEDRPLYPHRGLMLDTGRTYFPVADILRTIDAMAANKMNVFHWHITDSQSFPIVLPSEPSLAEKGAYGENMRYTVEDVERIVEFAMSRGVRVVPEIDSPGHTASWAGAYPEAVTCAGKFWLPDGDWNHRLAAEPGAGQLNPLAAKTYEVITNVVNDLTSLFPDGFYHAGADEVTPGCWEADPTIQADLERGATLSQLLERYVSAVHPLVVSRNRTAVYWEDVLLDAAVNVSASAIPPATTVLQSWNNGPNNTKLIVQAGYRAIVSSASFYYLDCGHGDFVGNNSIYDDPNSDFDANGGSWCGPYKTWQRVYDYDIAYGLTPEEAQLVLGGEVAMWTEQVDTTVLDGRVWPRASAMAEALWSGNRDASGRKRYAEATDRLIDWRQRMVGRGVRAEPIQPLWCRTRPGMCNAVQ

SEQ ID NO: 7728 - protein, 159 aa, Zea mays
  misc_feature (66)..(66): Xaa can be any naturally occurring amino acid
  misc_feature (90)..(90): Xaa can be any naturally occurring amino acid
  misc_feature (94)..(94): Xaa can be any naturally occurring amino acid
  misc_feature (99)..(100): Xaa can be any naturally occurring amino acid
  misc_feature (104)..(104): Xaa can be any naturally occurring amino acid
  misc_feature (106)..(106): Xaa can be any naturally occurring amino acid
MEKSNDHDKASHGGSGGGATEKWEETSLGIRTAETMLRLAPVGLCVATLVVMLKDSETNEFGSISXSNLTAFRYLVHANGICAGYSLLSXAIAXMPRSXXTMPXVXTFFWRPVPPLLLLYTASLVFAPHNYPPRILASLSYTVRFTTPHARAYYYLAYS

SEQ ID NO: 7729 - protein, 321 aa, Zea mays
MAPAVAAAASAAMRQALRDRQILDAVGTGAAALSLAGSSFIVICYLLFRELRKFSFKLVFYLAVSDMFCSLFTILGGPSNAFYCFAHDYSAHFFCVASFLWTTTISFTLHRTVVKHKTDVEEFGSIFHLYVWGTSLSTTVLRSIGSDYGRPGTWCWIQQGSMAKVLHLITFYLPLWGAILYNGFTYYEVNRMLNNATQMAAGISDQSNQSDIRAGRKAFNRWGYYPLILIGSWAFATINRLYDFANPGHRIVWLSFLDVGFAGLMGLFNSIAYGLNSSVRRAIAERIDTFLPERIKRSLPALSRLRSQQENELTSLIVEGN

SEQ ID NO: 7730 - protein, 259 aa, Zea mays
LSLSLSLSLSLYWIGIQANCHSYQIEGFKMNLIYYDLYQATRLENFVTAYGQFLKANGEEPVTWKRAATMEDVLREADVISLHPVLDKTTYHLINPERLAIMKKEAVLVNASRGPVIDEAALVEHLKANPMFRVGLDVFEDEPYMKPGLADMKNAVVVPHIASASKWTREGMATLSALNVLGKIKGYPVWGNPNQVEPFLQENLTPPPACPSIVNAKQIVCCPAIGKALGANTDRLGIYMLMCRRRLHHAHIYVHCMWN

SEQ ID NO: 7731 - protein, 203 aa, Zea mays
EGFKMNLIYYDLYQATRLENFVTGKQECYFLKANGEEPVTWKRAATMEDVLREADVISLHPVLDKTTYHLINPERLAIMKKEAVLVNASRGPVIDEAALVEHLKANPMFRVGLDVFEDEPYMKPGLADMKNAVVVPHIASASKWTREGMATLSALNVLGKIKGYPVWGNPNQVEPFLQENLTPPPACPSIVNAKQIGLPSAKL

SEQ ID NO: 7732 - protein, 203 aa, Zea mays
  misc_feature (185)..(185): Xaa can be any naturally occurring amino acid
  misc_feature (191)..(191): Xaa can be any naturally occurring amino acid
MAYRADDDYDYLFKVVLIGDSGVGKSNLLTRFTRNEFSLESKSTIGVEFATRSIRVDDKVVKAQIWDTAGQERYRAITSAYYRGAVGALVVYDVTRHVTFENVERWLKELKDHTDANIVIMLVGNKADLRHLRAVSVEDAKAFAEREYTFFMETSALESMNVEDAFTEVLTQIYRVVSKKALDIXDDPAAXTRGQTHHVGSKD

SEQ ID NO: 7733 - protein, 203 aa, Zea mays
  misc_feature (193)..(193): Xaa can be any naturally occurring amino acid
MAARVLAALALALALALVAVPAPTRASNDEGDALYALRQRLSDPNGVLQSWDPTLVTPCTWFHISCDQVGRVVRLDLGNSNVSGSIGPELGRLVNLKYLELYRNNLDGEIPKELGNLKNLISLDLYANKLTGGIPKSLSKLDSLRFMRLNNNKLTGSIPREFAKLSNLKVIDLSNNDLCGTIPVDGPFSTFLXSFENNSRLNG

SEQ ID NO: 7734 - protein, 217 aa, Zea mays
  misc_feature (198)..(198): Xaa can be any naturally occurring amino acid
MAARVLAALALALALALVAVPAPTRASNDEGDALYALRQRLSDPNGVLQSWDPTLVTPCTWFHISCDQVGRVVRLDLGNSNVSGSIGPELGRLVNLKYLELYRNNLDGEIPKELGNLKNLISLDLYANKLTGGIPKSLSKLDSLRFMRLNNNKLTGSIPREFAKLSNLKVIDLSNNDLCGTIPVDGPFSTFPLRSFEXNSRLNGPELQGLGPYDFGC

SEQ ID NO: 7735 - protein, 217 aa, Zea mays
MAARVLAALALALALALVAVPAPTRASNDEGDALYALRQRLSDPNGVLQSWDPTLVTPCTWFHISCDQVGRVVRLDLGNSNVSGSIGPELGRLVNLKYLELYRNNLDGEIPKELGNLKNLISLDLYANKLTGGIPKSLSKLDSLRFMRLNNNKLTGSIPREFAKLSNLKVIDLSNNDLCGTIPVDGPFSTFPLRSFENNSRLNGPELQGLVPYDFGC

SEQ ID NO: 7736 - protein, 180 aa, Zea mays
MATPAPAGAAMPELAPGQGREAKHGRAGGGPRQSAGARLLSLSVQAAVMAATLAVFLVFAAASALLLLVLVLAARAFPRHHRITSLDLAPSPPPPLRAGLSPVDIRRLPSFAFPSTRGDSGDETAAASPSCVVCLDAARAGERWRAMPACTHAFHAACVDRWLARTPVCPVCRAAVAVPI

SEQ ID NO: 7737 - protein, 179 aa, Zea mays
SKKKSNGTKRSDFFGERVKMCLRYSLCLILFSLISLQGFAKKTGDVSELQIGVKFKPATCEVKAHKGDMIKVHYRGKLTDGTVFDSSFERDEPFEFELGSGQVIKGWDQGLLGACVGEKRKLKIPAKLGYGEQGSPPTIPGGATLIFDTELIAVNEKPAGGEQEQEEEDVDDTYGADEL

SEQ ID NO: 7738 - protein, 191 aa, Zea mays
SKLTSKKKKKKKNKKKKKKKKKKKKEHNRLAFPSPPARLSLLSDSLSRSRVHLAAASKRDQRAPLGDGGAAAAAASNNLGGSFGEMLIDFVPDGAGLSLAESGGFVKAPGGAPANVACAIAKLGGSSAFVGKFGDDEFGHMLGNILKQNNGNAEGGLFDKHARTALAFGTLKHDGEREFMFYRNPSADMLL

SEQ ID NO: 7739 - protein, 402 aa, Zea mays
MATLRSVGTLGEADLKGKKVFVRADLNVPLDDAQKITDDTRIRASVPTIKFLLEKGAKVILASHLGRPKGVTPKYSLKPLVPRLSDFLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSTKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFDEALDTTKTVIWNGPMGVFEFQKFAAGTEAIAKKLAELTTTKGVTTIIGGGDSVAAVEKAGLADKMSHISTGGGASLELLEGKTLPGVLALDDA

SEQ ID NO: 7740 - protein, 401 aa, Zea mays
  misc_feature (326)..(326): Xaa can be any naturally occurring amino acid
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSTKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFDEALDTTKTVIWNGPMGXVFEFQKFAAGTEAIAKKLAELTTTKGVTTIIGGGDSVAAVEKAGLADKMSHISTGGGASLELLEGKTLPGVPCPR

SEQ ID NO: 7741 - protein, 165 aa, Zea mays
MGILRKKKHERKPSFKSVLTAILATHAATFLLLIAGVSLAGTAAAFIATMPLFVVFSPILVPAGITTGLLTTGLAAAGGAGATAVTIILWLYKRATGKAPPKVLEKVLKKIIPGAAAAPAAAPGAAPAAAPAAAPAAAPAAAPAAAPAPKPAAPPAPKPAAPPSI

SEQ ID NO: 7742 - protein, 345 aa, Zea mays
  misc_feature (175)..(175): Xaa can be any naturally occurring amino acid
MRQPRSGPGKRRGRGPRIPAATLQKQKTALANVDQITGAKIPKSFVFSRGKLPSTLRHLQQDLRKVMLPYTALNLKEKKRNNLKDFVNVAGPMGVTHFLILSNPQSLPHLRFAKSPQGPTFTFQIEEYSLAADIANSQKRPRCPPGIFKNSPLVVLGGLTGLGNPFRSLVEYFHXMFPSVDPTTVKLATCQRILLLKHDKEKDVIEFRHYSIKLQPVGVSRRIRKLMQNNQVPDLGEFEDVSEFVKKAGYGSESEADDEAAMVSLPSDIDKLNRASRKSAVRLQEIGPRMTMRLVKVEAGLCSGDVLYPWPVEKEVVGKKGTETGEVEGQEDDSEATDESEDEMV

SEQ ID NO: 7743 - protein, 188 aa, Zea mays
FYEAKRKGAKQGPARRQSSSSRSFPGTSRLLTGETVQPDTPQPPEEIVHNIYFWSDGFTVDDGPLRSFNDPEHAAFLESIMKSECPTELAPADGMSKVNVNLIRKEEKCPEPVKRPAPFQGGGRILAAPSENSAPSGISLAAAASSTATTTAPKTITVDDSLPSTSLQIRFADGSRVVGRFNTSHTIS

SEQ ID NO: 7744 - protein, 184 aa, Zea mays
  misc_feature (14)..(14): Xaa can be any naturally occurring amino acid
  misc_feature (43)..(43): Xaa can be any naturally occurring amino acid
PGSTQRSDPFFTEXIASVSDIKFARDGRHILSRDYMTLKLWDXLNMDSGPVATFQVHEYLRPKLCDLYENDSIFDKFECCLSGDGLHVATGSYSNLFRVFGCSPESVEASTLEASRNPMRRQVVDPARPARTLTGAVRRGGENTSVDASGNSCDLSTKLLHLAWHPTENSIACAAANSLYMYYA

SEQ ID NO: 7745 - protein, 100 aa, Zea mays
  misc_feature (47)..(47): Xaa can be any naturally occurring amino acid
  misc_feature (80)..(80): Xaa can be any naturally occurring amino acid
NLFRVFGCSPESVEASTLEASRNPMRRQVVDPARPARTLTGAVRRGXENTSVDASGNSCELSTKLLHLAWHPTENSIACXCLQTKLVLTTLLGKLARRNR

SEQ ID NO: 7746 - protein, 207 aa, Zea mays
PTRPIRLIDLRQSALCDNHAELFEEHEAPGSRSFFTEIIASVSDIKFARDGRHILSRDYMTLKLWDLNMDSGPVATFQVHEYLRPKLCDLYENDSIFDKFECCLSGDGLHVATGSYSNLFRVFGCSPESVEASTLEASRNPMRRQVADPARPARTLTGAVRRGGENTSVDASGNSCDLSTKLLHLAWHPTENSIACAAANSLYMYYA

SEQ ID NO: 7747 - protein, 321 aa, Zea mays
SLVRSSIQLTVIHYHIVRSQQRARRTPAADPAVAGWPRRPVGVVLAECSCWCVRGFAGHEGAAAIQHLSSPSSSSSPTARPPRLLIVSTSGSSSRVLVLILLRAGCVGRLASNAPRRTIRLIDLRQSALCDNHAKLFEEHEAPGSRSFFTEIIASVSDIKFARDGRHILSRDYMTLKLWDLNMDSGPVATFQVHEYLRPKLCDLYENDSIFDKFECCLSGDGLHVATGSYSNLFRVFGCSPESVEASTLEASRNPMRRQVVDPARPARTLTGAVRRGGENTSVDASGNSCDLSTKLLHLAWHPTENSIACAAANSLYMYYA

SEQ ID NO: 7748 - protein, 130 aa, Zea mays
MEVPMNTTQSGPHFPVQHRSLSLDIKGNKTDIVINKYEDTFLVIVTQIGCMGTILAAKKDESVFSNPTYNVSVLFGKRDEPLLLACARQLIEHISGSGSARSLVISLGLKDHSQGTLKDITVAVIDNRLW

SEQ ID NO: 7749 - protein, 385 aa, Zea mays
  misc_feature (186)..(186): Xaa can be any naturally occurring amino acid
  misc_feature (225)..(225): Xaa can be any naturally occurring amino acid
  misc_feature (321)..(321): Xaa can be any naturally occurring amino acid
  misc_feature (338)..(338): Xaa can be any naturally occurring amino acid
  misc_feature (344)..(344): Xaa can be any naturally occurring amino acid
  misc_feature (348)..(348): Xaa can be any naturally occurring amino acid
  misc_feature (351)..(352): Xaa can be any naturally occurring amino acid
  misc_feature (354)..(354): Xaa can be any naturally occurring amino acid
  misc_feature (358)..(358): Xaa can be any naturally occurring amino acid
  misc_feature (366)..(366): Xaa can be any naturally occurring amino acid
  misc_feature (368)..(369): Xaa can be any naturally occurring amino acid
  misc_feature (377)..(377): Xaa can be any naturally occurring amino acid
  misc_feature (383)..(383): Xaa can be any naturally occurring amino acid
MVSNGELSQPQAGEYGLAVMRRRPKTKIVCTLGPASRSVDMIEKLLRAGMCVARFNFSHGSHDYHQETLDNLHAAMERTGILCAVMLDTKGPEIRTGFLKDGKPIQLRKGQEIVISTDYSIKGDDKMISMSYKKLAVDLKPGSVILCADGTITLTVLHCDKEQGLVRCCCENTAMLGERKNVNLPXGVVVDLPTLTEKDREDILQWGVPNKIDMIALSFVRKGSXLVEGQGRYFGEHAKSIMLMSKVENQEGVANFDDILANSDAFMVARGDLGMEIPIEKIFFAQKVMIFKCNIQGKPVVTATQMLESMIKSPRPTRAEXTDVAKRILDGTDCVMLXGETAAXAYSXFAXXTXAKTXCKPESCVXHXXIFKSIWLXSNSMSXLE

SEQ ID NO: 7750 - protein, 208 aa, Zea mays
  misc_feature (161)..(161): Xaa can be any naturally occurring amino acid
MSKMADEKVISAPATGGGEDGLIAGDLSATEARVRPLETLLRAAPLGLCVAAMAVMLRDTQTNEYGTVSYSDLGGFKYLVYANGLCAAYSLVSAFYTAVPRPATLSRSWIVFLLDQVFTYLILAAGAASAELLYLAYNGDKEVTWSEACGVFGGFCRQARXSVAITFGTVLCFILLSLISSYRLFSAYEAPPSSALGSKGVEIPAYPR

SEQ ID NO: 7751 - protein, 146 aa, Zea mays
MPRSGFSGSFRSPKIDVVIDMGNPFLNRTVDGFLKIGAVGACKVAAEETFECLHRGDVSKHKVEHALRKMCKEGAYWGTVAGVYVGMVYGVERVRGRSDWKNAMIGGALSGALISGASNSDRGKVVKDAITAGAVATAVEFINCIT

SEQ ID NO: 7752 - protein, 298 aa, Zea mays
GRALLPPISPLPQSTTPTQPRPEEQEDGMSSGTGKVVCVTGASGYIASWLVKFLLQRGYTVRATVRDTADPKKTLHLQALDGAKDRLHLFKASLLEEGTFDDAVAGCDCVFHTASPFYHNVKDPKAELLDPAVNGTLNVLRSCKKASIKRVIVTSSMAAVAYNGKPRTPDVVVDETWFSSAEVCEKNKQWYVLSKTLAEEAAWKYANDNGLEIITINPTMVIGPLLQPTLNTSTEAILKFINGSSSTYANFCFGWINVKDVALAHILAYEVPSANGRYCMVERVIHHSDLVKIIHEMY

SEQ ID NO: 7753 - protein, 567 aa, Zea mays
LGTSRAGRDAKSNHRSNHAEVFFPTRRSPVLAPRHLVVGHWLTASCNLQPGGRGPLDQRHIRGEESSEDPNDADGEAVTAEQRLLGSPAPGPGCWHLNSSMRSKKIFGLSISLVLINLASILERADENLLPAVYKEVSAAFDAGPTDLGYLTFLMNFLKSIASPLAGVLALHYDRPAVLAIGTAFWALSTGAVGVSQYFGQVAFWRAINGVGLAIVIPALQSFIADSYKDGTRGAGFGLLSLIGSVGGIGGSVLATIVAGGDYYGFPGWRLAFISVAFVSFLIGLLVYLYTVDPRKLSPSHFGGGEDNERLHLVSNGILPPHSIWKDSWIAARSVMKVRTFQIIVLQGIVGSLPWAAVVFFTMWFELIGFDNSSSAALNSFFAIGCASGSFLGGVIADVLSRYYPDSARVMCAQFSAFMGIPFSWILLTVIPQSVDYWSAYAVTLFLMGITISWCATCANNPMFAEVVPPKHRTMIYAFDRAFEGSFGSLAAPAVGLVTEKIYGYNAKAVDLSHGSVDGAYALSRGLLTMMIVPFALCLMFYTPLYTVFKRDRENARLASIKEQELT

SEQ ID NO: 7754 - protein, 228 aa, Zea mays
  misc_feature (78)..(78): Xaa can be any naturally occurring amino acid
  misc_feature (205)..(205): Xaa can be any naturally occurring amino acid
MSTAGKTITCKAAVAWEAGKPLSIEDIEVAPPKANEVRIQIYYTGVCHTDAYTLSGKDPEGAFPIVLGHEGAGIVESXGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCXGLSVVQGAAARKAGKIIRCDVTL

SEQ ID NO: 7755 - protein, 537 aa, Zea mays
  misc_feature (125)..(125): Xaa can be any naturally occurring amino acid
  misc_feature (142)..(142): Xaa can be any naturally occurring amino acid
  misc_feature (156)..(156): Xaa can be any naturally occurring amino acid
  misc_feature (210)..(210): Xaa can be any naturally occurring amino acid
  misc_feature (394)..(394): Xaa can be any naturally occurring amino acid
  misc_feature (425)..(425): Xaa can be any naturally occurring amino acid
TCACVYTYTRPPPPQASLLPPPDSPFASASLVVAVLSCYRDPEEGRKEGRKEGRRGWPEETVRELRASFAAGQTRPAEWRAAQLKGLIRMIDEKEAEISAALHEDLAKPHMESFLHEISLTKSSXKFALKGLKNWMKPEKGXAAITTFPSSAQIVXSPLGVVLIISAWNYPFILSIDPVIGAIAAGNAVVLKPSEIAPATSSLLAKLPTXEYVDNSWYLKLWEGSVPETTALLEQRWDKIFYTGNGTVGRIVMAAAAKHLTPVALELGGKSPVIVDSNVDLHVAAKRIVVGKWGCNNGQACIAPDYIITTKSFAPELVASFKRVLERFYGEDPLESADLSRIVNSKQFKRLTNLIEEKRVADKIVYGGKADEKQLKISPTLLLDVPEDSEIMHXEIFGPLLPIVTVEKIEESFDLINAKPKPLAXAYLFTKNRKLQEEFVASVPAGGMLVNDTALHLTNPYMPFGGVGDSGMGCYHGKFGFDCFSHKKGVLIRGFGGEANARYPPYTTEKQKILRGLINGSFIALILALLGFPREKR

SEQ ID NO: 7756 - protein, 193 aa, Zea mays
MSAVNITNVAVLDNPTAFLNPFQFEISYECLVPLDDDLEWKLIYVGSAEDENYDQQLESVLVGPVNVGTYRFVLQADPPDPSKIREEDIIGVTVLLLTCSYMGQEFMRVGYYVNNDYDDEQLREEPPAKVLIDRVQRNILADKPRVTKFPINFHPEPSTGTGRQQQQQEPQTASPEKHAGSGEGNGSKPEADQ

SEQ ID NO: 7757 - protein, 498 aa, Zea mays
PASAFAWVSMDYLAAAVPVTLALGVGAILLVLRWTYCRRRTSAEEARLPPGSRGLLFLGETLHYLAASSTPGVLPPFFQRRLERYGPIFRTNLVGEDLVVSLDAELNAHVLKQEERGFQIWYPPSFMRVFGADNITAKLGVLHRHMRTLVLRLFGHQTVRSVLLHDVQRSARDELRSWLGRPDVEVRTATSRMIFGVTANKLISHDDAASGGTLWRCFHDWTSGLLSFPVSIPGTTFYRCMQGRKKVMTMLKQQLVERRRNAAERETTEDFFDLVIDELNKPDPMMDESTALDLLFTMLFASHETTSMVLTVILKYLTDNPKALQELTEEHERILESRADPGSDLTWEEYRSMKFTSHVIHESLRLANIALAMFRKANQDVHINGYTIPKGSKIMMCALASHLNTEVYEDPSVFNPWRWKDIPEPVGTSKDFMAFGGGLRLCAGAEFSKMQMAMFLHYLVTNYSWKPVSGGTMLFYPGLQFPEGFHIQLLPKIPNVVP

SEQ ID NO: 7758 - protein, 151 aa, Zea mays
AKSVRRRLQWCHSKLDLLLSRPNNCNKLRQGQTQHLHILFYGTVRTELNYPHAYEDTFLVIVTQIGCMGTILAAKKDESVFSDPTYNVYVLFGKRDEPLLLACARQLIGHISGSGSARGSARSLVISLGLKDHSQGTLKDITVAVIENRLW

SEQ ID NO: 7759 - protein, 556 aa, Zea mays
  misc_feature (94)..(94): Xaa can be any naturally occurring amino acid
  misc_feature (119)..(119): Xaa can be any naturally occurring amino acid
  misc_feature (127)..(127): Xaa can be any naturally occurring amino acid
  misc_feature (141)..(141): Xaa can be any naturally occurring amino acid
  misc_feature (177)..(177): Xaa can be any naturally occurring amino acid
  misc_feature (187)..(187): Xaa can be any naturally occurring amino acid
  misc_feature (221)..(221): Xaa can be any naturally occurring amino acid
MARRAASSLVSRCLLARAPAGAPPAAPSALRRTVPADGMHRLLPGVLQRFSTAAAVEEPITPSVQVNYTKLLINGNFVDSASGKTFPTLDPRTXGEVIAHVAEGDAEDINRAVAAARKXAFDEGPWXPKMTAYERSRILLXRFADLIEKHNDELAALETWDNGKPYEQAAQIEVPMXVARLMRYYAXGWADKIHGLIVPADGPHHVQILHEPIGVAGQIIXPWELPLLMFAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFKKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGIGREKGVDSLKNYLQVKAVVTPIKNAAWL

SEQ ID NO: 7760 - protein, 113 aa, Zea mays
TLLRHPTRIENELPSVPSLSLPEAQVPFISGAANDRDAGYAHATLKAPMVMKEIFIGLTLDLIAGGMWKTHHCNEQKKTRSFYNMLDKDQISGSVQEYLPRAYSEIFFFQECI

SEQ ID NO: 7761 - protein, 553 aa, Zea mays
  misc_feature (16)..(16): Xaa can be any naturally occurring amino acid
  misc_feature (55)..(55): Xaa can be any naturally occurring amino acid
  misc_feature (84)..(84): Xaa can be any naturally occurring amino acid
MARRAASSLVSRCLPXRGPLAGAAAPLPPSALRRTVPADGMHRLLPGVLQRFSTXAAAVEEPITPSVHVNYTKLLINGNFVDSXASGKTFPTLDPRTGEVIAHVAEGDAEDINRAVAAARKAFDEGPWPKMTAYERSRILLRFADLIEKHNDELAALETWDNGKPYEQAAQIEVPMVARLMRYYAGWADKIHGLIVPADGPHHVQILHEPIGVAGQIIPWNFPLLMFAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFNKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGIGREKGVDSLKNYLQVKAVVTPIKNAAWL

SEQ ID NO: 7762 - protein, 107 aa, Zea mays
GTLSKVYKAICLVKPCFEYLEGAFFNYLREVDCSDVEVYSIPEGSVVFPKVPLMRVEGPVAVVQLLETPFVNLINYASLVTTNAARHRHVAGKSKVLLEFGLRRAQV

SEQ ID NO: 7763 - protein, 181 aa, Zea mays
  misc_feature (110)..(110): Xaa can be any naturally occurring amino acid
MSYYGDRRAESSIVEAFTLSPLPYPVILVLLMVTLLLGASWFFTYDDFIEEASQQLSWALLGVPIALVLLIRWISSVDSFEGYLGFYPTESRWKGRYERGPAEGSSPWGXVALLVLLLLVLASFHSTIHDMWGPVNGCSDCSPDSCSVPRAHVCACATGCCLIDRWIDDSMYIFVRGDAAG

SEQ ID NO: 7764 - protein, 286 aa, Zea mays
MSEDPACSRRSRCDLGGDERWLSGPAGDDHFDRLPDALLLVIFNRIGDVKALGRCSLVSLRFHELVPLVDSVLVRVDCVIPDEPPSSSSSSSTPSSPTASVRARGVFSQIARIVLGGIVKPIQALGQILSPANSASGFPASAASSLSSSSSSSSPLPAGDVSHHSPSEVLRSFKELRHLRIELPAGELGMDDGVMLKWKADFGSTLGSCVILGASSASPSPSPSSAGSDSPSAAPSDDSGHTEPDECDDSGSIPESFYTNGGFKLRVVWSISSLIARAPLPLLTVA

SEQ ID NO: 7765 - protein, 202 aa, Zea mays
NFHMAIAAGVAVGVVLHAGAHLTCDFPLLLHASDAKYEPMKPFFGETRPPNYWWFVKGTAGWTGIVMVVLMSISFVLAQPWFRRNKLKDTNPLKKMTGFNAFWFTHHLFAIVYALLIVHGTSLYLTKEWYKKTTWMYIAYPVFLYSCERIVRLFRRHDSVKIQKVAVYPGNVLALYMSKPPGFKYRSGQYIFINCGAVSPYE

SEQ ID NO: 7766 - protein, 90 aa, Zea mays
GINSTYTLQLLSIYEHRIAVQGFIWGINSFDQWGVELGKSLASQVRKQLHGTRMEGKPVEGFNHSTSSLLARYLAVKPSTPYDTTVLPKV

SEQ ID NO: 7767 - protein, 253 aa, Zea mays
LVQCCCCCCKKKKKKKKKKKKKKKKKKKKKKKKKKKKKKKKKKKKKGPARVTDPAAVPGLGTAGAADAAPAGEAAAARVRPVETLLRAAPLGLCVAAMTVMLRDQQSNEYGTVAYSDLGGFKYLVYANGLCAAYSLVSAFYTAVPRPATVSRSWVVFLLDQVFTYLILAAGAAAAELLYLAYNGDKEVTWSEACGVFGSFCRQARTSVAITFGTVLCFILLSLISSYRLFSAYEAPPSSALGSKGVEIAAYPR

SEQ ID NO: 7768 - protein, 578 aa, Zea mays
MLSRLAAARRQLLLSPAVAYRSSSAAATASAVHERAAPASASVLPDTLERGSDAYQRNTAAVGGLLSDLRARVSQVLRGGGAEAVRRNAARGKLLPRDRIDRLLDPGASFLELSQLAGSDVYDEALPSAGIITGIGPVHGRLCMFVANDPTTKGGTYYPLTVKKHLRAQEIASECKLPCIYLVDSGGANLPRQADVFPDRDNFGRIFYNQAKMSSDGIPQIAVVLGSCPAGGAYIPAMADESVIVKGNGTIFLAGPPLVKAATGEEISAEDLGGASVHCKVSGVSDHFAQDEIHGLELGRNIVKNLHLAAKGTNIQSSACGYQEPLYDVEELRSIAPADVKQSFDIRSIIARIVDGSEFDEFKKLYGTTLVTGFARICGQPVGIIGNNGILFTESALKGSHFIELCAQRHIPLIFLQNITGFMVGSKSEASGIAKAGAKMVMAVSCAKVPKITIIVGGSFGAGNYGMCGRAYSPNFLFIWPTARISVMGGIQAAGVLAQIEKNNKKRQGVEWSKDEEEAFKAKVVEAYDREGSPYYSTARLWDDGVIDPADTRRVLSLCLSASAKPVPEDTRYGVFRM

SEQ ID NO: 7769 - protein, 104 aa, Zea mays
SADKHKELTSNELCAWTKEDLHRAEGAMLKVLQVVQTGQWVSWRALRGAASKAVDSQELLDYSLRGLGGKQLDNGLCVAVRCNAGTSAIEYRLESSSVRSPANA

SEQ ID NO: 7770 - protein, 397 aa, Zea mays
  misc_feature (220)..(220): Xaa can be any naturally occurring amino acid
MATVSLTPQAVFSTESGGALASATILRFPPNFVRQLSTKARRNCSNIGVAQIVAAAWSDCPAAAASAAAEVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVPAGGHIVTTTDCYRKTRIYMETELPKRGISXDVIGGCVSGRDELVSKVRIYHHVVGGVLNPNAAYLILRGMKTLHLRVQCQNDTALRMAQFLEEHLKIARVYYPGLPSHPEHHIAKSQMTGFGGVVSFEVAGDFDATRKFIDSVKIPYHAPSFGGCESIIDQPAIMSYWDSKEQRDIYGIKDNLIRFSIGVEDFEDLKNDLVQALEKI

SEQ ID NO: 7771 - protein, 484 aa, Zea mays
  misc_feature (72)..(72): Xaa can be any naturally occurring amino acid
MATVSLTPQAVFSTESGGALASATILRFPPNFVRQLSTKARRNCSNIGVAQIVAAAWSDCPAARPHLGGGGXSAIPNAKVAQPSAVVLAERNLLGSDASLAVHAGERLERRIATDAITTPVVNTSAYWFNNSQELIDFKEGRHASFEYGRYGNPTTEALEKKMSALEKAESTVFVASGMYAAAAMLSALVPAGGHIVTTTDCYRKTRIYMENELPKRGISMTVIRPADMDALQNALDNNNVSLFFTETPTNPFLRCIDIEHVSNMCHSKGALLCIDSTFASPINQKALTLGADLVIHSATKYIAGHNDVIGGCVSGRDELVSKVRIYHHVVGGVLNPNAAYLILRGMKTLHLRVQCQNNTALRMAQVLEEHPKIARVYYPGLPSHPEHHIAKSQMTGFGAGCSFEVAGDFDATRKFIDSVKIPYHAPSFGGCESIIDQPAIMSYWDSKEQRDIYGIKDNLIRFSIGVEDFEDLKNDLVQALEKI

SEQ ID NO: 7772 - protein, 515 aa, Zea mays
  misc_feature (73)..(73): Xaa can be any naturally occurring amino acid
  misc_feature (83)..(83): Xaa can be any naturally occurring amino acid
MATVSLTPQAVFSTESGGALASATILRFPPNFVRQLSTKARRNCSNIGVAQIVAAAWSDCPAARPHLGAPLRXGGGRRARGVXASSHAAAASAAAAASAAAEVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVPAGGHIVTTTDCYRKTRIYMETELPKRGISMTVIRPADMDALQNALDNNNVSLFFTETPTNPFLRCIDIEHVSNMCHSKGALLCIDSTFASPINQKALTLGADLVIHSATKYIAGHNDVIGGCVSGRDELVSKVRIYHHVVGGVLNPNAAYLILRGMKTLHLRVQCQNNTALRMAQFLEEHLKIARVYYPGLPSHPEHHIAKSQMTGFGGVVSFEVAGDFDATRKFIDSVKIPYHAPSFGGCESIIDQPAIMSYWDSKEQRDIYGIKDNLIRFSIGVEDFEDLKNDLVQALEKI

SEQ ID NO: 7773 - protein, 509 aa, Zea mays
  misc_feature (150)..(150): Xaa can be any naturally occurring amino acid
  misc_feature (173)..(173): Xaa can be any naturally occurring amino acid
  misc_feature (196)..(196): Xaa can be any naturally occurring amino acid
  misc_feature (209)..(209): Xaa can be any naturally occurring amino acid
  misc_feature (234)..(234): Xaa can be any naturally occurring amino acid
  misc_feature (269)..(269): Xaa can be any naturally occurring amino acid
MATVSLTPQAVFSTESGGALASATILRFPPNFVRQLSTKARRNCSNIGVAQIVAAAWSDCPAARPHLGGGGPRGRAVASAQAAAASAAASAARAPDVTATPHAKLAQQSAGGVAERNLLGTDAALAAHARARVERRITTDKNTRQVVYKXAWWFNNSQEVIDYKAGRHASSEXGVYGQSSMDALEGKISALVTAVXFLVNIYRMVAIAXILGVYGPASWRISWTKDCDRKRGLXLSNVRPEHGVALRVFWPNDKDPLLFALKTTNVSLXCRESPTNPFLRCIDIEHVSNMCHCKGALLCIDSNFASPINTKALTLGADLVIHSATKYIAGHNDVIGGCVSGRDELVSKVRIYHHVVGGVLNPNAAYLILRGMKTLHLRVQCQNDTALRMAQFLEEHPKIARVYYPGLPSHPEHHIAKSQMTGFGGVVSFEVAGDFDATRKFIDSVKIPYHAPSFGGCESIIDQPAIMSYWDSKEQRDIYGIKDNLIRFSIGVEDFEDLKNDLVQALEKI

SEQ ID NO: 7774 - protein, 494 aa, Zea mays
  misc_feature (404)..(404): Xaa can be any naturally occurring amino acid
  misc_feature (418)..(418): Xaa can be any naturally occurring amino acid
MAAEGEAAALEFTPTWIVAAVCSLIVLLSLVAERCLHYLGKTLKRKNQKPLFEALLKVKEELMLLGFISLLLTVFQGMIRRTCIPERWTFHMLPCEKPDEKAGEAATMEHFVAVGTLGRIGRRLLQEGTAGAEQCQKKGKVPLLSLEAIHQLHIFIFVLAITHVIFSVTTMLLGGAQIHQWKQWENGIKKDAPGNGPKVTNVHHHEFIKKRFKGIGKDSIILSWLHSFGKQFYRSVSKSDYTTMRLGFIMTHCPGNPKFDFHRYMVRVLEADFKKVVGISWYLWVFVVIFLLLNVNGWHTYFWIAFLPLILLLAIGTKLEHVIAQLAHDVAEKHTAVEGDVIVKPSDEHFWFGKPRVILYLIHFILFQNAFEIAFFFWILSTYGFDSCIMGQVRFIVPRLVTGXLIRLPARNSTLPPXAIVTQKGRCPKKEIFNEHVQQGVLGWAQKVKMKKGPKGAASASKDESITNADSAGPSVKIEMAKAGEDVEIVGNPG

SEQ ID NO: 7775 - protein, 444 aa, Zea mays
VKMNPFDRSGKVFQLAYEVECIFLKHFAGNDRKVAMKYIKPQQPRDTHIVTFLVGLSTGTFVSLFIIYSVLAHVAGIFSSTGNTAYMEIVYHVLSMFALISLHVFLYGCNLSMWKGTRINHNFIFDFSSTALTHRDAFLMSASIMCTVVAALVVNLFLRNAGATYANALPGALLLLSAGVLFCPFNIFYRSTRFCFMRVMRNIVLSPFYKVLMADFFMADQLTSQIPLLRHLEFTGCYFMAETFRTHAYGSCTSSSQYKNLAYVLSFLPYYWRAMQCLRRYLEEGHDMNQLANAGKYVSAMVAAAVRFKYAATPTPFWMWMVIASSTGATIYQLYWDFVMDWGFLNPKSKNFWLRDQLILKNKSIYYASMMLNLVLRLAWAESVMKLRLGMVESRLLDFSLASLEIIRRGHWNFYRLENEHLNNAGKFRAVKTVPLPFRELETD

SEQ ID NO: 7776 - protein, 159 aa, Zea mays
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKRTAEKEPKEGKSPKKVAKSPKKADKKA

SEQ ID NO: 7777 - protein, 156 aa, Zea mays
MDASATGAGAKGKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKTAKSPKKAEKKA

SEQ ID NO: 7778 - protein, 89 aa, Zea mays
SRPAENSFYSSRYGSCLGHLEKLKPNLLLDIHLHQHVETLYMEIRHKAIIQYTLPFISVDLNTMAAAFKTSVSMLQKELAALITEDKIQ

SEQ ID NO: 7779 - protein, 528 aa, Zea mays
  misc_feature (122)..(122): Xaa can be any naturally occurring amino acid
MGALRSLAISYPEFLVAGLCFVSLSALRHAMRERRQRAPLSWPVVGMLPFVLANLGRLYDAITDALHGSGCTLMFRGPWLARADFLLTCDPAAVQHCLASNHGGYDRGRDFAEMFDLLGDGXLLVADAASWAAPSGTSPATVFGTPAFRSFVLCTMARQTARLLVPFLDCAAADQEGDGGVVDLEDVFMRYSLDVTYASVFDADLDMLCVAAASAPVPPFGLATRVASESVLFRHIVPAWWWRLLRWLNVGSERRLAEAKAVLNEFVYREIAKRKSRLATTSQAGEGYDLLSLYMAWPREPGMSERQRDQFLRDSAVSYLFAAKDLIVAALTWFFYMLCTHPHVEAKILDELRSLHPTATVAATGGGEHAVFDSDALQPASYLHAAVLETLRLFPPAPFEEKEAVRSDVLPDGTTVAKGTRVIFCIYAMGRMEGLWGSDCHEFRPERWLSDIGRVRHEPSHKFAVFNCGPRSCLGKNLGLSNIKIAAAAILYNFRVELIDGHIVEPQNSVVLLTKNGMRVRIKRRHAA

SEQ ID NO: 7780 - protein, 227 aa, Zea mays
GDWDPRGRPGIIYSFTDRFAGGWSASHYPPPRRSGLISPRPASAILCLDRSVVRQVSKLYIYIYIYIYRRFFERASSEMGSAVLFYCICIAAVVALSSSMVAVGSAAPGETPKFISASALECSANVTEIAKARKLIDVHGHGLCPVRFDHTRGISAVASSCKDRPLPSPERCCGALKAYACPYSELINDNANNGCASEMFYVIMTRGRLRPGLFSQLCVEGPLGLQC

SEQ ID NO: 7781 - protein, 185 aa, Zea mays
FLLDRPAQFCGSIDRSVIRQVSKLYIYRRLFERASEMGSAVLFYCICIAVVVALSSSMVAVGSAAPGEPPKFISASALECSANVTEIAKARKLIDVHGHGLCPVRFDHTRGISAVASSCKDRPLPSPERCCGALKTYACPYSELINDNANNGCASEMFYVIMTRGRLRPGLFSQLCVEGPLGLQC

SEQ ID NO: 7782 - protein, 203 aa, Zea mays
GGWSASHYPPPRRSGLISPRPASAILWLDRSVGRKASEQAIYIYRRFFERASSEMGSAVLFYCICIAVVVALSSSMVAVGAAAPGETPKFISASALECSANVTEIAKARKLIDVHGHGLCPVRFDHTRGISAVASSCKDRPLPSPERCCGALKAYACPYSELINDNANNGCASEMFYVIMTRGRLRPGLFSQLCVEGPLGLQC

SEQ ID NO: 7783 - protein, 419 aa, Zea mays
PTRPVLLRFADLIERHAEEVAALETWDNGKTLAQAAGAEVPMVARCVRYYAGWADKIHGLVAPADGAHHVQVLHEPVGVAGQIIPWNFPLLMFAWKVGPALACGNTVVLKTAEQTPLSALYVANLLHEAGLPEGVLNVVSGFGPTAGAALCSHMGVDKLAFTGSTGTGQIVLELAARSNLKPVTLELGGKSPFIVMDDADVDQAVELAHQAVFFNQGQCCCAGSRTFVHERVYDEFVEKSKARALKRVVGDPFRDGVEQGPQIDGEQFNKILRYVQSGVDSGATLVAGGDRVGDRGFYIQPTVFADAKDEMKIAREEIFGPVQTILKFSGVEEVIRRANATPYGLAAGVFTRSLDAANTLSRALRAGTVWVNCYDVFDATIPFGGYKMSGVGREKGIYALRNYLQTKAVVTPIKNPAWL

SEQ ID NO: 7784 - protein, 115 aa, Zea mays
AFQLSLVRVLALGTSLNFENNRLRRFFCILHQVLFLTEGGTSKHHDPRRNSFDDAVRVCLEYDLHGIVSEARGVLKNPSAVARAQESNLALLTYGQLNNVWEAVYIQYLMGVHGV

SEQ ID NO: 7785 - protein, 177 aa, Zea mays
AFQLSLVRPLAPGSSLFFENNRLRRFFCTLHQVLFLTEGGTSKHHDPRRNSFDDAVRVCLEYDLHGIVSEARGVLKNPSAVARAQESNLALLTYGQLNNVWEAVYIQYLMGVHGVIVDRVEEISDAVAGFGLGKPGLGRGRGGAGVDGAKTHQAQAFSQQQLGFLLRLIPELIEQRH

SEQ ID NO: 7786 - protein, 593 aa, Zea mays
MMALNLSAPAPAPALQLQTMTVDPAPAHAPDAVKPDLAMACQALVEAAPEAEHADVAAELRSRAGVPVFVMMPLDTVRKDGNSLNRRKAVPTRPAALKSAGVEGIMVDVWWGIAEADGPGQYNFNGYMELMEMARKTGLKVQAVMSFHQCGGNVGDSVTIPLPGWVLEEMDKDQDLAYTDRSGRRNYEYVSLGCDAMPVLKGRTPIQCYADFMRAFRDHFATFMGNTIVEIQVGMGPAGELRYPSYPESDGTWSFPGIGEFQCYDRFMLSSLKAAAEAVGKPEWGNAGPGDSGSYKDWPEDTGFFRREGGWSTEYGEFFMSWYSQMLLEHGERILSAATGVFTGSPGVKISVKVAGIHWHYGTRSHAAELTAGYYNTRSHDGYAPIARMLARHGAVLNFTCVEMRDHEQPQDAQCRPEALVQQVAAAAREAGVGLAGENALPRYDDTAHDQVVATAADRAAEDRMVAFTYLRMGPDLFQPDNWRRFAAFVKRMTEPGAREACREQVEREAEGVAHATQPLVHEAAVALPAGPDRPAFPVACVRSLDGAARCDDYLYGESSLYLLIHKLRRRVVGARVHRAVVCVQRKLRLRAR

SEQ ID NO: 7787 - protein, 407 aa, Zea mays
LQREGRVLRGLSSPHIVPCLGSRAAAGGEYQLLLEFAPGGSLADEAARSGGGRLAERAIGAYAGDVARGLAYLHGRSLVHGDVKARNVVIGGDGRARLTDFGCARPAGGSTRPVGGTPAFMAPEVARGQEQGPAADVWALGCMVVELATGRAPWSDVEGDDLLAALHRIGYTDDVPEVPAWLSPEAKDFLAGCFERRAAARPTAAQLAAHPFVVASASAAAAIRGPAKQEVVPSPKSTLHDAFWDSDAEDEADEMSTGAAAERIGALACAASALPDWDTEEGWIDLQDDHSAGTADAPPAPVADYFISWAEPSDAELEPFVAVAAAAGLPHVAGVALAGATAVNLQGSYYYYPPMHLGVRGNEIPRPLLDHHGDGLEKGQGSHRVCNRETEKVTMKRISLKEDPLSL

SEQ ID NO: 7788 - protein, 126 aa, Zea mays
GPRGLFFFFFYINNKRLQIATLLRSLGGSFSWAVFQWFYTGGDGCGFQAFPLFGLEAYKKRFYFDFSPSLVGIGMICPPMVNFSLLLGAVVSSAILWPILQGKRGEWYDADASPSSLRGLNGYKVT

SEQ ID NO: 7789 - protein, 136 aa, Zea mays
  misc_feature (43)..(43): Xaa can be any naturally occurring amino acid
  misc_feature (55)..(55): Xaa can be any naturally occurring amino acid
  misc_feature (62)..(62): Xaa can be any naturally occurring amino acid
  misc_feature (90)..(90): Xaa can be any naturally occurring amino acid
  misc_feature (108)..(108): Xaa can be any naturally occurring amino acid
  misc_feature (113)..(113): Xaa can be any naturally occurring amino acid
SLFYSLPPEDYVAATLVLAGDGRYLNKEAAHDIIKIGARKGMXKKIIVGRNGLLXTPAEAAXIRKRKANGGFIMSASHNSGGPDNDWRIXFNYRSGQPAPETITDQIXGNTLXIAEVQTADIPDTDLSFEGVVSYG

SEQ ID NO: 7790 - protein, 153 aa, Zea mays
STARQGSISIFAVNRLGHPRLARVSGRTSPRPADDTLFLRLCRRTIAVRTWPSPRPCAPAVVPDIAAQLDLASACIDGAESMMAAPAAAGRPPLVVVGHRGKGMNALASPDERLREVKENSVRSFNDAARVAGVGYVEFDVQVTKDGCPVVFH

SEQ ID NO: 7791 - protein, 126 aa, Zea mays
MPTRLPLRLLLLVLAIAGAAHGRRGISFSDDDRSLLLAGSSDEVAGATSVLRLPSAAGEDPPPQACEMTYGFLPCTDTAPGNLFLVLAYGLLMFKAATYLSAGSELLLEVLGPGVVGGLFLPILGA

SEQ ID NO: 7792 - protein, 481 aa, Zea mays
  misc_feature (165)..(165): Xaa can be any naturally occurring amino acid
  misc_feature (276)..(276): Xaa can be any naturally occurring amino acid
PNASGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNMMFQLATTLGIFTANLINYGTQNIKPWGWRLSLGXLAAVPALLMTLGGLFLPETPNSLIERGRVEEGRRVLERIRGTADVDAEFTDMVEASELANTVEHPFRNILQPRNRPQLVMAVCMPAFQILTGINSILFYAPVLFQSMGFGXGNASLYSSVLTGAVLFSSTLISIGIVDRLGRRKLLISGGIQMIVCQVIVAVILGVKFGAEKQLARSYSVAVVVVICLFVLAFGWSWGPLGWTVPSEIFPLETRSAGQSITVAVNLLFTFAIAQAFLSLLCAFKFGIFLFFAGWITVMTVFVYVFLPETKGVPIEEMVLLWRKHWFWKKVMPDMPLEDGWGAAEGHAAPASNNHKG

SEQ ID NO: 7793 - protein, 542 aa, Zea mays
  misc_feature (136)..(136): Xaa can be any naturally occurring amino acid
  misc_feature (395)..(395): Xaa can be any naturally occurring amino acid
  misc_feature (404)..(404): Xaa can be any naturally occurring amino acid
LGTSRPAGDTHTALTETPTRDPDGSSPPPLQVSTVRLNCISRTPLPRVLGNRLHPALLLLIGAGACLLGYGTAWLLVSGVAPALPYWLICVAVRLATNGGAWLATAVLVTNMRNFPVSRGAVAGILKGYSGLSAAXFPAEIYTGVLRDSPINLLLSLALGIPAVCLLGMYFVQPCEPSLVETNAEQVHFMFAQVASVLLGVYLVGATILDHVVAVNDIMNYSLLVVMVLLIFAPLAIPLKMTLFPKKKTPSDSHSPTVDNDHTQPLLPSSSESNLGNLEEDDSTDIDVLLAEGEGAIKPKRRRPRRGEDFRFREAILKADFWLLFAICFVGIGSGITVLNNLAQIGIAAGAVDTTISLSVFSFCNFFGRLGGGAVSEYLVRSRTLPRSVLVICTXQVVMIITYXWLFALGRLATLYVSVALLGVCFGISLSVIISTSSELFGLKHFGKIFNFIALANPVGAFLFNTLAGYVYDLEVEKQHATASGSDVACHGPNCFRLTFFVLSGVACLGTLLSTVLTVRVRPVYQMLYAGGSFSQPRNPAH

SEQ ID NO: 7794 - protein, 299 aa, Zea mays
RPSVCPASSHSRARGGGHTKPLWASSSESNLGNLEGDDSTDIDVLLAEGEGAIKPKRRRPRRGEDFRFREAILKADFWLLFAICFVGIGSGITVLNNLAQIGIAAGAVDTTISLSVFSFCNFFGRLGGGAVSEYLVRSRTLPRSVLVICTQVVMIITYLLFALGRLATLYVSVALLGLCYGVLLSVVISTSSELFGLKHFGKIYNFITLANPVGAYLFNTLAGYVYDLEVERQHAAAAAAGSDVVACHGPSCFRLTFCVLAGAACLGTLLSTVLTVRVRPVYQMLYAGGSFSQPRNSAH

SEQ ID NO: 7795 - protein, 181 aa, Zea mays
MASSIVSSAAAATRSNVAQASMVAPFTGLKSAASFPVTKKNNNVDITSLASNGGRVRCMQVWPPINMKKYETLSYLPDLSDEQLLSEIEYLLKNGWVPCLEFETERGFVYRENNSSPGYYDGRYWTMWKLPMFGCTDATQVLAEVQEAKKAYPQAWVRIIGFDNVRQVQCISFIAYKPEGF

SEQ ID NO: 7796 - protein, 346 aa, Zea mays
MGVDYYKVLQVGRGASDDELKKAYRKLAMKWHPDKNPSNKKEAEAKFKQISEAYEVLSDSQKRAIYDQAGEEGLKAQVPPTGAGGPSGSSFYGGNASTFQFNPRSADDIFAEFFGFSSPFSTMGGMGGGAERGMRGSRFGMFGDDIFGSHPQFPGEASMHVPQRSQKVPPIENRLPCNLADLYKGTTKKMKISREVLDASGRTLVVEEILTIDIKPGWKKGTKITFPEKGNEAPHIIPADIVFIIDEKPHDVFTRDGNDLVMTQKITLAEALTECTVNITTLDGRNLTVQINNIIYPGYEEVVPREGMPIQKDSSKKGNLRIKFSIKFPSRLTSEQKAEIKRLLGS

SEQ ID NO: 7797 - protein, 682 aa, Zea mays
MDLARRGGAAGADDEGEIERHEPAPEDMESDPAAAREKELELERVQSWREQVTLRGVVAALLIGFMYSVIVMKIALTTGLVPTLNVSAALMAFLALRGWTRVLERLGVAHRPFTRQENCVIETCAVACYTIAFGGGFGSTLLGLDKKTYELAGASPANVPGSYKDPGFGWMAGFVAAISFAGLLSLIPLRKVLVIDYKLTYPSGTATAVLINGFHTKQGDKNARMQVRGFLKYFGLSFVWSFFQWFYTGGEVCGFVQFPTFGLKAWKQTFFFDFSLTYVGAGMICSHLVNISTLLGAILSWGILWPLISKQKGEWYPANIPESSMKSLYGYKAFLCIALIMGDGTYHFFKVFGVTVKSLHQRLSRKRATNRVANGGDEMAALDDLQRDEIFSDGSFPAWAAYAGYAALTVVSAVIIPHMFRQVKWYYVIVAYVLAPLLGFANSYGTGLTDINMAYNYGKIALFIFAAWAGRDNGVIAGLAGGTLVKQLVMASADLMHDFKTGHLTMTSPRSLLVAQFIGTAMGCVVAPLTFLLFYNAFDIGNPTGYWKAPYGLIYRNMAILGVEGFSVLPRHCLALSAGFFAFAFVFSVARDVLPRKYARFVPLPMAMAVPFLVGGSFAIDMCVGSLAVFVWEKVNRKEAVFMVPAVASGLICGDGIWTFPSSILALAKIKPPICMKFTPGS

SEQ ID NO: 7798 - protein, 485 aa, Zea mays
MGSVPEEKAKLGFGGLVGDLREVYESGRTQGLEWRQSQLRGLVRLLEEKEEEIFDVLHEDLGKHRGEAFRDEVGVLKKSVVDKLQNLKNWAAPEKAHTPLVAFPATALVVPEPLGVVLVFSCWNLPIGLALEPLSGALAAGNAVVVKPSELAPATSAFLAANIPKYLDSKAVKVVEGGPEVGEKLMEHRWDKVLFTGSSRVGRLIMAQAAKHLTPVALELGSKCPCIVDWLDSDRDSQVAVNRIIGAKWSTCSGQACIAIDYLLVEEEFAPILIEMLKSTLERFFTKPEYMARILNEKQFQRLSGFLADRRVASSVVHGGHFNPKTLSMEPTLLLNPPLDSDIMTEEIFGPLLPIITVKKIEDSIKFLRSKPKPLAIYAFTRNEKLKQRIIDETSSGSITFNDAIVQYGLDSIPFGGVGHSGFGQYHGKYSFDMFSHKKAVLKRSFLVEFMFRYPPWDETKIGMLRRVYRFDYVSLFLALIGLRR

SEQ ID NO: 7799 - protein, 257 aa, Zea mays
  misc_feature (232)..(232): Xaa can be any naturally occurring amino acid
MATTNWTLPDHPTLPKGKTVAVVVLDGWGEASPDQYNCIHVAQTPVMDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVRLIVKGASERGAKRIRLHILTDGRDVLDGSSVGFVETIEKDLAQLREQGVDARIASGGGRMYVTMDRYENDWSVVKRGWDAQVLGETXTQIPNALEAVETLRAEPKPNDQYLP

SEQ ID NO: 7800 - protein, 469 aa, Zea mays
MMMQLGARSLVRRFSRLAAAGAPAETTSAGVPRMPAFDHVPLPYDGPSAADIARKRAEYLSPSLFHFYSKPLNIVEGKRQYLYDEHGRRYLDAFAGIATVCCGHCHPDVVDAITRQAKRLQHSTVLYLNHVIADFAEALASKLPGDLKVVFFTNSGTEANELAILMARLYTGSHDIISLRNSYHGNAAGTMGATAQKNWKFNVIQSGVHHAVNPDPYRGAFGSDAEKYVRDVQEIIEFGTTGQVAGFISEAIQGVGGIVEVSPGYLPLAYDKVRKAGGLCIADEVQAGFARVGSHFWGFETHGVVPDIVTMAKGIGNGIPLGAVVTTPEVAQVLTRRCYFNTFGGNPLCTAGGLAVLEVLEKERLQENAFVVGSYLKDRLRGLQEKHEIIGDVRGTGFMLGIELVTDRQLKTPAKDEICHAMEHMKDMGVLVGKGGFYGNVFRITPPLCFTKEDADFFVEVMDIALSKL

SEQ ID NO: 7801 - protein, 435 aa, Zea mays
MEMKLTIRRVPTVVSNYQEDADKPRAGCGRNCLGDCCLPASKLPLYAFKLTPAKGSQEDAASTKLLVDILLSEWEDRMTRGLFRYDVTACETKVIPGNLGFVAQLNEGRHLKKRPTEFRVDRVLQPFDPAKFNFTKVGQEEVLFQFENSGGDDSYFLNNAPIIAVDRAPNVIAINVSPIEYGHVLLIPRVLDRLPQRIDPESFLLALQMAAEGGSPYFRLGYNSLGAFATINHLHFQAYYLSVPFPVEKAATHKIPLSEDTKKNGVTVSKLINYPVRGLVFEGGNTLDDLATVVSNACIWLQDNNVPYNVLISDCGKRVFLFPQCYAEKQALGEVSQELLDTQVNPAVWEISGHMVLKRRMDYEEASETSAWKLLAEVSLSEERFEEVKAYIFSAAGLVQYDEEEEEASDGEGPTAYVPVKVTPLPVAEGCLVLP

SEQ ID NO: 7802 - protein, 506 aa, Zea mays
  misc_feature (155)..(155): Xaa can be any naturally occurring amino acid
  misc_feature (167)..(167): Xaa can be any naturally occurring amino acid
  misc_feature (173)..(173): Xaa can be any naturally occurring amino acid
  misc_feature (192)..(192): Xaa can be any naturally occurring amino acid
MASPAMVPLRQLFVDGEWRPPAQGRRLPVVNPTTEAHIGEIPAGTAEDVDAAVAAARAALKRNRGRDWARAPGAVRAKYLRAIAAKVIERKPGLAKLEALDCGKPYDEAPWDSDDVAGCFECFAHPLSSNIVTGLGPDACAPLSSHANSDKVYFXLVGLIPVRNYPXLMATWXKPAPALAAGKRAMLVFDDXAIDKAVEWTSVWVLLGLSSGVLDNDPVLGPDAGAPLSAHPDVDKVAFTGSFETGKKIMASAAPMVKPVTLELGGKSPIVVFDDVDIDKAVEWTLFGCFWTNGQICSATSRLLIHTKIAKKFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTQYGLAGAVISGDRERCQRLSEEIDAGCIWVNCSQPCFCQAPWGGNKRSGFGRELGEGGIDNYLSVKQVTEYISDEPWGWYQSPSKL

SEQ ID NO: 7803 - protein, 98 aa, Zea mays
MPGGSSGPDGEVDAGFAKLQGEDFEYYMQTYSIMLGRNSKKSTVDVDLSSLGGGMNISRHHARIFYDFQRRRFALDVIGKNGCLVEGVLHLPGNPPVK

SEQ ID NO: 7804 - protein, 397 aa, Zea mays
  misc_feature (103)..(103): Xaa can be any naturally occurring amino acid
AASKLPLYAFKLTPAKGSQEDAASTKLLVDILLSEWEDRMTRGLFRYDVTACETKVIPGNLGFVAQLNEGRHLKKRPTEFRVDRVLQPFDPAKFNFTKVGQEXVLFQFENSGGDDSYFLNNAPIIAVDRAPNVIAINVSPIEYGHVLLIPRVLDRLPQRIDPESFLLALQMAAEGGSPYFRLGYNSLGAFATINHLHFQAYYLSVPFPVEKAATHKIPLSEDTKKNGVTVSKLINYPVRGLVFEGGNTLDDLATVVSNACIWLQDNNVPYNVLISDCGKRVFLFPQCYAEKQALGEVSQELLDTQVNPAVWEISGHMVLKRRMDYEEASETSAWKLLAEVSLSEERFEEVKAYIFSAAGLVQYDEEEEEASDGEGPTAYVPVKVTPLPVAEGCLVLP

SEQ ID NO: 7805 - protein, 159 aa, Zea mays
MGSGLSSSSSHRSSGASSSLHQPPAAAPALVVAVDGSLREFVTPAAVPLLPPVSVSDVLGANADDGRSFVCSSSALYFETDVPALGASELLRPGQLYFVLPAAMLGRPLSGADMAALAVRASQALAAGARPPRGGRRPLRSTRARVMAAAAAHHAHAHV

SEQ ID NO: 7806 - protein, 474 aa, Zea mays
GRLLLLAGTNQEQQAPASGLTHPLGHCGDLNRNVLAPAAPFVKKDILFAQQTAENIAALLTPQSGAYYDLWVDGEKIMSAEEPPEVTKARNDNSHGTNFPDSPEPIYGTQYLPRKFKVAVTAAGDNSVDILTNDIGVVVVSDDAGEPIGFNIYVGGGMGRTHRVETTFPRLADPLGYVPKEDILYAIKAIVVTQRENGRRDDRKYSRMKYMIDRWGIDRFRAEVEKYYGKKFESFRPLPEWQFNSYLGWQEQGDGKLFYGVHVDNGRVGGQAKKTLREIIEKYNLDVSITPNQNLILCGIDQAWREPITTALAQAGLLEPKDVDPLNLTAMACPALPLCPLAQTEAERGILPILKRIRAVFNKVGIKDSESVVVRITGCPNGCARPYMAELGFVGDGPKSYQIWLGGTPNQSTLAESFMDKVKLDDIEKVLEPLFTYWNGTRQEGESFGSFTNRTGFDKLKEVVNKWAESPSAA

SEQ ID NO: 7807 - protein, 341 aa, Zea mays
  misc_feature (55)..(55): Xaa can be any naturally occurring amino acid
  misc_feature (152)..(152): Xaa can be any naturally occurring amino acid
MTMRRCQTGPGPVLAARSPGLGNVDNLHESSSLSRSWDLNRQIDDDRDVLIEWRXAHKSFGEKQVLRGVSFKIRHGEAVGIIGPSGTGKSTILKVMAGLLAPDKGDVIICGKKRHGLVSDEDIEGLRIGLVFQSAALFPGLTVRENVGFLLXGNMPARRSFFSNCFCSAFIFDTSILCFRYENSSLPEDRIGKLVTETLAAVGLKGVEDRMPSELSGGMKKRVALARSIIFDDTKDVVEPEVLLYDEPTAGLDPIASTVVEDLIRSVHMTGRDALGKPGKIASYVVVTHQHSTIRRAVDRLLFLHEGKVVWEGMTHEFTTSANPIVQQFASGSLDGPIKYF

SEQ ID NO: 7808 - protein, 85 aa, Zea mays
GSKRITLGALPLGGGGASPLHLRRGGRVAHATLKGPSVVKEIFIGLTLGLIAGGMWKMHHWNEQRKTRSFYDMLDKGQISVVVEE

SEQ ID NO: 7809 - protein, 140 aa, Zea mays
MRSCLFSSVALWSVVIVSARRPEPPTSTGHSLANSLGGPLKGRPRRGAARHGSKTNYPRCPPSRRRRRKSPSSPARQMAGGRVAHATLKGPSVVKEIFIGLTLGLIAGGMWKMHHWNEQRKTRSFYDMLDKGQISVVVEE

SEQ ID NO: 7810 - protein, 421 aa, Zea mays
MSCLCWFKRRSRKGRSSSSGKRGASSTATVSVSGPATATATTTTTTTASAESTSRSDDSGAVRPVSKSAGSSQSQRSISSLYEERGHGQLRVFDYDELQGATAEFGRAQKLGEGGFGSVYKGFIRAADGKGDRVPVAVKKLNQRGMQGHKQWLAEVQFLGVLEHPNLVKLLGYCAVDSERGAQRLLVYEFMPNKSPRGRPGRRANPPLPWNTRLQVILGAAEGLAYLHEGVEVQVIYRDFKTSNVLLDKDFRAKLSDFGLAREGPTGANTHVSTAVVGTHGYAAPEYMDTGHLTAKSDVWSFGVVLYEILTGRRSLDRNRPAAEQKLLEWVAQFPPDSRNFRMIMDPRLRGEYSVKAAREIAKLADSCLLKNAKERPTMSEVVEVLGRAVQAHAEPDSGAPGPGAKGKKTDAATPSRRRRD

SEQ ID NO: 7811 - protein, 218 aa, Zea mays
  misc_feature (184)..(185): Xaa can be any naturally occurring amino acid
  misc_feature (188)..(189): Xaa can be any naturally occurring amino acid
  misc_feature (192)..(195): Xaa can be any naturally occurring amino acid
  misc_feature (197)..(198): Xaa can be any naturally occurring amino acid
  misc_feature (206)..(206): Xaa can be any naturally occurring amino acid
  misc_feature (208)..(209): Xaa can be any naturally occurring amino acid
  misc_feature (211)..(211): Xaa can be any naturally occurring amino acid
  misc_feature (215)..(215): Xaa can be any naturally occurring amino acid
  misc_feature (217)..(217): Xaa can be any naturally occurring amino acid
MGASQSQLESQPELNPQSQPQAQPELPPHSQSQSQPLYRHQPQPHEPTGREVRSTSRRDSWLLSPQNDPKPSTDSTKAVHNDKVVKASETQSMMPVKPLKQMNLPHNCEHILKDADSPVDKSSREKLCDQLYAGVFLDHKTKRYWLDKKSHGNCFMLYARALSITWAEDQRYWKWVQEKDASGXXTEXXELXXXXWXXVHGRFDTXKXXPXNLYXVXF

SEQ ID NO: 7812 - protein, 403 aa, Zea mays
  misc_feature (153)..(153): Xaa can be any naturally occurring amino acid
  misc_feature (194)..(194): Xaa can be any naturally occurring amino acid
MAAAHYGNGSSTSGGGGGRGRGKPITCKAAVAWGPGVPLSLEEVEVAPPGPMEVRVKVLFTSICHTDLSAWKGECEAQRKYPRILGHEAAGVVESVGEGVEGLAPGDHVVPIFTGECEKCVYCKSDKTNLCGTYRVDPLKSSMVYDDGTRFSXWTSRQATGRPVYHFLNTSTFTEYTVLDAACAVKINPEAPLXRMCLLSCGISTGVGAAWNTANVSARSTVAVFGLGAVGLAVAEGARLRGATRIIGVDVNPSKFTKGKEMGITDFIDPNDICDKPVHEVIREMTDGGVDYSFECTGINDVLREAFLSTHDGWGLTVVLGIHSTPKMVPLHPMELYSRRITGCVFGDFKGKSQLPDLVDKCVNGEVNINFDGFITHKMPFSYINKAFRLLEEGKSLRCLLSL

SEQ ID NO: 7813 - protein, 557 aa, Zea mays
MGCVFGRAAASSSAAPKKKWGKGRSSPQPEAGSPSAVAATDGDGRPRRRLGGRRASGPRQGCVPAAAAAEQLAAGWPPWLVAVAGEALRGWAPRRADTFEKLNKIGSGTYSNVYRARDTVSGRIVALKKVRFDNLEPESVKFMAREILILRRLDHPNIIKLEGLVTSRMSCSLYLVFEYMEHDLAGLAASCDVKFTLPQIKCYIQQLLSGLEHCHDNNVLHRDIKGSNLLLDNNGILKIADFGLATFFDPRHKRPMTSRVVTLWYRPPELLLGATEYSVGVDLWSAGCILAELLYGKPIMPGRTEVEQLHKIFKLCGSPSEEYWKKSKLPHATIFKPQQPYKRCIRETFKDFPTSALPLVETLLAIDPAERQTASAALHSDFFSTEPYACNPSSLPTYPPSKEMDAKLRDEEARRLRAAAKAKGEQKRTRPRDRSRRAGPAPEANAEIQANLDQRRRMITHANAKSKSEKFPPPHQDGGTGNPLGSYHHMEPMFEHQDASFSTVVPIEKGTSQTWSGPLFDPAALGQSRRKKQTTLDAKAAAYSKQLQKEKGGIRAR

SEQ ID NO: 7814 - protein, 517 aa, Zea mays
MAPKKRKADPAESPAAVEAATTNHRHEPASSEPKPRGSIYFPITDDPPEPNAAEEDEDEGAGDDEDDAEDIVKLLEPLSREQLVALLRTAAEASPATMAAVRRAVEADPASRKLFVHGLGWGAGAEDLRSAFSRFGELEDCRVISDKQSGRSKGYGFVLFRSRRSALRALNRPQLQIGGRLAFCHLAASGPAPPASQSQNPISNANPNANSNSTSNASGSSSSQTDNMQRKIFVGNVHADVDVDRLYNYFAQFGEIEEGPFGFDKNTGKPKGFALFVYKSVESARRALEEPMKNFDGKTLNVQKAIDGRTKGSSGTNTNANSNPTTASVAAAAAAAQMTAPATAAISPYDASAYGATAVPDMSFAQQAAMLGFGAQQQAFAQPNAMLAMIAAMQNPAALGMTPAMFAAMNPAFAAAALGAGGQQAQTAGLTGFGAQGFGTQAFGAGGAAFPNAAGVQAATAAYQGGGAPPGFQGPPGFQVGQATTQTSTAVAAAGYQAGAAGQGQVPGAQIGGTGFQ

SEQ ID NO: 7815 - protein, 292 aa, Zea mays
MGKDDVVESGAGGGEFAAKDYTDPPPAPLVDAAELGSWSLYRAVIAEFIATLLFLYVTVATVIGYKHQTDASASGATADAACGGVGVLGIAWAFGGMIFVLVYCTAGISGGHINPAVTFGLFLARKVSLVRALLYVVAQCLGAVCGVGLVKAFQSAYFDRYGGGANSLASGYSRGAGLGAEIVGTFVLVYTVFSATDPKRNARDSHVPVLAPLPIGFAVFMVHLATIPVTGTGINPARSLGAAVVYNKDKPWDDHWIFWVGPLLGAAIAAFYHQYILRAGAIKALGSFRSNA

SEQ ID NO: 7816 - protein, 290 aa, Zea mays
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 7817 - protein, 204 aa, Zea mays
  misc_feature (188)..(188): Xaa can be any naturally occurring amino acid
  misc_feature (192)..(192): Xaa can be any naturally occurring amino acid
  misc_feature (195)..(195): Xaa can be any naturally occurring amino acid
  misc_feature (200)..(200): Xaa can be any naturally occurring amino acid
  misc_feature (202)..(202): Xaa can be any naturally occurring amino acid
ELPAVAAALELWIPRAAGIRHQERERERESSLVPPPPPFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTXSVIXGVXAASGXEXST

SEQ ID NO: 7818 - protein, 618 aa, Zea mays
MEPFFLFVGLALVLCFLTPYYRHLQSKKTSPLEPTEWPIVGHLPGLVANIHHFHDWATGVLAGVGYNFEARAGRTGVRYFITCDPSNVRHIFTSNFANYPKGEEYAAIFDVLGGGIFNADGESWRRQRVKAQMLMTGPRFRAFTARCSRDKVERSLLPFLAHHAADDGRTPPCDLHDVFLRLTFDMTCTLVFGVDPGCLAFGLPVVPFARAMDDALETLFLRHIIPMACWKLMHVLEVGQERKMAAARRTIDSFVAATVAKRRADKLKGCECCVSNSYDLLSSFICHEEDGSSENDDDVFLRDTTVNLLLAGRDTTGAALSWFFYLVSKNPRVEQKILDELTPIAASRRTKGAEDAAHAASGMVTFDADELGSLVYLHAALSECLRLYPSVPFEHKVADKVLVFNYSMGRMEGVWGKDCTEFRPERWLNEDGTKLRYEPSYKFISFNAGPRTCLGKEMAFVQMKAVAAAVLWNFAVEVVPGHVVEPKLSIILHMKNGLAVKVTRRDGTGRRRRRRACVTPLAFLWSRLGPAPRGVSPARLCALRGAWAFTLHDTFQYACGRTWHMVSSCTLASAPMGMGLLGMVYIFHSYMVLLVTLYVSGSFHPTLSVCVHSFHFLE

SEQ ID NO: 7819 - protein, 522 aa, Zea mays
MEPFFLFVGLALVLCFLTPYYRHLQSKKTSPLEPTEWPIVGHLPGLVANIHHFHDWATGVLAGVGYNFEARAGRTGVRYFITCDPSNVRHIFTSNFANYPKGEEYAAIFDVLGGGIFNADGESWRRQRVKAQMLMTGPRFRAFTARCSRDKVERSLLPFLAHHAADDGRTPPCDLHDVFLRLTFDMTCTLVFGVDPGCLAFGLPVVPFARAMDDALETLFLRHIIPMACWKLMHVLEVGQERKMAAARRTIDSFVAATVAKRRADKLKGCECCVSNSYDLLSSFICHEEDGSSENDDDVFLRDTTVNLLLAGRDTTGAALSWFFYLVSKNPRVEQKILDELTPIAASRRTKGAEDAAHAASGMVTFDADELGSLVYLHAALSECLRLYPSVPFEHKVADKVLVFNYSMGRMEGVWGKDCMEFRPERWLNVEGTKLRYEPSYKFISFNAGPRTCLGKEMAFVQMKTVAAAVLWNFAVEVVPGHVVEPKLSIILHMKNGLAVKVTRRDDGTAPSSSCVRHTACF

SEQ ID NO: 7820 - protein, 543 aa, Zea mays
  misc_feature (405)..(405): Xaa can be any naturally occurring amino acid
PRVRPFFLFIELALVLCFITLYYRHLQSKKTSPLEPTEWPVVGHLPGLVANIHRFHDWATGVLAGVGCNFEARGGRTGLRYFITCDPSNVRHIFTSNFANYPKGEEYAAIFDVLGGGIFNADGESWRRQRVKAQMLMTGPRFRAFTARCSRDKVERSLLPFLAHHAAADDEGRPTPCDLHDVFLRLTFDMTCTLVFGVDPGCLALGLPGVPFARAMDDALETLFLRHITPTACWKLMSVLGVGQEKKMAAARRTIDCFVATTVAKRRADKLREGEGEGVCSSFDLLSSFICHEDDSSENDDDDDVFLRDTTVNLLLAGRDTTGAALSWFFYLVSKNPRVEQKLLDELAPIVASRRRAGGAAADAASGMVTFDADELGSGLVYLHAALSECLRLYPSVPFEHKVAXAADVLPSGKELKAGDKVLVFNYSMGRMEGVWGKDCTEFRPERWLNEDGTKLRYEPSYKFISFNAGPRTCLGKEMAFVQMKAVAAAVLWNFAVEVVPGHVVEPKLSIILHMKNGLAVKVRRRDGTYGAAPPSSVTPLLF

SEQ ID NO: 7821 - protein, 321 aa, Zea mays
PGGSSGPDGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPQQLPPPPYAHARAGRPRLSEFHDRSFEGDYGREVDEIGNGISETAMRGKLVKRNKKSSETSFYFADSRSEIRSRGDRDIDNQQALQAEEKDVVSSVATVLSDLCGPGEWMPMAKLHNELLEQFGNVWHPSRVRKYLTQDDWSPTETKGRPWFGLLALLRKYPEHFVINTRSKGRMTSEFVSLVSLLS

SEQ ID NO: 7822 - protein, 254 aa, Zea mays
MPGGSSGPDGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPQQLPPPPYAHARAGRPRLSEFHDRSFEGDYGREVDEIGNGISETAMRGKLLLEQFGNVWHPSRVRKYLTQDDWSPTETKGRPWFGLLALLRKYPEHFVINTRSKGRMTSEFVSLVSLLS

SEQ ID NO: 7823 - protein, 213 aa, Zea mays
  misc_feature (161)..(161): Xaa can be any naturally occurring amino acid
MGKRWIPLEANPDVMNQFIWGLGVSERAVQFCDVYGLDDELIALVPHPVLAVLFLYPFTSLDEENKEESSVSAKSTAGGKDLSKKVYFTKQTIGNACGTIGVIHAIGNATSQIKLVEGSYFGKFYKQTADMDPVQRAAFLEEDDEMEDAHSIAASAGDTNXELYELDGLKSQPTPHGPSSPETLLQDAAEVIKARIAENPNSMNFNVMALSKK

SEQ ID NO: 7824 - protein, 241 aa, Zea mays
PRVRTSNKNNTADRGSKSEIGGLSAILKLLSPNLIRSTLLLWTVFLGHAFLYYGLVLLTSELNHGNRICGSEEGAEVTTTAHIHDENLYRNVFITSFGEVPGLLLSAAIVDMIGRKLSMSSMLYISCLCISPLMFAQTESLTTIFLFCARVCISASFTVLHIYAPEIYPTAVRATGVGFASSIARFGGILCPLVAVGLVHACHQMAAILIFITVMLASGIAVSYFPLETSGRKLSDHVAAA

SEQ ID NO: 7825 - protein, 603 aa, Zea mays
  misc_feature (542)..(542): Xaa can be any naturally occurring amino acid
MVFDASGSRSAAAASGNPLRVILTRGFARQVLAGRWLTVFASLLIMASSGATYIFGSYSGTLKSSLGYDQRTLNTVSFFKDLGANLGVFSGLINEVTPPWVVLAMGAAMNLSGYLMVYLAVSGRTAPPPLWLVCLYFFVGANSQSFANTGALVTCVKNFPDSRGVVLGILKGFVGLSGAVYTQLYLALYGGDDAESLILLVAWLPAAVSVVFVHTIRYMPYPRRRGGGQETSSSDSDPFFCFLYLSIALACFLLVMIVVQKQVPFSRAAYGLAATPLLILLLMPLGVVVKQEYKIYRERQLDAADPPPPTIVSASATDAIKKTEQQPASSSFCGCVRTMFRPPARGEDYTILQALVSVDMLVLFVATICGVGGTLTAIDNMGQIGESLGYPARSVNTFVSLISIWNYAGRVTAGYASEAALARYRVPRPLLLTGVLALACAGHVLIALGAPRSLYAASVVVGFCFGAQWPLVFAIISEVFGLKYYSTLYNLGGMASPVGSYILNVRVAGRLYDAAAARQRGRGRICLGVECYRRSFLIVTAXTVVGALVSLVLVWRTWTFYRGDIYARFRDGDEGPGRDGRLPVDQKREEEQREKAAANGRKA

SEQ ID NO: 7826 - protein, 580 aa, Zea mays
MRRGTFCVKCGGKVRCTCKQRCALLTEFELSRGGEAEPQSRPRPAGDIHTVRAPEAGSTGDEAFRVITHQDLRVLFRFAGVGNPSMARKMLIDGEVAAVADGGHYDYDLFVIGAGSGGVRGSRTAASFGAKVAICELPFHPISSEWLGGHGGTCVIRGCVPKKILVYGASFRGEFEDSKNFGWEINGDINFNWKTLLENKTKEIVRLNGVYQRILTSAGVTMIEGAGSLVDAHTVEVSQPDGSKQRYTAKHILIATGSRAQRVNIPGKDLAITSDEALSLEELPKRAVILGGGYIAVEFASIWRGMGAEVDLFYRRDLPLRGFDDEMRAIVASNLEGRGIKLHPGTNLSELSKTADGIKVVTDKGEELIADVVLFATGRTPNSQRLNLQAAGVEIDRVGAIKVDEYSRTSAPSVWAVGDVTNRINLTPVALMEATCFAKTVFGGQQVKPDHRDVPCAVFSIPPLSVVGLSEEQALEEANGDILVFISSFNPMKNSISKRQEKTIMKLVVDAETDKVLGASMCGPDAPEIIQGIAIAVKCGATKADFDSTVGIHPSAAEEFVTMRTVTRRLSPTSKPKTNL

SEQ ID NO: 7827 - protein, 357 aa, Zea mays
MEGGAGASEKGKVLVTGASGFVGSWLVMKLLQAGYTVRATVRDPANVGKTKPLMDLPGATERLSIWKADLAEEGSFHDAIRGCTGVFHVATPMDFLSKDPENEVIKPTVEGMISIMRACKEAGTVRRIVFTSSAGTVNLEERQRPVYDEESWTDVDFCRRVKMTGWMYFVSKTLAEKAALAYAAEHGLDLVTIIPTLVVGPFISASMPPSLITALALITGNAPHYSILKQVQLIHLDDLCDAEIFLFENPAAAGRYVCSSHDVTIHGLAAMLRDRYPEYDVPQRFPGIQDDLQPVRFSSKKLQDLGFTFRYKTLEDMFDAAIRTCQEKGLIPLATAAGGDGFASVRAPGETEATIGA

SEQ ID NO: 7828 - protein, 356 aa, Zea mays
MEGGAGASEKGTVLVTGASGFVGSWLVMKLLQAGYTVRATVRDPANVGKTKPLMDLPGAKERLSIWKADLAEEGSFHDAIRGCTGVFHVATPMDFLSKDPENEVIKPTVEGMISIMRACKEAGTVRRIVFTSSAGTVNLEERQRPVYDEESWTDVDFCRRVKMTGWMYFVSKTLAEKAALARSREHPENEVIKPTLVVGPFISASMPPSLITALALITGNAPHYSILKQVQLIHLDDLCDAEIFLFENPAAAGRYVCSSHDVTIHGLAAMLRDRYPEYDVPQRFPGIQDDLQPVRFSSKKLQDLGFTFRYKTLEDMFDAAIRTCQEKGLIPLATAAGGDGFASVRAPGETEATIGA

SEQ ID NO: 7829 - protein, 116 aa, Zea mays
LDLTDADGQGVLTMDKCQLQELRVRPVSTSRGSHRTLMPELCMWLWYAPCIELPGGLVLNGATLVAIKPSEEGTGDTVWNETADAAWVLDAFEEPYRTAVKMLLKRRTYSLEMNSF

SEQ ID NO: 7830 - protein, 178 aa, Zea mays
  misc_feature (27)..(27): Xaa can be any naturally occurring amino acid
MAAAAIHQFAECITCHAWSPDQTMIAXLCPNNHEVHIYKFFTDKWEKLHDLSKHGQIASGIDWSNSSNKIGTVSHDRNSWISKGIRKRHESSVTSLAWHPNNIYLATTSTDGKCRELSTFIKGVDTRRSQSSTSTNSKFGEQIAQLDLSSTWVFGVRWSPSVKTLDYAGDNSMAYGID

SEQ ID NO: 7831 - protein, 160 aa, Zea mays
MAAAAIHQFAECITCHAWSPDQSMIAFCPNNHEVHIYKFFTDKWEKLHVLSKHDQIVSGIDWSNSSNKIVTVSHDRNSYVWTQEGSDWIPTLVILKLNRAALCVQWSPKENKFAVGSGAKSVCICYYEQENNWWISKVIRKRHESSVTSLAWHPNNVSLK

SEQ ID NO: 7832 - protein, 469 aa, Zea mays
GTSPATSTTSLQAVDTFSGIRGSMSNYYDDYDDIDEMEDDYDMDDPIDDMVDEQQGIRDSDAEDNDYGQPNDKIPDTSSADARKGRDIQGIPWEQINITRKKYRQSRLEQYKNYENVPNSGEEAMKDCKPTEKGGIYYEFRRNTRSVKSTILHFQLRNLVWATSKHDIYLVSHYSIRHWSALSGVDTELINVQGHVAPREKHAGSLLEGFYQTQVSTLTVKDNLLVAGGFQGELICKHLDQEGISFCCRTTYDDNAITNAVEIFNTSSGAVHFMASNNDSGVRYYDMERFQLFKHFQFEWPVNHASLSPDRKVVVIVGDDPDGLLIDANSGKTVHSIKGHRDYSFASAWSPDGRTFATGNQDKTCRIWDVRNLSKSVHVLRGNLGAIRSIRFTSDGQFMSMAEPADFVHIYDVKSDYNKRQELDFFGEISGTSFSPDTDTLFVGVWDRMYGSLLQFGRLYNYSYLDSLF

SEQ ID NO: 7833 - protein, 403 aa, Zea mays
MAMATAGAVIAACILALLAPPPARAAGGGRCAGESFSANRAYAACNDLPRLGASMHWTYDRASGDLHVAFVAAPAAPGGWVAWALNPSGDGMAGAQALVAGPFPDGGGTWAVRTYNVSGYALGEPGPIAFPASDLAAELGADGRVRVFGTLGLGAAAVGGGGVLLNQVWQVGAAVSSGGVPAPHAMGADNLAAKAKLDLLRATTVAAGADSATRKRNIHGVLNAVSWGLLLPMGAIFARYLKTFRAADPAWFYLHVTCQLIGYGVGVSGWATGMKLGKESRGVTYTDHRNIGIAVFALGTLQVLALFLRPKKEHKFRVYWNTYHHSVGYAVIVLGVVNIFKGMSILGVEQRWRTAYIAAVCVLLVAAAALEAVTWGVVLRRRKADGKTFSSAPNGHLPHSVSV

SEQ ID NO: 7834 - protein, 299 aa, Zea mays
HASDVIPIFNGECGACAYCESDRTNLCGTYRVDASKSTMVSDGGTRFSVADRVSGRTVPVYHFLNTSTFAEYTVLDAACAVKVNPEAPLQKMCLLSCGISTGVGAVWNTANVSAGSTVAIFGLGAVGLAVAEGARLRGAARIIGVDINPEKFTKGREMGVTDFVDSRASDKPVHEVIREMTHGGVDYSFECTGINGVLREAFVSTHDGWGLTVVLGIHATPKMLPLHPMELFDGRRITACVFGDVKGKSQLPAIVDKCVNGDLDINLDGFITHRMPFSDINKAIQLLEEGKSLRCVLNL

SEQ ID NO: 7835 - protein, 149 aa, Zea mays
HIRLRAPHSIDDLSRSSSSSSSAPTRAQPLGSRPENVGGVRAVQKDPIKLWERYVEWLYQHKELGLLVDVSRMGFTEDFMRQMEPRMQRAFAAMRELEKGAIANPDEARMVGHYWLRDPALAPNSFLRSKIETTLDRILAFSQDVVSGK

SEQ ID NO: 7836 - protein, 269 aa, Zea mays
  misc_feature (96)..(96): Xaa can be any naturally occurring amino acid
MLRPPWRISELLPERRRVLHGECCARGGSGGGKKKGMPAKNLMAERRRRKKLNDRLYMLRSVVPKISKASVTRALKKGTTLDSVIEMLKGVTPELXSCPIVLFTYYNPNLKRGVGNFMSTIKQAGIHGLVVPDLPLEETALLRSEAIMHNIELVLLTTPTTPTDRMKGIAQASEGFLYLVSAVGVTGARSNVNLRVEHLLREIKKVTDKPVAVGFGVSTPEHVKQIVGWGADGVIVGSAIVKQLCEAATPEEGLERLEEYARSMKAAMP

SEQ ID NO: 7837 - protein, 513 aa, Zea mays
METASFLSVALALAALVPVSLLLVNRLLYGKLPPGPRRRPVVGNLFDVQPVRCRCYQEWARRYGPIMTVWLGTSPTVVVSTSELAKEVLKTHDQQLADRCRDRSTESFSRGGQDLIWADYGPHYIKVRKLCNLELFTQRRLEALRPIREDEVTAMVESVYKAVTAPGSAGKPLVVKNHLSMVAFNNITRLAFGKRFVDAAGELDEQGREFKGIVHNGIKIGASLSIAQHIPWLRWLAPVDEQAFKAHGERRDRLTVKIMEEHARALKQRGAQQHFVDALFTLRDKYDLSDDTVIGLLWDMITAGTDTTVISVEWAMAELLRNPRVQEKLQEELDRVVGRDRVLSETDFPNLPYLQAVVKESLRLHPPTPLMLPHRASASVKIAGYDIPKGANVVVNVWAVARDPEVWDSPLEFRPERFLRENIDIKGADFRVLPFGAGRRVCPGAQLGINLVASMIGHMLHHFTWTLPSGTCPEDVSMMESPGLVTFMATPLQAVATPRLDKEELYRRVPSDV

SEQ ID NO: 7838 - protein, 197 aa, Zea mays
  misc_feature (94)..(94): Xaa can be any naturally occurring amino acid
  misc_feature (160)..(160): Xaa can be any naturally occurring amino acid
  misc_feature (179)..(179): Xaa can be any naturally occurring amino acid
MDVPLPLLLGSVAVSLVVWCLLLRRGGAGKGKRPLPPGPRGWPVLGNLPQAGAKPHHTMRALAREYGPLFRIQLLSADVVAKTPLRMKDKEFFXSPPPPSDDLIEGIIDEAMKKKKYQKGFILDVFPRTETQAHKLDEMLEKKGANDDKILNFTIDDDAXKERITENKIHSSKGKTYQXKFAPPKAPQNNDETAKTL

SEQ ID NO: 7839 - protein, 692 aa, Zea mays
  misc_feature (579)..(579): Xaa can be any naturally occurring amino acid
MSSSRKPKTPILLFFLFLLASLAFSQEFTYKGFSASGRGGSPNLNLNGTSATEILPSGILRLTNETSRLFGHAFYPTPLRFLDQKNGTAVSFSTQFAFTVVPEFPTLGGHGFAFVVAPDPRMSGALPSQYLGLLSAADVGNATNHLFAIEFDTVQDFEFDDVNGNHVGVDLNSLISNASAKADPLNLKSGDTTAWVDYDGAARLLNVSIANGTLGKPTTPLISFRVDLSGIFREQMYVGFSASTGVLASSHYLRGWSFRLGAGAAPALDLSSLPSLPQLKSSKNRTSLILAVAFSAFVALVVLAGAGAYGAYRYKNRDIIEPWELDYGPHRFKYAELRRATRGFREREVLGSGGFGKVYRGVLRKSGETVAVKRVNHESRQGLREFVAEIASIGRLRHRNLVQLQGWCRRRGDLLLVYDYMPNGSLDRHLFGDHLKASRLTWPVRYRILRDVASALLYLHEGWESVVLHRDVKASNVLLDADMSARLGDFGLAKLHERGTNPSTTRVVGTLGYLAPELTRTGKATTAADVFAFGALVLEVVAGRHPIEPRAPPEELVLAEWAWERYAAGEVEKVVDRGXRLAGAYDFAEAAAAVKVGLWCSHPAPATRPTMREVARYLDGGDASEVPEPPPPPPMPPAYSGEVGFDDFVHSYPSSSFERAAAAGGGWDGGTQMSVATFPFSSLSMRSSHVST

SEQ ID NO: 7840 - protein, 170 aa, Zea mays
  misc_feature (152)..(152): Xaa can be any naturally occurring amino acid
MDGGGGVGGGMGPVGGGVGGMVGPVGVGGGGGGSDVELVSKTLQFEHKLFYFDLKENPRGRYLKISEKTSTTRSTIIVPIAGVAWFLDLFDYYIRTDERDVFSKELRLDTKVFYFDIGENKRGRYLKVSEASVNRNRSTIIVPAGSSGEEGXEAFRNVLLEINDEASRLY

SEQ ID NO: 7841 - protein, 371 aa, Zea mays
MGSGGANTAPLITPYKMGKFDVSHRVVLAPLTRQRSYGNVPQPHAILYYQQRATKGGLLIAEATGVSDTAQGYKDTPGIWTHEQVEAWKPIVDGVHQKGGIFFCQIWHVGRVSNSTFQPNGQAPISSTDKPLKPQVRANGIDVATFAVPRRLETDEIPLVVNDFRVAARNAIEAGFDGVEIHGAHGYLIDQFLKDGVNDRTDKYGGSLENRCRFALEVTQAVVDEIGADKVGIRLSPFASYSEAPDSDPEALGLYMANALNEFGILYCHMVEPRMVKLGEKFETPYSLRPIRDAFRGTFIVAGGYGREDGNRAISTGYADLVAFGRLFLANPDLPRRFEVDAPLNKYNRDTFYIPDPVVGYTDYPFLSSDV

SEQ ID NO: 7842 - protein, 133 aa, Zea mays
  misc_feature (57)..(57): Xaa can be any naturally occurring amino acid
  misc_feature (110)..(110): Xaa can be any naturally occurring amino acid
  misc_feature (115)..(115): Xaa can be any naturally occurring amino acid
MGLHAGVLVFLAAVLTAVLSFIAAAALISNNALVERGNHTTGRRLLQANKDCPVRFXGTNYTAIYDPLVRARCTTPTMRWGALKDFSRPYSTYINYVRTNCTATMFMIHXNLYGXYSPSLFANTCEDVDNGLT

SEQ ID NO: 7843 - protein, 342 aa, Zea mays
MVGLGWRVGSKVQRWVRSCLRGFSSAAVPSQLENVGFIGLGNMGSHMARNLITAGYKVTVHDINENSMKKFSEDGIPTKQSPLEVSESSDVIITMLPSSTHVLEVYNGPNGLLCRGERLGPWLYIDSSTVDPQTSRKISTAISRCLLKEKKGYAESPKILDAPVSGGVPAAEAGKLTFMVGGLEEAYLAAKPLLQAMGEKTIYCGGAGNGSAAKICNNMAMAISMLGVSEAFVLGQNLGIKATTLTDIFNCSSARCWSSDTYNPVPGVMEGVPSSRNYSGGFTSKLMAKDLDLAMASASGVGFKCPMGSNALEIYRKLCEDGCELKDFSCAFRHYYSGKNEE

SEQ ID NO: 7844 - protein, 246 aa, Zea mays
  misc_feature (147)..(147): Xaa can be any naturally occurring amino acid
  misc_feature (223)..(223): Xaa can be any naturally occurring amino acid
  misc_feature (233)..(233): Xaa can be any naturally occurring amino acid
MATKRSVGTLGEADLKGKKVFVRADLNVPLDDAQKITDDTRVRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVXDAFGTAHRAHASTEGVTKYLKPAVAGFLMQKELDYLVGAVANPKKPFAAIVGGSKVSSKIGVIESLLAKVDILILXGGGMIYTFYXAQGYSVGNLSWRG

SEQ ID NO: 7845 - protein, 258 aa, Zea mays
AALEAAVSKKSRHPACSLPISSPAPRRTQQQQRHWGEFVTPGLLFLYIAGWIGWVGRSYLIASSTAAFAAKPRLPRARLTVACSATGGDGNGSSSSVSLASSVKTFSAALALSSVLLSSAATSPPPAAADIAGLTPCKESKAFAKREKNSIKKLTASLKKYAPDSAPALAINATIEKTKRRFENYGKFGLLCGADGLPHLIVSGDQRHWGEFVTAMREIIIDVELATRLLPRGFIWPVASHRELINGDIVVDPPAFGY

SEQ ID NO: 7846 - protein, 225 aa, Zea mays
MAALAAASTAAFAAKPRARLSVACSAATGDSSSVSLASSVKTFSAALALSSVLLSSAATSPPPAAADIAGLTPCKESKAFAKREKNSIKKLTASLKKYAPDSAPALAINATIEKTKRRFENYGKFGLLCGADGLPHLIVSGDQRHWGEFVTPGLLFLYIAGWIGWVGRSYLIAISGEKKPAMREIIIDVELATRLLPRGFIWPVAAYRELINGDLVVDDKDIGYY

SEQ ID NO: 7847 - protein, 233 aa, Zea mays
  misc_feature (204)..(204): Xaa can be any naturally occurring amino acid
MAALAASSTAAFAAKPRLPRARLTVACSATGGDGNGSSSSSVSLASSVKTFSAALALSSVLLSSAATSPPPAAADIAGLTPCKESKAFAKREKNSIKKLTASLKKYAPDSAPALAINATIEKTKRRFENYGKFGLLCGADGLPHLIVSGDQRHWGEFVTPGLLFLYIAGWIGWVGRSYLIAVSGEKKPAMREIIIDVELATRLXPRGFIWPVAAYRELINGDLVVDDKDIGYY

SEQ ID NO: 7848 - protein, 304 aa, Zea mays
MAATSTFLFSSNLHSLNSQPFSSSLSFFRNVHSTLSFPSSKPSRGVVAMAGSGKFFVGGNWKCNGTKDSIRKLVSDLNSATLESDVDVVVAPPFVYIDQVKNSITDRIEISAQNSWVGKGGAFTGEISVEQLKDLGCKWVILGHSERRHVIGENDEFIGKKAVYALSEGLGVIACIGELLQEREAGKTFDVCFQQLKAFADVVPSWDNIVIAYEPVWAIGTGKVATPEQAQEVHAAVRDWLKKNVSAEVSSKTRIIYGGSVNASNSAELAKQEDIDGFLVGGASLKGPEFATIINSVTSKKVVA

SEQ ID NO: 7849 - protein, 133 aa, Zea mays
TYEAMKKQIAEGSKAMPFYCALPTLSEYMNESGWTRSNCKRTKMEFSAYLCYMAMYHILVEMGIDWDARALIDIKPLYKHWHAFDDNSVNQNTSSPQAELDSQRMDGILQAIPHVLALFCFGTRFRTHIALAC

SEQ ID NO: 7850 - protein, 232 aa, Zea mays
  misc_feature (101)..(101): Xaa can be any naturally occurring amino acid
IHRGRTGRPRLPLFLCSPVRPLPPLVGVVAAARIIVRASLPRPPTAPPQERATQRFDSGRREWRRRRPSPPPTSPASPLPHRPRSTTTRTTSSASAAPAAXAQRLVAMAGSGKFFVGGNWKCNGTKESISKLVSDLNAATLESDVDVVVAPPFIYIDQVKSSLTGRIEVSAQNTWIGKGGAFTGEISAEQLVDIGCQWVILGHSERRHVIGEDDEFIGKKAAYALEPNLKVM

SEQ ID NO: 7851 - protein, 310 aa, Zea mays
  misc_feature (223)..(223): Xaa can be any naturally occurring amino acid
  misc_feature (250)..(250): Xaa can be any naturally occurring amino acid
  misc_feature (292)..(292): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFXEWNKGELLSFLVEITADIFSIKDDQGXATLVDKVLDKTGKKGTGKGTVQQAAELSGAAPTLEGSLEFRXFSGLKEETGRGFPKFFQG

SEQ ID NO: 7852 - protein, 387 aa, Zea mays
LGTSRPAGTASGFSSPWLRIRIPPTTSIPFPSLPSCPAGSPARRLCPDPGDMPRYDDRYGGTRLYVGRLAPRTRSRDLEYLFGKYGRIREVELKRDYAFIEFSEHRDADEARYQLDGRDVDGSRIVVEFAKGVPRGPGGSREYMGRGPPPGTGRCFNCGMDGHWARDCKAGDWKNKCYRCGERGHIERNCQNSPRSVRRERSYSRSPSPRRGRGRSPSYSRSRSRSRSRSRSYSRSRSLSGSPRGGRRDRDDRRSRSLSYSRSPMRSPPAKEKERSPTPGGSRSPRSRSPQDQVMSPPPKDNGDRNGSDRGDSPRGRENSRSRSRSRSPSGGNRSPAANGRSPRSPRGDRTPSPMADRSPSPKGNGNNDGGDDDTGRGGSPTGSKSP

SEQ ID NO: 7853 - protein, 188 aa, Zea mays
  misc_feature (66)..(66): Xaa can be any naturally occurring amino acid
  misc_feature (85)..(85): Xaa can be any naturally occurring amino acid
  misc_feature (162)..(162): Xaa can be any naturally occurring amino acid
  misc_feature (182)..(182): Xaa can be any naturally occurring amino acid
PLARRLHADPGDMPRYDDRYGGTRLYVGRLATRTRSRDLEHLFGRYGRFFGFYRRSLVEGCPWWTXDHLWKFQVGDAFEYLTHDXRLTVCGNPLRRIREVELKRDYAFIEFSDHRDADEARYQLDGRDVDGSRIVVEFAKGVPRGSGGSREYMGRGPPPGTXRCFNCGVDGHWARDCKAGDXENKCYR

SEQ ID NO: 7854 - protein, 379 aa, Zea mays
HWDPRGRPGPPPASVPRGLEFGSLPAHPSPSLPSCPAGSPARRLCPDPGDMPRYDDRYGGTRLYVGRLAPRTRSRDLEYLFGKYGRIREVELKRDYAFIEFSEHRDADEARYQLDGRDVDGSRIVVEFAKGVPRGPGGSREYMGRGPPPGTGRCFNCGMDGHWARDCKAGDWKNKCYRCGERGHIERNCQNSPRSVRRERSYSRSPSPRRGRGRSPSYSRSRSRSRSYSRSRSLSGSPRGGRRDRDDRRSRSLSYSRSPVRSPPAKEKERSPTPGGSRSPRSRSPQDQVMSPPPKDNGDRNGSDRGDSPRGREDSRSRSRSPSGGNRSPAANGRSPSPRGDRGPSPMADRSPSPKGNGNNDGGDDDTGRGGSPTGSKSP

SEQ ID NO: 7855 - protein, 236 aa, Zea mays
  misc_feature (230)..(230): Xaa can be any naturally occurring amino acid
MDGGAGEEGKQERHLVLAHKLFLLSHPSVDDLSKVALRAEVLDTVKSDDMATLFESLVAAGVLEGDAALLAEMRGRIDEEIRKLDEKIADAEENLGESEVREAHLAKSLYFIRVGEKEKALEQLKVTEGKTVAVGQKMDLVFHTLQIGFFYMDFDLISKSIDKAKNLFEEGGDWERKNRLKVYEGLYCMATRNFKKAASLFLDSISTFTTYEIFPYDTFIFYTVLTSVIXLDRVSL

SEQ ID NO: 7856 - protein, 241 aa, Zea mays
MGANGHPPASTVAQNGSHSGGGGGGGGGVNPSNGGTGAALRHDPGLAREWSTEEQTILDELLVKYASDLPVVRYAKVAMKLPEKTVRDVALRCRWMNKKESAKRKKEDHNSSKKSKDKKEKVSDSSSKPPVHMVGRPNVPPYPLPVLPMDDDEISSKAIGGPTGEILETNAHVLGQISSNLSNMQIQDNISLLCQTRDNILRVLKEINDAPDIMKQMPPLPVKINEELVNSLLPRPTVPMQ

SEQ ID NO: 7857 - protein, 388 aa, Zea mays
MPQPAPQTAAYGAYPPTYSVQAYTGRKVAIVGSGPSGLAAADQLNKMGHFVTVFERADRIGGLMMYGVPNMKTDKIGVVQRRVNLMAEEGVTFVVNANVGSDPLYSIERLRSENDAVILACGATKPRDLTIPGRELSGVHFAMEFLHANTKSLLDSNLEDGKYISARGKKVVVIGGGDTGTDCIGTSIRHGCTSLVNLELLSKPPSTRAADNPWPQWPRIFRVDYGHQEAATKFGKDPRTYEVLTKRFIGDGNGKVKALEVVRVKWEKVDGRFQLKEMEGSEEIIEADLVLLAMGFLGPEATIAEKLGLEKDNRSNFKAQFGDFATSVDGVFAAGDCRRGQSLVVWAITEGRQAAAAVDKYLSRYDQNAAATGDSTPSGTGLVQPVAA

SEQ ID NO: 7858 - protein, 877 aa, Zea mays
MHLKLWKPLSHCAALLLDKKNRPPRTPPAGAGAGSGGGRRLQESKLREALEEASEDGSLAKSRDVALLDGGDGGAEEGSVGRSRSLARLHAQRDFLRATALAAERAFQSPDALPVLEEALAKFLVMYPNYASASDVDRLRADEYPHLDKVCLDYCGFGLFSYLQSCNPADSSAAFTLSEITANLSNHALYGAAEKGTAEHDIKNRIMDYLNIPESEYCLVFTVSRGSAFRLLAECYPFGTNKRLLTMFDHESQSVNWMTQVARDKGAKAYSAWFKWPTLKICTTELRKLISTKKRRRKDSATGLFVFPVQSRVTGAKYSYQWMALAQQNHWHVLLDAGALGPKDMDSLGLSLFRPDFIITSYYRVFGADPTGFGCLLIKKSVMACLQSPSGGTGAGLVRIVPVFPQYLSDSVDGFDGVLDGLEDDNIIPIEEGSASNSHHASQLPAFSGAYSSAQVREVIESEMDQDSSDRDGASTIYEESESVSVGEVMKSPVFSEDESSENSFWVDLGQSPPGSDHSEQSSKGKLGSPLPASWFSGRKKASPKVPSKLSRSPVHDKHVLSFDAAVRSVSQEPGPVEVVPEEDHSRNGIKNIHISEIEEDNRDGKVNKRFVKFSCANGPAEGSATSVFGTCTARENGSTSEICSETQAETKESAIRRENEGDFRLLGRREAHNGRFNGGGRFFGVEEPERVSSMGRKVSFTMDDSRLCRNSDAGETSGYAMADDNDDDAYSDYDEAQDGRKEPEIVCRHLDHVNMLGLSKTTLRLRYLINWLVTSLLQLRLPDSGDGEGAAAAAAPPLVYIYGPKIKYDRGAAVAFNVKDCGSGTSLINPETVQKLAEKEGLSLGVGFLSHIRLTDSQRHGAADVGLSSSSSPAAA

SEQ ID NO: 7859 - protein, 265 aa, Zea mays
MLVLFETPAGFALFKVLDEGKLDKVEDLWKEFTTSDSARKVVELKAFNKFENTSDALSAATLIIDSKPSKGLRKFLQKHCEGETLAVADSRLGNAIKEKLKIDCLHNSAVMELMRGLRNQLTELITGLGAQDLGPMSLGLSHSLSRYKLKFSPEKVDTMIIQAIGLLDDLDKELNTYAMRVREWYGWHFPELTKIVTDNIQYAKVVKMMGNRTNAVNLDFSEILSDEELETQLKEAAVISMGTEVSDLDLSNIRELCDQVLALSE

SEQ ID NO: 7860 - protein, 238 aa, Zea mays
  misc_feature (225)..(225): Xaa can be any naturally occurring amino acid
MARKKIREYDSKRLLKEHLKRLAGIDLQILSAQVTQSTDFTELSNQEPWLSSMKLVVKPDMLFGKRGKSGLVALNLDRAQVRQFVKERLGVEVEMGGCKAPITTFIVEPFVPHDQEYYLSIMSDRLGCTISFSECGGIEIEENWDKVKTIFLPTEKPMTLDACAPLIATLPLEVRTKIGDFIRGSFSVFQDLDFSFMEMNPFTLVNGEPYPLDMRGELDDTAAFXNYRKWGDIEFPST

SEQ ID NO: 7861 - protein, 274 aa, Zea mays
MELRELGGTGLRVSAVGFGASPLGNVFGDVPRDTARAAVRRALDLGINFFDTSPYYGGTISESVLGDCLRHAAVPRDRVVVATKCGRYKDEGFDFSANRVTRSIDESLARLGLDYVDILHAHDIEFTHLEQIVNETIPALQKIKENGKARFIGITGLPLSIYPYVLDRVAPGSVDVILSYCHYGINDTSLVDLLPYLKSKGVGVISASPLSMGLLTDNGPPEWHPAPEELKVEENVAAALELSTSGIDEELMREVEAILEPVKNLTWPSGIQQA

SEQ ID NO: 7862 - protein, 83 aa, Zea mays
MELRELGGTGLRVSAVGFGASPLGNVFGDVPRDTARAAVRRALDLGINFFDTSPYYGGTISESVLGDCLRHAAVPRDRVVVAT

SEQ ID NO: 7863 - protein, 202 aa, Zea mays
MAETVFAPCLEGMKHVRSDSGVMLAKPFLDVCKQILPVLDKFGAAMAVVKSDIGGNITRLENKYSSDPTKYEHLYTMVQEEVEKKTAKGSSSCTNGLLWLTRAMDFLVELFRNLLDHPDWTMSQACTDSYTKTLKKWHGWLASSSFTVAMKLAPNKDKFMEVISGTGDIKADIEKFCTTFYPFLKENHDFLASVGLDDMKAS

SEQ ID NO: 7864 - protein, 419 aa, Zea mays
MSHYHSADFEEMEDEYDMNEPVDDMEGEDEYQELVIRDSDAEDEDDADQLHKLSDTSAADARSGKDIQGIPWETIEVTRETYRQARLEQYKNYENIPNSGVAAMMLRNLVWATSKHDVYLVLHYSVLHWSALNGVDTEIMDVHGHVAPSEKHPGSLLEGFLHTQISTMAVKDNLLVAGGFQGELICKHLDREGISFCCRTTYDDNAITNALEIFNTSSGALHFIASNNDCGVREYDMERYQLFKHFRFDWPVNHTSLSPDGKLVIIVGDDTDALLIDSNSGKTIHSMKGHLDFSFASAWSPDGLTFATGNQDKTCRIWDARNLTESVHVLRGNVGAIRSIRFTSDGHFLSMAEAADFVHIFDIKSDYNKRQELDFFGEVSGMSFSPDTDTLYVGISDRTYGSLLQFGRLYNYSYLDSLL

SEQ ID NO: 7865 - protein, 546 aa, Zea mays
MARRAASSLVSRCLLARAPAGAPPAAPSAPRRTDGMHRLLPGVLQRFSTAAAVEEPITPSVHVNYTKLLINGNFVDSASGKTFPTLDPRTGEVIAHVAEGDAEDINRAVAAARKAFDEGPWPKMTAYERSRILLRFADLIEKHNDELAALETWDNGKPYEQAAQIEVPMVARLMRYYAGWADKIHGLIVPADGPHHVQILHEPIGVAGQIIPWNFPLLMYAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFKKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGMGREKGVDSLKNYLQVKAVVTPIKNAAWL

SEQ ID NO: 7866 - protein, 299 aa, Zea mays
HWVPRGRPGYIRFATPTPRCHTPARRWYIIIVKKKRSCFWDGCIYAGTLLPAATTGWKEGGVVVKPGRCGWLVQRRQAAVRAMSAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAASIISTEQGEELRKQIGAVAYIECSSKTQRNVKAVLDTAIKVVLQPPRRREVTTKKMKARSNQSLRRYLCGSGCFTS

SEQ ID NO: 7867 - protein, 233 aa, Zea mays
IRHELARAAAAVRARAAADGGESPVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAASIISTEQGEELRKQIGAVAYIECSSKTQRNVKAVFDTAIKVVLQPPRRREVTTKKMKTSSNQSLRRYLCGSGCFTS

SEQ ID NO: 7868 - protein, 549 aa, Zea mays
MYQKKSHFCLCSANMALEPIALLLTVLIAAPLTVLLLFLVAGNKKAARAASPTPPRRRDRLRLPLPPSPRGLPLVGHLHLLGALPHRALMSLARAHGPVLLLRLGRVPTVIVSSAAAAEEVMRARDLTFANRPASAMAERLLYGRDVAFAPYGEYWRQVRRVCVVHLLSARHVGSFRRVREQEAAALAARVARDSAGGAAVGLSDLLTEYANAVVSRAAFGDESARGLLDEFDSGRRQRKVLSDLQKLIGTTPLGELLPWLGWVDAVTGLEGKIRRTFEALDGLLEKVIDDHRRRPRNGEDGSHRDFVDVLLDVHEKDQEHGIQLESNEIKAIILDMFAAGTDTTTTVMEWAMAELVTHPRAMRRAQDEVRAAAAGSTGVNEDHVAQLDYLKAVLKETLRLHAPVPLLVPREPAADTEILGYHVPARTRVLVNAWAIGRDPATWERAEEFVPERFLGGGAAANVGFKGQHFELLPFGAGRRMCPGIAFAEGSAEMALASLLYHFDWEASRGQNREGTPSLDMTEMSGITVHIKSGLPLVSKPWSGSPLN

SEQ ID NO: 7869 - protein, 394 aa, Zea mays
MASAATTLLKSSFLPKKAEWGSKPQLVAAHPRPATVVVSMVARASAYADELVQTAKTIASPGRGILAMDESNATCGKRLDSIGLENTEANRQAYRTLLVSAPGLGQYISGAILFEETLYQSTVDGKKIVDVLSEQGIVPGIKVDKGLVPLAGSNNESWCQGLDGLASREAAYYQAGARFAKWRTVVSIPNGPSQLAVKEAAWGLARYAAISQENGLVPIVEPEILLDGEHGIERTFEVAQKVWAETFFYMAENSVMFEGILLKPSMVTPGAECEEKATPEQVAEYTLRLLRTRIPPAVPGIMFLSGGQSEVEATQNLNAMNQSPNPWHVSFSYARALQNTCLKTWGGRPENVKAAQDALLLRAKANSLAQLGKYTGDGEAAAAKEGMFVKNYSY

SEQ ID NO: 7870 - protein, 263 aa, Zea mays
  misc_feature (240)..(240): Xaa can be any naturally occurring amino acid
MLLLKIFTALFFYITSIVSAADTSAWKSRSIYFVLTDRIARSSSDTGGSACGDLGNYCGGTFKGLESKLDYIKGLGFDAIWITPVVSNKAAGYHGYWAEDLYAVNSNYGTAADLKSLVAAAHAKGIYMMVDVVANHMGPGAITNNRPEPLNQASSYHTACNIDYSNQNSIEICQIAGLPDINTTKSEIRTLLNTWVNWLVKEYSFDGVRIDTVKHVEKDFWPGFSAATGVYSIGEVFDGXPTYLAEYAKLMPGLPHYAVYYPM

SEQ ID NO: 7871 - protein, 204 aa, Zea mays
MLSTASVPSTSFAAAFLSSRARRRRRAPWLRSVAAAATSGVGDGEVERFATSSSITDYLRYRRPELGCAGGAGGGGLPGGELQTAVVRFKKRFPWSLLHPFLHVDLVSTVHIADKEYFDRLQRELEDYDCVLYEMVTTRENLSNPKGPMAAKKMKSSRRGFSIIGFIQKQMARVLSLDYQLDCLDYGNEKWQHADLDYETFKQL

SEQ ID NO: 7872 - protein, 335 aa, Zea mays
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRAKVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 7873 - protein, 335 aa, Zea mays
MAPLGDGGAAAAAASNNLVVSFGEMLIDFVPDVAGLSLAESGGFVKAPGGAPANVACAIAKLGGSSAFVGKFGDDEFGHMLVNILKQNNVNAEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 7874 - protein, 352 aa, Zea mays
  misc_feature (188)..(188): Xaa can be any naturally occurring amino acid
MMASQAMVPLRQLFVDGEWRPPAQGRRLPVVNPTTEAHIGEIPAGTAEDVDAAVAAARAALKRNPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKXAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 7875 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIGDGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFNLMAKGEGIRCIIRMEN

SEQ ID NO: 7876 - protein, 338 aa, Zea mays
MAQAASGSSKIDTKAPTSADEAAQPKSYGDLVSTLPARGGWVSLVQYQNYWLNPGRLQNIIPVKELYKPRADDIVLATYLKCGTTWLKALAFAITTRGRHHQAFAAADHPLLTVHPQEAVPHLEVHTPGQGLADIERLPSPRLLGTHLPLSLLPPAVATSGCRVVYLCRQPKDVFVSLWHFVKGMRGGRSPVELDAALAMFCEGVSPFGPVWEHYLEYWKESLARPERVLFLRYEEMAADPVRAVRTLAGFFAVPFTDEEEGRGVPEEIVRLCSFEMLSGLESNRTGDLDCGDNTVIGKSTFFRKGKVGDWENHLTKEMGKKVDAVFEDKLQGSGLVF

SEQ ID NO: 7877 - protein, 162 aa, Zea mays
MDSEHWISRLAAAKRFYAAQLGHSDRAGMDELEMDEEVRPEFPCPYCYEDHDVGSLCAHLEEEHPFEPQAANRRRLRRFIIPGSQALSLLSRDLREAHLQVLLGGGGQRSSDNSSSSSATNISADPLLSSFGLGFPTSDAEQASKSTVFIPDDATTVKEAPA

SEQ ID NO: 7878 - protein, 228 aa, Zea mays
MDSEHWISRLAAAKRFYAAQLGHSDRAGMDELEMDEEVRPEFPCPYCYEDHDVGSLCAHLEEGHPFEPQAAACPVCSEMVTKDMVNHITTQHGYLFKNRRRLRRFIIPGSQALSLLSRDLREAHLQVLLGGGGQRSSDNSSSSATNISADPLLSSFGLGFPTSDAEQASKSTVSIPDDATTVKEAPAQARKLSIDSSLTSEERELKRKQARVRATFVQDLLLSTLFGD

SEQ ID NO: 7879 - protein, 228 aa, Zea mays
MDSEHWISRLAAAKRFYAAQLGHSDRAGMDELEMDEEVRPEFPCPYCYEDHDVGSLCAHLEEEHPFEPQAAACPVCSEMVTKDMVNHITTQHGYLFKNRRRLRRFIIPGSQALSLLSRDLREAHLQVLLGGGGQRSSDNSSSSATNISADPLLSSFGLGFPTSDAEQASKSTVSIPDDATTVKEAPAQARKLSIDSSLTSEERELKRKQARVRATFVQDLLLSTLFGD

SEQ ID NO: 7880 - protein, 202 aa, Zea mays
  misc_feature (30)..(30): Xaa can be any naturally occurring amino acid
MAQTVFTPSLEAMKHVKAENGVILTKPFLXVCKQILPVLDKFGAAMAIVKSDIGGNITRLENKYTSEPSKYEHLYSMIQEEVQNKTAKGSSSCTNGLLWLTRAMDFLVELFRNLLEHPDWAMSQSCTDSYTKTLKKFHGWLASSSFTVAMKLAPNREKFMEVISGTGDINADIEKFCTTFSPFLKENHNFLASVGLDDLKAS

SEQ ID NO: 7881 - protein, 181 aa, Zea mays
MAQTVFTPSLEAMKHVKAENGVILTKPFLDVCKQILPVLDKFGGAMAIVKSDIGGNITEEVQNKTAKGSSSCTNGLLWLTRATDFLVELFRNLLEHPDWTMGQSCTDSYTKTLKKFHGWLASSSFTVAMKLAPNREKFMEVISGTGDINADIEKFCTTFSPFLKENHNFLASVGLDDLKAS

SEQ ID NO: 7882 - protein, 209 aa, Zea mays
  misc_feature (46)..(46): Xaa can be any naturally occurring amino acid
MAQTVFTPSLEAMKHVKAENGVILTKPFLDVCKQILPVLAPAFMDXDKFGGAMAIVKSDIGGNITRLENKYTSEPSKYEHLYSMVQEEVQNKTAKGSSSCTNGLLWLTRAMDFLVELFRNLLEHPDWAMSQSCTDSYTKTLKKFHGWLASSSFTVAMKLAPNREKFMEVISGTGDINADIEKFCTTFSPFLKENHNFLASVGLDDLKAS

SEQ ID NO: 7883 - protein, 291 aa, Zea mays
  misc_feature (243)..(243): Xaa can be any naturally occurring amino acid
  misc_feature (274)..(274): Xaa can be any naturally occurring amino acid
MATKRSVGTLGEADLKGKKVFVRADLNVPLDDAQKITDDTRIRASIPTIKYLLEKGAKVILASHLGRPKGVTPKFSLKPLVPRLSELLGLEVVMAPDCIGEEVEKLAAALPDGGVLLLENVRFYKEEEKNDPEFAKKLASVADLYVNDAFGTAHRAHASTEGVTKFLMPSVAGFLMQKELDYLVGAVANPKKPFAAIVGGSKVSSKIGVIESLLAKVDILILGGGMIFTFYKAQGLAVGKSLXVEEDKLELATSLIETAKSKGVKLLLPTDVVXVADKFAADAESKIVPAL

SEQ ID NO: 7884 - protein, 252 aa, Zea mays
MAIARTGVYVDDYLEYSSTLAGDLQRILSTMRELDDRAHGIMGQTKEQIKYILGVSSHGYDRSNMDDDESERMKKDIEASQDNALNLCTEKVLLARQAYDLIESHIKRLDEDLGQFAEDLKHEGKIPPDEPTVLPPVPVVSRDEKRRFGFSTPQASKKFREREWDRERGMDFDLMPPPGSSKKAGTSMDVDQTIDPNEPTYCICHQISYGDMIACDNENCGGGEWFHYTCVGLTPETRFKGKWFCPTCRNLQ

SEQ ID NO: 7885 - protein, 374 aa, Zea mays
SATSASAAVAPPPLRLKAGLVGCGLVKQLVLVSADLMHDFKTGHLTLTSPRSMLVGQAVGTLMGCVLAPLTFMLFYRAFDVGEPDGYWKAPYALIYRNMAILGVEGFSALPRHCLQLCAGFFAFAVLANLARDLLPRRLARLVPLPMAMAVPFLVGASFAVDMCVGSLVVFAWHRLDGKKAALLVPAVASGLICGDGIWTFPSSLLALAKILVRSALFRCSGAASLSGTVWKLKEKTEHGISVRAQCMAQSSVRARLTRCMHQKGWPACLVSAVTSVLGDRRPQALPLSLLRWCCGALNKRARTFSGYHQPPVGSEGCCRATLGGRSGIGFTEQSDRSGLYAAVSNPTAPATEEESWLSRTDEFFPRLSTPRPH

SEQ ID NO: 7886 - protein, 360 aa, Zea mays
NILIEKSSRISRSPLYDGHVISFDAAVLSVSQDADCLKEDPEEENFENGRRAHFRQVSEIQEEPEAEEVACQRAMNGGAEHKESAIRRETEGEFRLLGGRDGNNRFTGGRLFGVEEIDGGLSMGRRVSFSTEANIIADRLNRASDAAEASGYTFPGDDGCASDGYDDAQDWGRREPEIICRHIDHVDMMGLNRTTLRLRYLINWLVTSLLQLKLSDSKGGDGVPLVHIYGPKIKYERGAAVAFNVKQNDGTFVNAEVVQKIAEKNGISVGIGFLSHIKVDMKQKQLNGTLDIPEASFYKNGRRDNKKVTIRVEVVTASLGFLTNFEDVYKMWAFVAKFLDPSFLESERLTIAADHSEGQT

SEQ ID NO: 7887 - protein, 221 aa, Zea mays
  misc_feature (212)..(212): Xaa can be any naturally occurring amino acid
MSSTAGKVIKCRAAVAWEPEKPLSIEEIEVAPPQKDEVRLKILYTFFCRTDVYWWDVKGQAPLFPRILGHEGSGIVESVGEGVTNLKPGDHVLPIFTGECGECAHCKSEESNLCELLRINTDRGVMLSDGKTRFSKNGKPIYHFVGTSTFSEYTVCHIGCVAKINPAAPLDKVCVVSCGFCTGFGATVNVAKPKPNSTVAVFGLGAVGLSAXEGARVSGAS

SEQ ID NO: 7888 - protein, 130 aa, Zea mays
FAPDANSQIVPAFAIPDGWMGLDIGPDFVASFNAALDTTKPVFWKGPMGVFEFDKFPVGTEAVAKKLAELSGKGVPTIIGGGDSVPPVEKVGVADVMSPISPGGGASLELLEGKELPGVVALNEPPPGPV

SEQ ID NO: 7889 - protein, 116 aa, Zea mays
  misc_feature (102)..(102): Xaa can be any naturally occurring amino acid
MEANSGGGGGAEGGRAVTGGGGGSDVELVSKTLQVEHKLFYFDLKENPRGRYLKISEKTSATRSTIIVPSSGISWFLDLFNYYVNSEEHELFSKELQLDSKXVFYFDIGENRRGRF

SEQ ID NO: 7890 - protein, 354 aa, Zea mays
MNNCRHERNMVMNKDALVFCYKKKAKTRKSKMNKLKSKQHGKESKEKGTRPLGVPMAAAAPTHAPVSSSACRAGFSSSGVSFPNFRSAAASAPGWRRREPYPAVSVVSSSPQSVAGAITVDTEVDTLLDSVKWDSKGLAVAIAQNVDTGAILMQGFANKEALAKTISTRKATFFSRSRSSLWTKGETSMNFINVHDIFLDCDHDSIIYLGKPDGPTCHTGAETCYYTSVYDALQSSKPNEGRQVMTTLYSLEDTISRRHEEKVTDGGGKPSWTKKLLLDNQLLCSKIREEAGELIQTLLENEDQSRAASEMADLLYHAMVLLRVKDVKMEQVLEVLRKRFSQSGIEEKASRNKS

SEQ ID NO: 7891 - protein, 320 aa, Zea mays
  misc_feature (28)..(28): Xaa can be any naturally occurring amino acid
GDAGGLYQVGQFPHWNVWSEWNGKANTXGYRDTVRQFIKGTDGFAGAFAECLCGSPQLYQAGGRKPWHSINFVCAHDGFTLADLVTYNSKYNLSNGEDNRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTEFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 7892 - protein, 385 aa, Zea mays
MEMKKPCCEESETIVGSWECWFDDACIVDMDYFVKTLSSIKQKGVRADLIGSIITHYASIWLPDLSSSAENGVTTHFQSPESVTNSWMKKRFFVETLVSVLPPEKDSVPCNFLLRLLRTANMVRVDATYRGELENRISWQLDQASLKELMIPSFSHTCGTLLDVELVLRLVKRFMSLDRDGAALVKVAKLVDCYLAEAAVDANLTLSEFIALAGALPSHSRATDDGLYRAIDTYLKAHPDVSKQERKGLCRLLDSRKLTTEASLHAAQNERLPVRAVIQVLFSEQTKLNRHIDWSGSFSSLRSPNGGLDPPGRCLSKRETNAQQMEIRKLKEDVYRLQSQFNAMQGQMERMAAKKKGLFKWRKFGMPTFSRNVGEVEKIEKKKKR

SEQ ID NO: 7893 - protein, 108 aa, Zea mays
  misc_feature (88)..(88): Xaa can be any naturally occurring amino acid
MSEHLFEDTFVVTRLDPDGKKFDRVSRVEARSEQLDMYMQLDVATDVYPMHAGEKFNMVIAPTLNLDGTPDTGYYTQAGRKTSGRQLXYLMQGKLYQISEDTSSRPNA

SEQ ID NO: 7894 - protein, 146 aa, Zea mays
MSEHLFEDTFVVTRLDPDGKKFDRVSRVEARSEQLDMYMRLDVATDVYPMHAGEKFNMVIAPTLNLDGTPDTGYYTQAGRKTLADNYEYVMQGKLYKISEDTSSSQNAKVEMYASFGGLLMLLRGDPSTAASFELDQRLFLLIRKV

SEQ ID NO: 7895 - protein, 163 aa, Zea mays
MALVGQVATVAQLVGVDAFSLITMIAEAAQTARRNRAVCRQLAQRVEMIGGLLRRLRDDDDARLLRHAETRGPVEALEETLRRAYLLVRSCQRRGYAFRCLMGARHADELREMQGEIGFYLGLFPLISYVDWARRRGNGKAACGDTRSLQEGSKDKRVTDLKL

SEQ ID NO: 7896 - protein, 196 aa, Zea mays
MALVEQVAQLVGVDAFSLITMIAEAAQTARRNRVVCQQLARRVEMIGGLLRRLREQDDNDDDVRLLRHAETRGPVEALEETLRRAYLLVRSCQRRGYAYRCLMGAQHADELREVQGEIGFYLQIFPLVSYVDWARRRGNGKAASGDTRSFAEAPMVRPPCLVPFLFLSLLRWMQLFREYVMPLVCMHLLCLSPYVY

SEQ ID NO: 7897 - protein, 253 aa, Zea mays
  misc_feature (225)..(225): Xaa can be any naturally occurring amino acid
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAGKIKDWTNVVVAYEPVWAIGTGKVATPAQAQEVHANLRDWLKTNVSPEVAESTRIIYGGSVTGASCKELAAQXDVDGFLVGGASLKPEFIDIINAATVKSA

SEQ ID NO: 7898 - protein, 277 aa, Zea mays
  misc_feature (194)..(194): Xaa can be any naturally occurring amino acid
  misc_feature (228)..(228): Xaa can be any naturally occurring amino acid
  misc_feature (260)..(260): Xaa can be any naturally occurring amino acid
  misc_feature (267)..(267): Xaa can be any naturally occurring amino acid
GDWDPRGRPGVKRRTDFMADEGIIFKNGVAVGEEGHPSLSDLRASHNVVVIATGATVARDLPIKGRQLEGIHYAMEFLHKNTKSLLDSELGDNAYISAKDKHVVVIGGGDTGNDCIGTSLRHGAKSVTNFELLPQPPPERANDNPWPQWPRIYRVDYGHTEVRQHTGKDPREYCIMSEEFMDDGSGKVKGINTXRVEWTKSPSGGWDMKKVEGSQQFFPADLVLLAMXFLGPEARVLGDEIEKDARKNVKTAPGKYRPNXEGVFRCXGNARRGQSLI

SEQ ID NO: 7899 - protein, 694 aa, Zea mays
MGCVCGRPSSFEDGQCRATPPPAAKLSAAVRREEEARKQQLQLQQHARAGSGREEALERRRAMMAMAAACQVRSPVPRAVEAEQVAVGWPPWLVAVAPEAVRGWVPRRAESFEKLDKIGQGTYSNVYRARDLEKEKIVALKKVRFDNLEPESVKFMAREILILRRLDHPNVIKLEGLVTSRMSCSLYLVFEYMEHDLAGLASFPGVKFTESQVKCYMQQLLRGLEHCHSRHILHRDIKGSNLLIDNRGILKIADFGLASFFDPEQRQPLTSRVVTLWYRPPELLLGATNYGVAVDLWSAGCILAELYAGKPIMPGRTEVEQLHKIFKLCGSPSEDYWRKSKLPHATIFKPQHPYARRVAETFKEFPAPTLALVDVLLSVDPADRGTASYALQSEFFTTKPYACNPSSLPRYPPSKEFDAKRREEEARRQGVTGGKQHKHDPERRTRESRAVPAPDANAELVSSLQKRRAQANTRSRSEMFNPCKEDSASGFRIEPPRPTPGTESSEDPQHAYPTRIFHSGPLVNQSQPSKAGGGKNDELQVPGVANHPVVVSSRTGPRADDSSWTMVAQAGAFSHGRRLSESINEHLSNSGKYDQVFPKKDDRNTIRADGAIGYGSKGNKIHHSGPLTCPSGSVVDEMLKENDRQIQEVFRRTRVEKSRARRDHGHHQGGMRPADFGAIPVFPSSRSSYQAVQQ

SEQ ID NO: 7900 - protein, 443 aa, Zea mays
MAAPSGGGGGGAGEGSSSAAAAATIGVHGVDQVAEAMWQMNLEEAMELGPYPERVGEPDCSYYMRTGMCRFGMTCKFNHPADRKLAVAAARMKGEYPQRIGQPECQYYLKTGTCKFGATCKFHHPREKAAMATRVQLNELGYPLRPNEKECAYYLRTGQCKFGSTCKFHHSQPSTMMVAVRGSVYSPGQSATSPGQHAYQGAVTSWPLSRSASFIASPRWPGHSSYAQVIVPPGLVQVPGWSPYTAQIGSSSSDDQQRTPGAAQYYTGSRQSGTPGIGDRGMFSSYQAGSVPVGLYAVQTENVFPERPDQPECQFYMKTGDCKFGSVCKFHHPRERIIPTPNCALSPLGLPLRPGEPICSFYNRYGMCKFGPNCKFHHPMGNPMYGHASSPTSEAQTSRRMLAHVPSHPEVSPDSGSGRSRRIVHSDSQQIPSVERITEREAS

SEQ ID NO: 7901 - protein, 177 aa, Zea mays
MAGRDREPLVVGRVVGDVLDPFVRTTNLRVSYGARTVSNGCELKPSMVVHQPRVEVGGPDMRTFYTLVMVDPDAPSPSDPNLREYLHWLVTDIPGTTGAAFGQEVICYESPRPTMGIHRFVLVLFQQLGRQTVYAPGWRQNFNTRDFAELYNLGPPVAAVYFNCQREAGSGGRRMYS

SEQ ID NO: 7902 - protein, 101 aa, Zea mays
RPGPEPASHSHRPSAQNYLARPRSAQLLQFRNKLQAITDLAIYPDENIAITSCAMDGYLEEGGDRCKLDIVSGCTDPSSDMFDPLATVDDGSCPLESDSEE

SEQ ID NO: 7903 - protein, 262 aa, Zea mays
RHRRRGHPPAAGPCWSRPRRHLQAELLRDRPRRSRCHGGGAGCRRAAEQGTDLQLQRVSLPTWAEFELGRAPVYWKTSSGLPPSPGEGLTLFYNPAATKMAPNEVFGVAFNGGFNQPIMCGGEPRQMTLQERGKADPPIYTIRIRVPQHAVSLIFSFTNGAEWDGPYTLKFRVPKPWQNKPLSFFNEGLADELNREGACDLAIYPDENIAITSCAMDGYLDEGGDRCKLDIVSGCTDPSSDMFDPLATVDDGSCPLESDSEE

SEQ ID NO: 7904 - protein, 148 aa, Zea mays
MAEHLFEDIFHVTRIDPDGKKFDRVNRIEARSEQLEMYMQLDIATYVYPMHMGDKFTMVLAPTLNLDGTPDTGYYTQAGRKTLADKYDYVMHGKLYKISEDNSSKDKGPTKVEIYASFGGLLMLLKGDPSSAANLELDQRLFLLIRKV

SEQ ID NO: 7905 - protein, 560 aa, Zea mays
  misc_feature (446)..(446): Xaa can be any naturally occurring amino acid
  misc_feature (449)..(449): Xaa can be any naturally occurring amino acid
  misc_feature (467)..(467): Xaa can be any naturally occurring amino acid
  misc_feature (473)..(473): Xaa can be any naturally occurring amino acid
IVGLVEAGRPFTLKYQLPNEDLDSLISVSTDEDLDNLVDEYDRIAATSSGGGSSRTSRIRLFLFPAKPESSSSLGSLLDDSSKSENWFVDALNSAISGSLDGIPRGISTDSASVNCLLGLEDDSSVHSRSGVTNSAPTEDQRASQPKLQAGAAAAAVGTGRHPHDVQSVPDSPMLDKNSSFGSTSSAPSLSNLPPIRVRPEDRPSDARIMQPTAVEDHFAQMGISEQQLPMYIQAQQQVPIPAMTGMSPSEASSRMFSDDDKSDHGGRGSKAQPHKQEVPAIVDPTNRAVYYNDRSPPADLKRDMPVGTEAASYRLPVSAPDAAAAAATQVPAGYVLAQMHAPQQHPPPQQHLPPQQPQQPAPQQQIVSAGNQHFIHNPATGTFIPIQSYYHHHPVPQQAPQTVPRQQQAPAFDPNTGMYYLPMQQNAHQPYSMPPGAQATLPPPXPLXDTTPKPTVPIPQMAVRPXLQQPGXYRTTAAATAVPAPNAAPGYAGMAYHHVIQSHHHHPAPQPVANMAGNYGYEFADPTRPQVYYSQAAAPPTLPQYPPIVSPDAGQAEKH

SEQ ID NO: 7906 - protein, 62 aa, Zea mays
MAGGTVAHATLNGPIVVKEIFNGLTLGLIAGGISKIHHCYQHMKAICFYDMLDKGQIVVGQE

SEQ ID NO: 7907 - protein, 181 aa, Zea mays
MANDSLTRGHIIGDVLDPFTSSVSLSVLYDGRPVFDGMEFRASAVSVKPRVEIEGDDFRVAYTLVMVDPDAPNPSNPSLREYLHWMVTDIPASTDDSFGRELIPYESPSPTMGIHRLVLVLYQQLGRGTVFAPQVRQNFNLRNFARRFNLGKPVAATYFNCQRQTGTGWEKVHLSNGPTYP

SEQ ID NO: 7908 - protein, 438 aa, Zea mays
MDPEPFVRLSVGQLGLKLPGGNASKAAGRLCDCEIRLGGFPVQTAPVPLVHSPAFNLDPFTNAAVFSLEESDLKALAAPGCFRAPRSSCLEVAVYYLARFGASRCGVLACGRKRLVGVFRVELASSEWRDGKPVLLHHGWAGIGKGAARPELHLRVKLEADPRYIFQFDDEIALNPQVVQLHGSIRQPVFSCKFIRDRRPSQSDPLGGGQYWSSSSSEEQDMEMVRRERKAWKVVIHDLSGSAVAAAFMATPFVPAPGGDTVARSNPGAWLIVRADTTGSSDSWQPWGRLEAWREAAAAAASSGKDTVRLRLHLLPDRHDDCVLVSEAPLSSDKGGEFFIDMDRQAPSATAAEHCAASLGAACAGGGFVMSCRVEGEARSSRPFVQLAMRHVTCMEDAAMFVALAAAVDLSVKACRPFRRKPNKKAASPSPDHLELDT

SEQ ID NO: 7909 - protein, 381 aa, Zea mays
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECRDCKMCNSGKTNLCGKVRGATGVGVMMSDRKSRFSVNGKPIYHFMGTSTFSQYTVVHDVSVAKINPQAPLDKVCLLGCGVSTGLGAVWNTAKVEAGSIVAVFGLGTVGLAVAEGAKSAGASRIIGIDIDTKKFDVAKNFGVTEFVDPKEHDNPIQQVLVDLTDGGVDYSFECIGNVSVMRAALECCHKGWGTSVIVGVAASGQEIATRPFQLVTGRVWKGTAFGGFKSRTQVPWLVDKYMKKEIKVDEYITHNMNLADINDAFHLLHEGGCLRCVLAMQI

SEQ ID NO: 7910 - protein, 211 aa, Zea mays
MDQEAKDSRPSRSPSEPNLFLQWGSRKRLRCVKTRDDGSPSPSPSQGLRRAIPRATRPLLGADIATFRSPRRPSTLNRRKSDLLVNEYKHTMALSPEKDKYYTTRGSPFPFEGNGFDFGTITEDKGTTSLPRFFIALSNKEKEEDFMAMKGSKLPQRPKKRPKLMQKCLLMVSPGAWLSDLSHERYEVREKKSSKKRARGLKALSMASDSE

SEQ ID NO: 7911 - protein, 437 aa, Zea mays
HASGGGKGQQTKGGGGGGGGGKGGKDANMVLPQPTPQQMQQQMQMKGMKLPPELLMGMGGSKMPPFPTPAPAPGPPPPAAKDPKPAKFSYPEDDEFGDEGSEFDDEFDDFDDEDDFEDDGFDDDDLYGDPKMMAKPVAMPPAAGKKGGNGGKKGGGGGNEIPVQVKGNAHSGGGKKDSAAKQNQGGGKNGGGGGGSQAPQNGKGGGNGNQQGKKGGGGGGGPPAGSGAPMMGGMAMPAPRPPLPQQQQPGPGMMMRPPNMMGGAGFPGGGMGPGMGQMGGAPMGHPHHPHPHQHMGAGGNGMQMQPGGGGGGAVHGMPAGAMPGHAAGFYQGGGSAAGGGMPSGPEMLQAAGNPMAMAAHQQQQQYMAMMQQQQMMNGHGAGAGGPGGYPAMGYGYGRPAMQYPPPPPPPYYYHPMPQRHPHDNMFSDENPNSCTVM

SEQ ID NO: 7912 - protein, 125 aa, Zea mays
LIESAAEMLYGLIHVRYILTSKGLAAMLDKYKNYDFGRCPRVHCSGQPCLPVGQSDIPRSSNVKIYCPKCEDLYYPRSKYQSNIDGAYFGTTFPHLFLMTYPHLKPQKPSQQYVPKVFGFKLHKP

SEQ ID NO: 7913 - protein, 328 aa, Zea mays
MASGEEGKGETVLVTGASGFIGSTLVRGLLGRGYNVRAGVLDPDDRAETDHLLALAAGAGRLSFFRCDLLDGAALLDAARGCSGVFHLASPCTVDPVKDPQNQLMVPAVEGTLNVVRAAKDAGGVRRVVVTSSISAVVPNPGWPAGEVVDERCWTDIDYCEKNGVWYPASKTLAEKAAWKFAEENGLDVVVVNPGTVLGPMIPPAINASMAMFCRLLQGCTEEYADFFLGPVHVEDVAMAHILVFESASASGRHLCVHSICHWSDFAAKVAELYPDYKVPKFPMDTQPGLVRQEVGSKKLTALGLQITPMEKIIRDAVESLKSRGHIS

SEQ ID NO: 7914 - protein, 142 aa, Zea mays
  misc_feature (61)..(61): Xaa can be any naturally occurring amino acid
  misc_feature (105)..(105): Xaa can be any naturally occurring amino acid
FPGFITSDRESLSFRGPTERVRDWKEVAIECTPAPLLNTQSARCMDCGTPLCHYESSSAAXPIGNKIPEFNGLVHHNRWPTASTSTTVSSKQASPEFTGRVCPAXPCEGLCDLGIIENAVCLKRLDCALIHEGYQEVWMIPQ

SEQ ID NO: 7915 - protein, 557 aa, Zea mays
  misc_feature (533)..(533): Xaa can be any naturally occurring amino acid
  misc_feature (549)..(549): Xaa can be any naturally occurring amino acid
LRSVDRSIDRSAIMAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPADELKVSKAEFIDLARKSGKFDEDSLAFQSRLLAKSGIGDESYMPRCVFEPNASCATMKEGRAEASTAMFAALDELFDKCRVRPKDVGVLVVNCSLFNPTPSLSAMIVNHYKMRGNILSYNLGGMGCSAGVIAIDLARDMLQASGAGLAVVVSTEAVSFTWYPGKRRSMLIPNAFFRAGCAAVLLSNRRRDFHRAKYQLEHVVRTHKGADDRAFRSVYQEEDEQRIKGLSISRDLLEVGGHALKTNITTLGPLVLPFSEQLLFFAGVLFRHLFPSKASTPAPPTTPGDASAAAPYIPDFKRAFEHFCMHAASRDVLEHLQSNLGLRNADLEASRAALHRFGNTSSSSIWYELAYLEAKGRVRRGDRVWQLAFGSGFKCNSAVWARRXARVRRPARSPWLDCIXQYPARMDA

SEQ ID NO: 7916 - protein, 253 aa, Zea mays
MEREPKSPDDRPEPAAAAAQPQPLEWRFAQVFGERAAGEDVQDVDIISAIEFDKSGNHLATGDRGGRVVLFERTDIADNACRRELERQEYLVSRHPEFRYKTEFQSHEPEFDYLKSLEIEEKINKIKWCQTTNNALFLLSTNDKTIKYWKVQEKKVKRVSVMNLDTSQSSDNGSTSSPGTSSCRALLPNGGCTGKMYSPNNNMPFPPGGCTSLRLPVVVTGQEFTHVARSRRVYAHAHDYHINSISNNSVHGF

SEQ ID NO: 7917 - protein, 159 aa, Zea mays
  misc_feature (94)..(94): Xaa can be any naturally occurring amino acid
MAENLAPEKRHSFVHNGQKVFEWDQTLEEVNMYIELPKGVPTKLFHCSIQASHVEVGIRGNPPYLNHDLTHPVKTDSSFWTIEDGEMHITLQKXREKGKTWSSPIQGQGILDPYAADQEQKRLMLQRFQEENPGFDFSQAQFSGTCPDPRTFMGGIRSE

SEQ ID NO: 7918 - protein, 370 aa, Zea mays
  misc_feature (292)..(292): Xaa can be any naturally occurring amino acid
MSNAASTTPLLAHYKMGKFDLSHRVVLAPLTRERSFGNVPQPHAILYYQQRATKGGLLIAEATGVSDTAQGYKDTPGIWTKKQVEAWKPIVDGVHAKGGIFFCQVWHVGRVSNHTFQPNGQAPISSTDKPIKPATRADGIGLAKVSTPRRLTTDEIPLVIDDFRVAARNAIEAGFDGVEIHGAHGYLIDQFLKDQVNDRTDKYGGSLENRCRFALEVVQAVADEVGADKIGIRLSPFASYSDASDSNPEALGLYMAQALNKLGILYCHMVEPRMVNIGEKLETPHSLRPMRXAFRGTFIVAGGYGREDGNRAISTGYADLVAFGRLFLANPDLPRRFEVDAPLNKYNRDTFYIPDPVVGYTDYPFLSSDV

SEQ ID NO: 7919 - protein, 67 aa, Zea mays
MAMGSLAFATALVFVFVFAIAVPAPAPAPTSDGTSIDQGIAYLLMIMALVLTYLIHPLDASAPYKLF

SEQ ID NO: 7920 - protein, 312 aa, Zea mays
MSPYANVHDWFTPLRLAPVLFFSCSPLPACAPFRGTTGRPPLYASCSDLVGPLRRRPSPVRAMMGGWGVSDGYEGSKRTRMMMESNPYFAVNAGTGAGASTGIQNFPGVRLRGLPFDCNDIDICKFFVGLDIVDCLLVNKNGRFTGEAFVVFPTAMQTEFALHRNRQNMGRRYVEVFRCKKQEYYSAIANEGGYFESEYRRSSPPPRPPKKPAEDKGSMEYTEVLKLRGLPYSATTEDIIKFFLEYELTEENVHIAIRSDGKATGEAFVEFPTAEVAKTAMCKDKMTIGTRYVELFPSTPEEASRARTRGRH

SEQ ID NO: 7921 - protein, 241 aa, Zea mays
MGSNTGGASGGFYQPFNSNLAGAGASTGIQNFPGVRLRGLPFDCNDIDICKFFVGLDIVDCLLVNKNGRFTGEAFVVFPTAMQTEFALHRNRQNMGRRYVEVFRCKKQEYYSAIANEVSQGGYFESEYRRSSPPPRPPKKPAEDKGSMEYTEVLKLRGLPYSATTEDIIKFFLEYELTEENVHIAIRSDGKATGEAFVEFPTAEVAKTAMCKDKMTIGTRYVELFPSTPEEASRARTRGRH

SEQ ID NO: 7922 - protein, 672 aa, Zea mays
MDQLRPEPAAGAHEIEKTAAPDVESEPAAAVPEPERVPPWREQVTARGMVAALLIGFVYTVIVMKLSLTTGLTPTMNVSAALLAFLALRGWTRALGRLGIACRPFTRQENTVVQTCVVACYTIGFGGGFGSFLLGLDKKTYELSGVSTPGNVPGSYREPAIGWMTGFLLAVSFVGLLTLLPLRKVLVIDYKLTYPSGTATAVLINGFHTPQGDKNAKIQVRGFLKYFGISFLWSFFQWFYTAGDHCGFAQFPTFGLQAFNQTFSFDFSLTYVGAGMICSHLVNLSLLFGAVVSWGVMWPLIGKQKGNWYPADASQNSMTGIYGYKAFLCIALLVGDGLYNFVKVIAITVKNIRERSRRKNLNRVADADTMALDDMQRDEVFNRDNIPTWLSYAGYAALSLIAVIAIPIMFREVRWYYVVVAYALAPALGFCNAYGTGLTDMNMGYNYGKIALFVLAAWAGKDSGVVAGLVGCGLVKQLVLVSADLMHDFKTGHLTLTSPRSMLVGQAVGTLMGCVLAPLTFMLFYRAFDVGEPDGYWKAPYALIYRNMAILGVEGFSALPRHCLQLCAGFFAFAVLANLARDLLPRRLARLVPLPMAMAVPFLVGASFAVDMCVGSLVVFAWHRLDGKKAALLVPAVASGLICGDGIWTFPSSLLALAKVKPPICMKFTPGS

SEQ ID NO: 7923 - protein, 962 aa, Zea mays
MLLHAGPSFLLAPPPRFAAAPSSASPRRSRTPQSSPPTSHFARPADPVAQRVRPVAPRPPMATAEEGASSDVGVAVAESAQGFLLDARAYWVTKSLIAWNISDQKTSLFLYASRNATMCMSSQDMKGYDSKVELQPENDGLPSSVTQKFPFISSYRAFRIPSSVDVATLVKCQLAVASFDAHGNRQDVTGLQLPGVLDDMFAYTGPLGTIFSEEAVSMYLWAPTAQDVSVSFYDGPAGPLLETVQLNELNGVWSVTGPRNWENRYYLYEVTVYHQTTGNIEKCLAADPYARGLSANSTRTWLVDINNETLKPLAWDGLAAEKPRLDSFSDISIYELHIRDFSAHDSTVDCPFRGGFCAFTFQDSVGIEHLKKLSDAGLTHVHLLPSFQFGGVDDIKSNWKCVDEIELSKLPPGSDLQQAAIVAIQEEDPYNWGYNPVVWGVPKGSYASNPDGPSRIIEYRLMVQALNRLGLRVVMDVVYNHLYSSGPFAITSVLDKIVPGYYLRRDSNGQTENSAAVNNTASEHFMVDRLIVDDLLNWAVNYKVDGFRFDLMGHIMKKTMIRAKSALQSLTIDEHGVDGSKIYLYGEGWNFGEVAENQRGINGSQLNMSGTGIGSFNDRIRDAINGGSPFGNPLQQGFSTGLFLEPNGFYQGNETETRLTLATYADHIQIGLAGNLKDYVVISHTGEARKGSEIRTFDGSPVGYASSPIETINYASAHDNETLFDIISLKTPMDLSIDERCRINHLSTSMIALSQGIPFFHAGDEILRSKSLDRDSYDSGDWFNKIDFTYETNNWGVGLPPREKNEGSWPLMKPRLENPSFKPAKHDIIAALDKFIDILKIRYSSPLFRLTTASDIVQRVHFHNTGPSLVPGVIVMSIEDARNDRHDMAQIDETFSCVVTVFNVCPYEVSIEIPDLASLRLQLHPVQVNSSDALARQSAYDTATGRFTVPKRTAAVFVEPRC

SEQ ID NO: 7924 - protein, 894 aa, Zea mays
  misc_feature (70)..(83): Xaa can be any naturally occurring amino acid
  misc_feature (142)..(143): Xaa can be any naturally occurring amino acid
SSDVGVAVAESAQGFLLDARAYWVTKSLIAWNISDQKTSLFLYASRNATMCMSSQDMKGYDSKVELQPEXXXXXXXXXXXXXXISSYRAFRIPSSVDVATLVKCQLAVASFDAHGNRQDVTGLQLPGVLDDMFAYTGPLGTXXSEEAVSMYLWAPTAQDVSVSFYDGPAGPLLETVQLNELNGVWSVTGPRNWENRYYLYEVTVYHQTTGNIEKCLAADPYARGLSANSTRTWLVDINNETLKPLAWDGLAAEKPRLDSFSDISIYELHIRDFSAHDSTVDCPFRGGFCAFTFQDSVGIEHLKKLSDAGLTHVHLLPSFQFGGVDDIKSNWKCVDEIELSKLPPGSDLQQAAIVAIQEEDPYNWGYNPVVWGVPKGSYASNPDGPSRIIEYRLMVQALNRLGLRVVMDVVYNHLYSSGPFAITSVLDKIVPGYYLRRDSNGQTENSAAVNNTASEHFMVDRLIVDDLLNWAVNYKVDGFRFDLMGHIMKKTMIRAKSALQSLTIDEHGVDGSKIYLYGEGWNFGEVAENQRGINGSQLNMSGTGIGSFNDRIRDAINGGSPFGNPLQQGFSTGLFLEPNGFYQGNETETRLTLATYADHIQIGLAGNLKDYVVISHTGEARKGSEIRTFDGSPVGYASSPIETINYASAHDNETLFDIISLKTPMDLSIDERCRINHLSTSMIALSQGIPFFHAGDEILRSKSLDRDSYDSGDWFNKIDFTYETNNWGVGLPPREKNEGSWPLMKPRLENPSFKPAKHDIIAALDKFIDILKIRYSSPLFRLTTASDIVQRVHFHNTGPSLVPGVIVMSIEDARNDRHDMAQIDETFSCVVTVFNVCPYEVSIEIPDLASLRLQLHPVQVNSSDALARQSAYDTATGRFTVPKRTAAVFVEPRC

SEQ ID NO: 7925 - protein, 369 aa, Zea mays
MDMGSGSSPVITDPISISPPLLGGLTSNLMPFSVMSGGCSSSPSMSASSRRKIEEVLVNGLLDAMKSSSPRKKHNLAFGQDNSPDEDPAYTAWLSKCPSALASFKQIVANAQGRRIAVFLDYDGTLSPIVDDPDKAFMSPVMRAAVRNVAKYFPTAIVSGRSRKKVFEFVKLTELYYAGSHGMDIVTSAAAHATEKCKEANLFQPACEFLPMIDEVSKCLVEVASSIEGARVENNKFCVSVHYRNVAEKDWKVVAGLVKQVLEAFPRLKVTNGRMVLEVRPVIDWDKGKAVEFLLRSLGLSDSEDVVPIYIGDDRTDEDAFKVLRERSCGYGILVSQVPKDTEAFYSLRDPSEVMGFLNSLVRWKKHPL

SEQ ID NO: 7926 - protein, 208 aa, Zea mays
  misc_feature (174)..(174): Xaa can be any naturally occurring amino acid
MLLRPALPVAVSSTLPLISHLAAVRRRCSIAATGMAGVSAASPAAAQIGSFLSKKPYAPPSWASHLALAPSHTFSLGHFPTPIHKWNLPNLPEGTEVWIKRDDLSGMQLSGDKVRKLEFLLSDAVAQGADCVITVGGIQSNHCRATAVAAKYLNLDCYLILRTSKLLVDQDPGXLVGNLLVERLLGAHIDLVSKEEYGKIGSVALADL

SEQ ID NO: 7927 - protein, 475 aa, Zea mays
MSATQPWRSLLCCAAAGYDDADEPPPSSRGQRKGRSRRDRDRERLQLLLLPSSSSAASRVSLSSLGGSSGTLTPEDLSLTLSGSSLHAFTCAELRAATAGFSRANYLGCGGFGPVYRGRVAAGLRPGLDAQPVAVKYLDLDCGTQGHREWLAEVFFLAQLRHDNLVTLIGYCYEDDHRMLVYEYMSNQSLEKHLFRSLDGPMPWMTRMKIAVGAAKGLAFLHGADTPVIYRDFKASNILLDQDYSTKLSDFGLAKDGPQGDATHVTTRVMGTNGYAAPEYIMTGHLTAKSDVYSFGVVLLELLTGRRSVDRSRRPREQSLVDWARPYLKKPDKLYRVMDPAMECQYSCQGAGRAAMVAYKCLSQNPKSRPTMREVVQALEPVLDMNDYLQIGSFVFTVVVEDSNDDDSQGKMVDVTIETTVEEKRQSHQDRHRQKFPNSLVNADVVLHRDGDLGKHIAALRRHRRTSSYVKERGA

SEQ ID NO: 7928 - protein, 73 aa, Zea mays
  misc_feature (42)..(42): Xaa can be any naturally occurring amino acid
MTEVLLNDRLGKKERAKCHEDVTIGDLKKLVAGQTATRPYKXRILKWYGIYKDHITLKEYDMHDGMGLELYYN

SEQ ID NO: 7929 - protein, 165 aa, Zea mays
  misc_feature (82)..(82): Xaa can be any naturally occurring amino acid
  misc_feature (154)..(154): Xaa can be any naturally occurring amino acid
KIYRPHQQRVKEEPARACAWLSLLAAAAYGRLISDGGPPAPLLPVIRLAAPPAEAECEQTYGFLPCTTTVLGNLFLVLAYGXFLMFKAATFLSAGSELLLEIMGPGLVGGLLLPILGALPDALLVLVSGLSGSKEEAQSQVLIGMGLLAGSTVXLLTLLWGTCVV

SEQ ID NO: 7930 - protein, 172 aa, Zea mays
  misc_feature (26)..(26): Xaa can be any naturally occurring amino acid
  misc_feature (55)..(55): Xaa can be any naturally occurring amino acid
  misc_feature (81)..(81): Xaa can be any naturally occurring amino acid
  misc_feature (103)..(103): Xaa can be any naturally occurring amino acid
MLPYQDLLSGNELLSDSFSYKELENXASCWEVEVNCVTLGPVDVDIEANPSAIGXDDDSADDTAVKVIDIVDTFRVQEQPXLLDNKSFVSYIKQYIRELSTAXLLGTMTTLDEIKKAVEGATKFLLTKLNDLQFFVDESTKDKASVVFTYYKDGATNPTFLYFSHGLKEIKC

SEQ ID NO: 7931 - protein, 253 aa, Zea mays
SARGFLFEPIQGEAGVVIPPDGYLKGVRDLCSKHNVLMIADEIQTGIARTGKMLACDWENIRPDMVILGKALGAGVVPVSAVLADRDVMLCIRPGEHGSTFGGNPLASAVAVASLKVVRDEGLVERAAKLGQEFRDQLQKVQQKFPQILREVRGRGLLNAVDLNNDALSPASAYDICIKLKERGILAKPTHDTIIRLAPPLTISPEELAEASKALSDVLEHDLPQLQLQKQIKKPESEAEKPVCDRCGRDLYG

SEQ ID NO: 7932 - protein, 422 aa, Zea mays
MSCLGWFKRRSRSGGSAAKRGASAPVSASGPATTTTTTTTATTASAVSTSRSDDSGAARPASKSAGSAGSSSQSHRSISSLYEERGHGQLRVFGYEELQGATADFSRAQKLGEGGFGSVYKGFIRGADGKGDRVPVAVKKLNQRGMQGHKQRLAEVQFLGVLEHPNLVKLLGYCAVDSERGAQRLLVYEFMPNKSLEDHLFRRANPPLPWNRRLQVILGAAEGLAYLHEGEVQVIYRDFKTSNVLLDKDFRAKLSDFGLAREGPTGANTHVSTAVVGTQGYAAPEYMDTGHLTTKSDVWSFGVVLYEILTGRRSLDRNRPAAEQKLLEWVAQFPPDSRNFRMIMDPRLRGEYSVKAAREIAKLADSCLLKNAKERPTMSEVVEVLGRAVQAHAEPDSGAPGPGPGAKGKKTDAATPSRRRRD

SEQ ID NO: 7933 - protein, 418 aa, Zea mays
MSCLCWFKRRSRKGRSSSSGKRGASSTATVSVSGPATATATTTTTASAESTSRSDDSGAVRPVSKSAGSSQSQRSISSLYEERGHGQLRVFDYDELQGATAEFGRAQKLGEGGFGSVYKGFIRAADGKGDRVPVAVKKLNQRGMQGHKQWLAEVQFLGVLEHPNLVKLLGYCAVDSERGAQRLLVYEFMPNKSLEDHLFRRANPPLPWNRRLQVILGAAEGLAYLHEGEVQVIYRDFKTSNILLDKDFRAKLSDFGLAREGPTGANTHVSTAVVGTQGYAAPEYMDTGHLTTKSDVWSFGVVLYEILTGRRSLDRNRPAAEQKLLEWVAQFPPDSRNFRMIMDPRLRGEYSVKAAREIAKLADSCLLKNAKERPTMSEVVEVLGRAVQAHAEPDSGAPGPGAKGKKTDAATPSRRRRD

SEQ ID NO: 7934 - protein, 92 aa, Zea mays
LQELRVRPVFPSGSSHRTLMPALSMRLHYAPLIELPGGTLLKGATLVAIKPSEDALSPVGTCWISEAFEEPYRTAAKVLLKRRAYCLEMNSF

SEQ ID NO: 7935 - protein, 96 aa, Zea mays
LQELRVRPVFPSGSSHRTLMPALSMRLHYAPLIELPGGTLLKGATLVAIKPSEDALREGQGAGAAGPVGTCWISEAFEEPYRTAAKVLLKRRAYCL

SEQ ID NO: 7936 - protein, 148 aa, Zea mays
  misc_feature (118)..(118): Xaa can be any naturally occurring amino acid
MASGDATLFEESFTVMEYDQSKYDRVARIHCTSADSQTIMSLDINIELFPCVRGDSLHVVLTTTLALDGSKEEEKGWRDVGKGGDAPATIADLYDYVCHGKIYKFEETFDGNTINAYXSFGGLLMSLQGPVKKLTPLRVDNVYLLVKK

SEQ ID NO: 7937 - protein, 175 aa, Zea mays
MDGTSFDLTEHEGSNLSPFLLKHFNEWDDRKTRGLFHHDISSCETKVLPGVHNFVATLIEGRDQKKRPTEFTMNQVLQPFVSEKFNFTKVSPLEVIFRFNDTEKDPAQYFDGVPDTVSASSSAILINVSPIGYWHVLLTPRIQDCLPQRIDHESFLIAMYVAREAKAPFFRGGYN

SEQ ID NO: 7938 - protein, 264 aa, Zea mays
  misc_feature (44)..(44): Xaa can be any naturally occurring amino acid
EWPRRRRPSCPPISPASPTSAARRRRPLPPSHSSFASAARAAAXQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVQG

SEQ ID NO: 7939 - protein, 326 aa, Zea mays
  misc_feature (264)..(264): Xaa can be any naturally occurring amino acid
VALAAAAAAGDQTPAPPKRPSIVLHAFLFLLAYLALGVTFYAAAPANFTSSAGPTHPVADALYFCIVTLCTIGYGDITPATPAAKLFSISFVLVGFGFVDILLSGMVSYVLDLQEHLLITALNNPTSARKHLHNYIFDIKKGRMRIRMKVALALGVVAVCVCFGAAVLRKVESLGWLDAVYLAVMSVTTVGYGDQAFQTLAGRLFASAWLLVSTLAVARAFLYLAEMRIDKRHRIEPGGNIIHPLICYANGWLQADYPPESLFXKSEFVVYKLKEMGKITEKDIMMICDQFQRLDTGSCGKITLSDLLESHHLVSEPRDKKKGKKS

SEQ ID NO: 7940 - protein, 172 aa, Zea mays
MMAAMNIDLGGLAGRPTTSQADPFQSALYGAGPGLIRSGLGVYSEKFLGSSSDFMQSNITQYLSNPQYYFQVNNQYVRNKLKVVLFPFLHRGHWTRITEPVGGRLSYKPPVQDINAPDLYIPLMAFATYIVVAGYALGVLGRFTPEALTIQFTKGLLGWFMQAILIKALLYS

SEQ ID NO: 7941 - protein, 168 aa, Zea mays
  misc_feature (25)..(25): Xaa can be any naturally occurring amino acid
  misc_feature (39)..(39): Xaa can be any naturally occurring amino acid
  misc_feature (111)..(111): Xaa can be any naturally occurring amino acid
  misc_feature (134)..(134): Xaa can be any naturally occurring amino acid
  misc_feature (141)..(141): Xaa can be any naturally occurring amino acid
MLAYQDLLSWRRSSSSDSFTYNELXNAILREVEGKRVTXGPVNVDIAANPSAEGGEDERADDTAVNVADIVDTFRLQEQPPFDEKSFVSYILKYIKNLTAVLEPKKANEIXKGVEGATKYLLNKLNDLQFCAGXSMKDDAXVLFAYYNDAATNPTFLYVSHGLNEIKC

SEQ ID NO: 7942 - protein, 208 aa, Zea mays
IRLEAGLCSVCGEESFGTGSDHIREKDGIWAVLAWLSILAYKNKDKLEDKLVTVEDIVRQHWATYGRHYYTRYDYENVDAGAAKELMAYLVKLQSSLSEVNQIVKGIRSDVSNVVHGDEFEYNDPVDGSISSHQGIRYLFEDGSRLIFRLSGTGSEGATIRLYIEQYEKDPSKIGRLSNEALAPLVEVALKLSKMEEFTGRSAPTVIT

SEQ ID NO: 7943 - protein, 159 aa, Zea mays
MDSTGTGAGGKGKKGAAGRKVGGPRKKSVSRSVKAGLQFPVGRIGRYLKKGRYAQRVGTGAPVYLAVVLEYLAVEVLELAGNAARDNKKTRIIPRHVLLGIRNDKELGKLLGGVTIAQGGVLPNINPVLLPKKTAEKASSVGSKEAKSPKKAAKSPKKA

SEQ ID NO: 7944 - protein, 159 aa, Zea mays
MDSTGTGAAGKGKKGAAGRKVGGPRKKSVSRSVKAGLQFPVGRIGRYLKKGRYAQRVGTGAPVYLAAVLEYLAAEVLELAGNAARDNKKTRIIPRHVLLAIRNDEELGKLLGGVTIAHGGVLPNINPVLLPKKTAEKASSGGSKEAKSPKKAAKSPKKA

SEQ ID NO: 7945 - protein, 159 aa, Zea mays
MDSTGTGAGGKGKKGAAGRKVGGPRKKSVSRSVKAGLQFPVGRIGRYLKKGRYAQRVGTGAPVYLAAVLEYLAAEVLELAGNAARDNKKTRIIPRHVLLAIRNDEELGKLLGGVTIAHGGVLPNINPVLLPKKTAEKASSGGSKEAKSPKKAAKSPKKA

SEQ ID NO: 7946 - protein, 355 aa, Zea mays
  misc_feature (270)..(270): Xaa can be any naturally occurring amino acid
MEQAAMPQVPRVKLGTQGLEVSKLGFGCMGLTGTYNAPLGDEAVAAVVAHAFRRGITFFDTSDAYGPRTNETLLGKALKQLPREQVQVATKFGIGQGAAGMTVCGTPEYVRACCEASLRRLDAGYIDLYYQHRVDTTVPIEDTIGELKKLVEEGKVKYIGLSEASPDTIRRAHAVHPITAVQMEWSLWSRDIEHEIVPLCRELGIGIVAYSPIGRGFFGGRGVTQQVSSESSLQRHPRFTTESLEKNKQIYLKIEDLAKKYQCSPAQLAXGCTPSQLALAWVHHQGNDVCPIPGTTKIDNFNQNVGALSVKLTPDEMAELESYAAAGEVLGDRYGDQLANTWKDSETPPLSSWKF

SEQ ID NO: 7947 - protein, 406 aa, Zea mays
MDLGASDPAALGTAYLSPIPPATVPSSTTSRGTPAEPPLELAPEPPKLCQISPNPAGRTPQHIAKTNRAGRHKPQPVAMDLASSDLAALGAAELVRVSASIPRAAPRTFALLTACLVFPLSFAVLAHSLFTHPILLRIQGATHSELAQWLRLFAYQFLYLIVLFTFSLLSTAAAVFTVASLYANKPASISSSLTALPPILPRLLRTFLWVSLLMLAYHLVFALTVLLLIVVFIPNASESESAPPSLAFVLFLVVVVFVFLGIHVYISALWHLASVISVLEPLCGLAAMAKSKDLLQGRTGTAATLVVSYFAVCGVTSVLFRAAVVKGRAEEGSFGLALPGRLLVGAVLLCVLVCVNLLGLLVQSVFYYACKAFHNQQIDRTALYEHLGGYLGEYVPLKSNIQMENL

SEQ ID NO: 7948 - protein, 112 aa, Zea mays
LMSNFFAQPEAVAYGKTAEQLHSEKVPENLIPHKTFKGNRPSLDWVVRTICLYAGSPLSFTFEHRIGMQDLLWGTHAFDPWGGELGKALACQVGKQLHGNLLEGKAVEAPNH

SEQ ID NO: 7949 - protein, 271 aa, Zea mays
  misc_feature (265)..(265): Xaa can be any naturally occurring amino acid
PVESPQSEEKDVDSGAAALPKLKPLHWDKFRASSGRPTVWDQLKASSFRVNEEMIETLFVSNSTRRMPKNGFKEANGAPCNQENKVLDAKKSQNIAIMLRALDTTKEEVCKALLDGQADSLGTELLEMLLKMAPTREEELKLREYREDAQSKLGSAESFLKAVLGIPFAFKRAEAMLYIANFDSEVDYLKTAFKTLEAACEELRGSRLFHKILDAVLKTGNRMNTGTNRGNAHAFKLDSLPQLVDIKGTDGKTTLLHFVIEEIPXSEGATL

SEQ ID NO: 7950 - protein, 149 aa, Zea mays
  misc_feature (35)..(35): Xaa can be any naturally occurring amino acid
  misc_feature (50)..(50): Xaa can be any naturally occurring amino acid
  misc_feature (59)..(59): Xaa can be any naturally occurring amino acid
  misc_feature (69)..(69): Xaa can be any naturally occurring amino acid
  misc_feature (114)..(114): Xaa can be any naturally occurring amino acid
MEVFGKSVIAEPSNVIFLSAILNTGKIKSLSHKCXTKRCQNENIFGIMYXRCKLTETTXHICDKNCNQXRILYDNHYSLCRVSGQFFPLSPLEQQAVRDIRRKHECDSNHARPXARTLGALLYPYSFERPHSPVSPILSQGEKYCLSLC

SEQ ID NO: 7951 - protein, 347 aa, Zea mays
  misc_feature (69)..(69): Xaa can be any naturally occurring amino acid
  misc_feature (83)..(83): Xaa can be any naturally occurring amino acid
MAFAPKTSSSSSLSSALQAAQSPPLLLRRMSSTATPRRRYDAAVVVTTTTTARAAAAAVTVPAAPPQAXRRRRCRQSKRRHPXERRSRPVSDTMAALMAKGKTAFIPYITAGDPDLATTAEALRLLDGCGADVIELGVPCSDPYIDGPIIQASVARALASGTTMDAVLEMLREVTPELSCPVVLLSYYKPIMSRSLAEMKEAGVHGLIVPDLPYVAAHSLWSEAKNNNLELVLLTTPAIPEDRMKEITKASEGFVYLVSVNGVTGPRANVNPRVESLIQEVKKVTNKPVAVGFGISKPEHVKQIAQWGADGVIIGSAMVRQLGEAASPKQGLRRLEEYARGMKNALP

SEQ ID NO: 7952 - protein, 329 aa, Zea mays
MDGGGDAAKTRMKTVCVTGAGGFVASWLVQLLLSRGDYLVRGTVRDPGDPKNAHLAALGGASERLRLFKADLLDPASVAAAVAGCDGVFHVASPVPAVEPTNPDEVLVPAVTGTQNVLEASHAASVRRVVVVSSVGAVIANPSIPDGAVVDEDCWSDEDYCRTTKNWYCVSKTVAEREALAYGERTGTMDVVTVCPPWVLGPLLQPTVNATSMRFVTYLKGENTEEKTRNMVDVRDVAAALVLTYETPQASGRRYICSAHPMRVSETVGLVPSLRPDLKLLQYPRKFVQVEDHQRVSSRRLQALGWKCRTVEETLRDTVDSSKAAGIMN

SEQ ID NO: 7953 - protein, 376 aa, Zea mays
MALLKAARVADVPTLDVVVAPGLVAVAKARSAAAVGGRFSVIGHRGKGMNALASEDPRLRDVRENTVRSFNDAGRFPVDYVEFDVQVTKDGCPIIFHDNFIFTQDDGKISQKRVADIQLEDFLQYGLQNEQGKVGKPLLRRLKDGRMVNWDVQSEDALCTLEEAFDKVNPRLGFNVELKFDDSLEYTEEELTRILQAILKVVFEYAKDRPILFSSFQPDAAQLMRKLQGTYPVYFLTNGGTELYADVRRNSLEEAVKLCLAGGLQGIVSEARGIFRHPAAVPKIKEANLSLLTYGTLNNVPEAVYMQHLMGVNGVIVDLVPEITEAVSELIALPLPEPDLEVGSLSNQAAARGATTPNFSQREISFLLRLIPELVQ

SEQ ID NO: 7954 - protein, 388 aa, Zea mays
  misc_feature (127)..(127): Xaa can be any naturally occurring amino acid
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILXEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 7955 - protein, 133 aa, Zea mays
MSYYGDRRAESSIVEAFTLSPLPYPVILVLLMVTLLLGASWFFTYDDFIEEASQQLSWALLGVPIALVLLIRWISSVDSFEGYLGFYPTESRWKGRYERGPAEGSSPWGVALLVLLLLVLASFHSTIHDMWGP

SEQ ID NO: 7956 - protein, 282 aa, Zea mays
  misc_feature (166)..(166): Xaa can be any naturally occurring amino acid
  misc_feature (189)..(189): Xaa can be any naturally occurring amino acid
  misc_feature (193)..(193): Xaa can be any naturally occurring amino acid
  misc_feature (215)..(215): Xaa can be any naturally occurring amino acid
  misc_feature (234)..(234): Xaa can be any naturally occurring amino acid
  misc_feature (255)..(255): Xaa can be any naturally occurring amino acid
  misc_feature (268)..(268): Xaa can be any naturally occurring amino acid
MRQLHNLHLSTQSGYNNQQFSRPFSLEIPRPINRRLMDPVAASEETRGDEVVLRKRHILYDVSTGAAELSLVGSSFMVMCYLLFREVRKVSFKLVFYLSVSDMICSLFTILLGTSNAFFCSALGSSAHFRWGASPLWTTTISGTLHRAAGKHRTAVEEFGPICHLXVRGTSLSTTVLRAIGRDYGRPGXWRWXQQGSMAKVLHLIPFELPLWRAXLCTDGVTSYEGNRMLNNAXQMAAGISDQSNQADTRAGRKXVNRWGYYPLNLIXSWAFATINRLYDFA

SEQ ID NO: 7957 - protein, 364 aa, Zea mays
CPSGNTENFGAELLETLLKMAPTKEEEIKLREFEEETSPVKLNPAEKFLKAVLDVPFAFKRVDAMLYIANFDSEVNYLKKSFETLEAACDELRSSRLFLKLLEAVLKTGNRMNVGTNRGDAHAFKLDTLLKLVDVKGTDGHTTLLHFVVQEIIRTEGSRQSGSTQTTPRTQANPLREELECKKLGLQAVAGLANELSSVKKAAGMDSDVLSSYVTKLAGGIEKVTEVVLRLKNEGTESRDGAWRFHDRMQRFLKKADGEIIRIQCQESVALSLVKEITEYFHGDSAKEEAHPFRIFMVVRDFLAVLDQVCREVGRVNERTIASSARHFPVPVNPTTPQLFPRLHALRAGFSDDDESSAASVSSP

SEQ ID NO: 7958 - protein, 192 aa, Zea mays
MSAVNITNVAVLDNPTAFLNPFQFEISYECLVPLDDDLEWKLIYVGSAEDENYDQQLESVLVGPVNVGTYRFVLQADPPDPSKIREEDIIGVTVLLLTCSYMGQEFMRVGYYVNNDYDDEQLREEPPAKVLIDRVQRNILADKPRVTKFPINFHPEPSTGPGQQQQQEPQTTSPENHTGNGEANGSKPEADQ

SEQ ID NO: 7959 - protein, 192 aa, Zea mays
GAPRGRPGVHRVIFLQYLSATDPLVMARVLQDVLDTFTPTIPLRITYNNSQVLAGAELKPSAVISKPRVDIGGNDMRTFYTLVLIDPDAPSPSHPSLREYLHWMVTDIPETTSVNFGQELVFYERPDPRSGIHRLVFVLFRQLGRGTVFAPEMRQNFNCRSFARQYHLSIASATHFNCQREGGSGGRRFREE

SEQ ID NO: 7960 - protein, 753 aa, Zea mays
MGCVSSKQFHGGDDHGDGKPRRRPSSNSLKRLVSYSSSKRHEELEEEDEVGAAVAATSSSGGRRAGNDASTARLIRKPPALVVEAVPALSEEAATLAVGVVDAERAVAAATGNRKRPPADVHINGAAEQGLSSVGVRTEGEAKPRIRDVPNGVQGEHVVAGWPRWLTEVAAEAVRGWQPRRAESFEKLDKIGQGTYSSVYKARDLENGKIVALKKVRFANMDPESVRFMAREIHILRRLDHPNVIKLEGLVTSRMSSSLYLVFEYMEHDLAGLAATPGLKFSEPQVKCYMQQLLSGLDHCHNRGVLHRDIKGANLLLDNNGILKIADFGLATFFNPKQKQHLTSRVVTLWYRPPELLLGATNYGAAVDLWSAGCILAELLSGKPIMPGRTEVEQLHKIFKLCGSPSEEFCPRVRLSRATIFKPQHPYRRCVNDVYKDFPTTALTLLDHLLAVEPGNRGTAASALDSEFFTTKPYACDPSSLPKYPPSKEYDAKLRDEEARRQRAAAKGQEAEAGRRKQPPAPDGNSGLQHRRVQMNPKSSSYKFTPKEDAVSGFPIDPPARAAADNGYPQRVPLMQAGRSSSTLGRSSGMDPKAQRFHTSQIVTTEMSGQSTASGQRGNAPKMSNLGESARRQYLREHRSSSRYSQLTAADPSDRPEWNHQFQERPSSSHRKDDAVANKEHTVVNGTKKNRIHYSGPLMPPGVNMDEILREHERQIQQAVRRARLDKGKGKHSGERDQSESLLCTTGNLRADR

SEQ ID NO: 7961 - protein, 241 aa, Zea mays
MAANLEDVPSLDLMHELLRRMKCSSKPDKRLILIGPPGSGKGTQSPIIKDEYCLCHLATGDMLRAAVAAKTPLGIKAKEAMNKGELVSDDLVVGIIDEAMKKPSCQKGFILDGFPRTVTQAQKLDEMLAKQGANVDKVLNFAIDDAVLEERITGRWIHSASGRTYHSKFAPPKSPGVDDVTGEPLIQRRDDTAEVLKSRLEAFHRQTEPVIDYYSKKGLVVNLPAEKPPKEVTAEVQKALS

SEQ ID NO: 7962 - protein, 388 aa, Zea mays
MLRLQKHLSLRLQEHLLPLHRSASLIQLSLQRSLLSTGSATYSSPGHFAADDYLVSTCGLTREQAANAAKCISHWKSSSNADAVLSFLTGPALGLSNAEIALLVAKDPRVLSCSVDNTLRARLARFRSHGFSAAQISEFVRVAPCFFRKFNIDVKLGFWMPFLGSPDRFLRLVKRNFYLLSSDLDKVVKPNIQLLQECGLSIQEIGSLCVANPRLLTSKPDRIRAVLVRAGEMGVPRKTLLFRHAVTAVAGLCPETFASKLKMMANILGCSEAEVARMVQKNPLVLRRSMETIQRACEFLINVVGVGTNFILDKPTILMYSLERRLVPRHYVMKVLQDKGLMRKDHSFYTLAAISASVFCSRYVHPHKNVLPNLAAAYASGCNGKIAI

SEQ ID NO: 7963 - protein, 224 aa, Zea mays
  misc_feature (109)..(109): Xaa can be any naturally occurring amino acid
MVKRWLPLEANPDVMNQFMWGLGVPEDVGFCDVYGLDDELLAMVPQPVLAVLLLYPQDRSKESQASATSSVETKEPSKNVYFTKQTVGNACGTVGIIHALGNATSRIKXEGSYFDRFYKRTADMDPIQRAAFLEEDEEMENAHSIAATAGDTEAKDGVIEHYICFSCVDGELYELDGGTSQPIPHGPSTPDTLLQDAAEVIKARIAMYSQSNNFNVMALSGKAI

SEQ ID NO: 7964 - protein, 344 aa, Zea mays
MLAGISRFLTRRRRPPFPLAATAAAAAMSSSSSTAANISERPISPDTTRVAWVGTGVMGQSMAGHLLAAGYALTVFNRTASKTQGLVSRGASLADSPRAAAAAADVIFLMVGFPSDVRSTALDPSTGALSGLTPGGILVDMTTSDPTLAAEIAAAAAAAGCSAVDAPVSGGDRGARNATLSIFAGGDAAVVARLAPLFKLMGNALYMGGPGAGQRAKLGNQIAIASTMVGLVEGMVYAHKAGLDVAKWLEAISTGAAGSKSLELYGKRILERDMAAGFYVRHFVKDLGICLLECQAMGLSLPGLALAQQLYVSLIAHGEGGLGTQALILAVERLNNTSLEKKDE

SEQ ID NO: 7965 - protein, 466 aa, Zea mays
MELVTIVTLTLLAYSAAMLARVLVARAQRRRCYLLDYVCYKATDDRKLPTDLCGEIIQRNKLLGLEEYKFLLKVIVNSGIGEETYGPRNMIEGGEARPDRLREGMEEMDETFHAVLDELFARSAAPGGVGIRPADVDVLVVNVSMFSPAPSLSARVVRRYGLREDAKVYNLTGMGCSATLIALDLVNGYFRTHAGQVALVMTSESIAPNWYAGNKRTFMLGNCLFRSGGCAYFLTNDPRLRPHAKLRLRHVVRTHTGASDEAYNCALQMEDEAGRPGFHLGKELPRAAVHAFVHNLRVLAPRVLPLPELLRLACATLSARLARKKRQRGAGHGHGHLTIRMKAGVDHFCVHTGGAAVIDGVGKGLTLTEHDLEPSRMTLHRFGNTSASSVWYVLAYMEAKGRLRQGDRVLMLTFGAGFKCNSCVWTVERPATDAGVWKDRIHHYPLKDVSNPFMDKYGFVKDLIDL

SEQ ID NO: 7966 - protein, 466 aa, Zea mays
MELVTMVTLTLLAYSAAMLARLLVARAQRRRCYLLDYVCYKATDDRKLPTDLCGEIIQRNKLLGLEEYKFLLKVIVNSGIGEETYGPRNMIEGGEARPDRLREGMEEMDETFHAVLDELFARSAAPGGVGIRPADVDVLVVNVSMFSPAPSLSARVVRRYGLREDAKVYNLTGMGCSATLIALDLVNGYFRTHAGQVALVMTSESIAPNWYAGNKRTFMLGNCLFRSGGCAYFLTNDPRLRPHAKLRLRHVVRTHTGASDEAYNCALQMEDEAGRPGFHLGKELPRAAVHAFVHNLRVLAPRVLPLPELLRLACATLSARLARKKRQRGAGHGHGHLTIRMKAGVDHFCVHTGGAAVIDGVGKGLTLTEHDLEPSRMTLHRFGNTSASSVWYVLAYMEAKGRLRQGDRVLMLTFGAGFKCNSCVWTVERPATDAGVWKDRIHHYPLKDVSNPFMDKYGFVKDLIDL

SEQ ID NO: 7967 - protein, 338 aa, Zea mays
  misc_feature (298)..(298): Xaa can be any naturally occurring amino acid
  misc_feature (317)..(317): Xaa can be any naturally occurring amino acid
  misc_feature (331)..(331): Xaa can be any naturally occurring amino acid
LACLQLFARLNYRDRASMASACRAWRALGSSSCLWSTLDLRAHRYDREVASSLASRCGSLRRLRLRGHEAAEAVPALRAHGLREVVADGCRGLTDATLAVLAARHEDLQSLQIGPDPLERISSDALRHVALCCSQLRRLRLLGLREADADAVGALARGCPLLEDVAFLDCGTVDEAALAGIHSVRFLSVAGCRNLKWATASTCWTQLPSLIALDVSRTDVPPSAVSRLISHAKTLKLICTLNCISVEEEQLHNPAVFSNSKGKVVLTINSDIFKSFETMFPVVDVKEHEFFNQCNWSXKDKIPGDTMTWLEWILSQXLLRIAESNPQGMDXFWLQACK

SEQ ID NO: 7968 - protein, 671 aa, Zea mays
  misc_feature (117)..(117): Xaa can be any naturally occurring amino acid
  misc_feature (164)..(164): Xaa can be any naturally occurring amino acid
  misc_feature (196)..(196): Xaa can be any naturally occurring amino acid
MEISDEQRMQVECQRLPPSWQGNGSDADVEVDHHLWPSKDGPLPIFLKFENVEYRVKMTLKNPLTAARVAFASQTRADQGSSCKHILKGIAGSVDPGEILALMGPSGSGKTTLLKIXGGRLGGGVKGHITYNDTPYSPCLKRRIGFVTQDDVLFPQLTVGGTLXFAAFLRLPACMSKQQKRDRVDAIIAELNLERXLSFHFFRCRHTKIGGAFVRGVSGGERKRTSIGNEILVDPSLLLLDEPTSGLDSTSASKLIFILQRLAKTRRTIITTIHQPSSRMFHMFDKLLLISDGHAIYHGKARDCMHHFSSLGFVPEIPMNPAEFLLDLATGNLDDISVPEALRGSPDPQEFRSQVIRHLQLKYRAGAEAPAGRRTPTEQLRLAVRAHNKDRRRRSIGWLQQFAVLSRRTFRERASDYLDKMRLAQAVGVALLLGLLWWKSQTGNEAQLRDQVGLIFYICIFWTSSSLFGSVYVFPFEKLYLVKERKADMYRLSAYYASSTLCDAVPHVVYPVLFMAILYFMAGLRRTVPCFFLTLLATLLIVFTSQGTGELLGAAILSVKRAGVMASLVLMLFLLTGGYYVQHIPKFIRWLKYVSFMHYGFNLLLKAQYHGHLMYNCASRGGCQRLQSSPSFGTVDLDGGMREVWILLAMALAYRLLAYFCLLKRISLTPL

SEQ ID NO: 7969 - protein, 370 aa, Zea mays
MTSTAAGASSSAAKSESYLRADKIDLESLDIQLEKQLAKTWEKHKGSYNQGPREDWEIDLAKLEIRYVIAQGTYGTVYRGTYDGQDVAVKLLDWGEDGFASETETATLRASFKQEVAVWHELNHPNVTKFVGASMGTTDLKIPANSSNSGGRTELPPRACCVVVEYLAGGSLKQYLIKNRRRKLAYKVVVQIALDLARGLNYLHSRKIVHRDVKTENMLLDTQRNLKIADFGVARVEAQNPKDMTGATGTLGYMAPEVLEGKPYNRKCDVYSFGICLWEIYCCDMPYPDLSFADVSSAVVHQNLRPDIPRCCPSPMANIMRKCWDANPDKRPDMDDVVRFLEALDTSKGGGMIPEGQAGGCLCFFRARGP

SEQ ID NO: 7970 - protein, 185 aa, Zea mays
FLLDRPAQFCGSIDRSVIRQVSKLYIYRRLFERASEMGSAVLFYCICIAVVVALSSSMVAVGAAAPGEPPKFISASALECSANVTEIAKARKLIDVHGHGLCPVRFDHTRGISAVASSCKDRPLPSPERCCGALKTYACPYSELINDNANNGCASEMFYVIMTRGRLRPGLFSQLCVEGPLGLQC

SEQ ID NO: 7971 - protein, 218 aa, Zea mays
  misc_feature (200)..(200): Xaa can be any naturally occurring amino acid
  misc_feature (203)..(203): Xaa can be any naturally occurring amino acid
MQGASHMLLEEPFRLASVLSPAKPKVFPSLTKIVGTLGPNSHSVGIIQECLTAGMSVARFDFSWMDAAYHQETLDNLRKAAQNVKKLCPVMLDTLGPEIQVHNSTGEPIELKAGNHVIITPDISKALSAEILPIKFGDLAKAVKKGDTLFMGQYLFTGSETTSVWLENAATLAGPIFTLHASQVHINLPTLSEYDKMSFXNWXSCNSVDIISLSHTRS

SEQ ID NO: 7972 - protein, 136 aa, Zea mays
MSSLPLRSGEKMESPSISDAVPLHAPEDATADFSQPQSPLHEVDSFPVTESSDDVVVNVSEIPNLSPSDDVFDHERNSGEDRDQDHGENLAETNVVVVVPIDELKKKIIRQVEYYFSDENLPTDKFLLNAMKRNKK

SEQ ID NO: 7973 - protein, 363 aa, Zea mays
  misc_feature (67)..(68): Xaa can be any naturally occurring amino acid
KSGWLEEPNASVSELTARRTRSPLLSSSSGSPSPHAIPTHYRLAFGYAYPAYECYKTVELNKPEIAXXIFWCQYWILVALLTVLERFGDFTISWLPFYSEAKLMFFVYLWYPKTKGTTYVYGTFFKPYISQHENEIDRNLLELRARATDTVVLYFQKAASAGQSTFFDVLKYVAAQSPSQKSRQRLHQESQQPPQQQQPQVQVQQAQPQKQAAPVMRRASSIAARQAAMAQQSQETKPVSSSPKIKRQTSARSGSVASTKPPVAASAPKPGGSPKKGEVKPAAGPVQTPTTGADSPKPEPSAPSLPGAEGVDNIAIDEASGDAPEGAEELDPALEEETPMEETIRVTRAKLRRRMTTEDPAGN

SEQ ID NO: 7974 - protein, 332 aa, Zea mays
  misc_feature (221)..(221): Xaa can be any naturally occurring amino acid
  misc_feature (240)..(240): Xaa can be any naturally occurring amino acid
MMGGFLSRVLLLAFGYAYPAYECYKTVELNKPEIAQLIFWCQYWILVALLTVLERFGDFTISWLPFYSEAKLMFFVYLWYPKTKGTTYVYGTFFKPYISQHENEIDRNLLELRARATDTVVLYFQKAASAGQSTFFDVLKYVAAQSPSQKSRQRLHQDSQQPPQQQQPQVQVQQAQPQKQAAPVMRRASSIAARQAAMAQQSQETKPVSSSPKIKRQTSAXSGSVASTKPPVAASALKPXVEPKERRGQTCSDPVQTPTTGADSPKSEPSVPSLPGAEGVDKMAIDEASGDAPEGAEELDPALEEETPMEETIRVTRAKLKRRTTTEDPAGN

SEQ ID NO: 7975 - protein, 332 aa, Zea mays
  misc_feature (36)..(36): Xaa can be any naturally occurring amino acid
MMGGFLSRVLLLAFGYAYPAYECYKTVELNKPEIAXLIFWCQYWILVALLTVLERFGDFTISWLPFYSEAKLMFFVYLWYPKTKGTTYVYGTFFKPYISQHENEIDRNLLELRARATDTVVLYFQKAASAGQSTFFDVLKYVAAQSPSQKSRQRLHQESQQPPQQQQPQVQVQQAQPQKQAAPVMRRASSIAARQAAMAQQSQETKPVSSSPKIKRQTSARSGSVASTKPPVAASALKPGGSPKKGEVKPAADPVQTPTTGADSPKPEPSAPSLPGAEGVDKMAIDEASGDAPEGAEELDPALEEETPMEETIRVTRAKLRRRTATEDPAGN

SEQ ID NO: 7976 - protein, 332 aa, Zea mays
  misc_feature (199)..(199): Xaa can be any naturally occurring amino acid
MMGGFLSRVLLLAFGYAYPAYECYKTVELNKPEIAQLIFWCQYWILVALLTVLERFGDFTISWLPFYSEAKLMFFVYLWYPKTKGTTYVYGTFFKPYISQHENEIDRNLLELRARATDTVVLYFQKAASAGQSTFFDVLKYVAAQSPSQKSRQRFHQDSQQPPQQQQPQVQVQQAQPQKQAAPVMRRASSIAARQAAMXSQSQETKPVSSSPKIKRQTSARSGSVASTKPPVAASALKPGGSPKKGEVKPAADPVQTPTTGADSPKPEPSAPSLPGAEGVDKMAIDEASGDAPEGAEELDPALEEETPMEETIRVTRAKLRRRTATEDPAGN

SEQ ID NO: 7977 - protein, 720 aa, Zea mays
  misc_feature (305)..(305): Xaa can be any naturally occurring amino acid
  misc_feature (314)..(314): Xaa can be any naturally occurring amino acid
KHCLQKKYKKNPVLLLVLLAAHVVSTSAHAEPPLPSPYNTSAHGEPPLPSTYNPSMCSESFRCGGVEIRYPFYLANATADYSGNYYSCGYTDLSVSCELEVEGPSTTWTPTIRLGGDNYTVKNIYYDYHTISLADRDVLGGGGCPVVDHNVTIPQDVRLNASAFDNLTFFFGCHWGPRDTLPEFAGNNISCAGFSTPTVSGGSFVFKPEDLDEQEEQELASHCDEVASVPVGSDALRATDTFSLTGYGSLGTIGGGYGEALRAGFQLGWDRGSGPCARCEQSGGKCGYGRAGEFLGCFCSSSRVXTPAATAVRXSKRKARILAGALGGGAAALLVGAAIFLFVIMRKRKQKKKVINSSSKLLKYSGSGGTPRSRVGDMESGSIEDPPTHHFTYEELEEATNRFDESRELGDGGFGTVYKGYLRDGRVVAVKRLYNNGYRRVEQFQNEAAILSGLRHPNLVMFYGCTSSHSRELLLVYEFVANGTVADHLHGQRAPERALSWPLRLSVAVESAAALTYLHAIEPPVVHRDVKTTNILLDADYHVKVADFGLSRLFPLDVTHVSTAPQGTPGYVDPEYHQCYQLTDKSDVYSFGVVLVELISSKPAVDITRHRSEINLASMAISKIQKCQLEELVDLGLGYDTDPATRKMMTMVAELAFRCLQQNGEMRPPIKEVLEVLRNIQGECLTSGKDGDKSKDGPFSPTTVHAPWDSRSTTPNTSRD

SEQ ID NO: 7978 - protein, 166 aa, Zea mays
MAETEQKEVEEKGSLISGLLDKAKGFFAEKLANIPTPEATVDDVDFKGVTRQGVDYHAKVSVKNPYPQAIPICQISYILKSDTRMIASGTIPDPGSLIANGSTVLDVPVKVPYSIAVSLMKDMCLDWDIDYQLDIGLTIDIPIVGDITIPVSTQGEMKLPSLRDFF

SEQ ID NO: 7979 - protein, 118 aa, Zea mays
  misc_feature (45)..(45): Xaa can be any naturally occurring amino acid
  misc_feature (76)..(76): Xaa can be any naturally occurring amino acid
  misc_feature (97)..(97): Xaa can be any naturally occurring amino acid
  misc_feature (107)..(107): Xaa can be any naturally occurring amino acid
METKRSVRTLGEADLKGKNAFVRADLNGPLDDAQKITDDTRIRAXVPTSSFLLQKGAKVILARHLGRPKGATPKYXSLKPLVPRLSELLAVEVLMAXDCIAEEVDKXLVEALPQGGVL

SEQ ID NO: 7980 - protein, 404 aa, Zea mays
NRLGGFPVQTAPVPLVHSPAFNLDPFTNAAVFSLEESDLKALAAPGCFRAPRSSCLEVAVYYLARFGASRCGVLACGRKRLVGVFRVELASSEWRDGKPVLLHHGWAGIGKGAARPELHLRVKLEADPRYIFQFDDEIALNPQVVQLHGSIRQPVFSCKFIRDRRPSQSDPLGGGQYWSSSSSEEQDMEMVRRERKAWKVVIHDLSGSAVAAAFMATPFVPAPGGDTVARSNPGAWLIVRADTTGSSDSWQPWGRLEAWREAAAAAASSGKDTVRLRLHLLPDRHDDCVLVSEAPLSSDKGGEFFIDMDRQAPSATAAEHCAASLGAACAGGGFVMSCRVEGEARSSRPFVQLAMRHVTCMEDAAMFVALAAAVDLSVKACRPFRRKPNKKAASPSPDHLELDT

SEQ ID NO: 7981 - protein, 373 aa, Zea mays
FSLEESDLKALAAPGCFRAPRSSCLEVAVYYLARFGASRCGVLACGRKRLVGVFRVELASSEWRDGKPVLLHHGWAGIGKGAARPELHLRVKLEADPRYIFQFDDEIALNPQVVQLHGSIRQPVFSCKFIRDRRPSQSDPLGGGQYWSSSSSEEQDMEMVRRERKAWKVVIHDLSGSAVAAAFMATPFVPAPGGDTVARSNPGAWLIVRADTTGSSDSWQPWGRLEAWREAAAAAASSGKDTVRLRLHLLPDRHDDCVLVSEAPLSSDKGGEFFIDMDRRAPSATAAEHCAASLGAACAGGGFVMSCRVEGEARSSRPFVQLAMRHVTCMEDAAMFVALAAAVDLSVKACRPFRRKPNKKAASPSPDHLELDT

SEQ ID NO: 7982 - protein, 468 aa, Zea mays
MSCFRCFSGCRTKRGKGEKRREGSTAPASPAAASFPSTVSTGAPSNLTFSTASSAVVTSHSEDSSAVMRPEATKSSGSASVSSARSIPELYEERGASSLREFGFRELRAATSDFSRLLKVGEGGFGSVYKGVVRLPGGPAGGTVVAIKKLNPNGHQGHKQWLAEVHFLGVVEHPNLVRLIGYCAAQGERGPLRLLVYEFMTNKTLDDHLFNKAYPVLPWDIRLEIALDAAEGLLYLHEGLEVQVIYRDFKASNVLLDEEFRAKLSDFGLAREGPSAGDTHVSTAVMGTLGYAAPDYVETGHLTTKSDVWSFGVVLYEILTGRRSIERNRPKNEQKLLEWVRLYPVESKQFSKIIDARLEGHYSKQGTRKIAKLANSCLAKHRRDRPTMREVVESLKQAMQHKELDGKAGALNETSPPEEMSGKPSTEDVAVASARRRMLHLAALGENANSIARRRFMFMRTAASPTPT

SEQ ID NO: 7983 - protein, 169 aa, Zea mays
  misc_feature (134)..(134): Xaa can be any naturally occurring amino acid
  misc_feature (163)..(163): Xaa can be any naturally occurring amino acid
MLVYRDLLSDDQLLSDSFTYNDLENGVLCEVKEKGRTQGPVDVDIDAIPSTEDGEDQSCDDTVVKVVDIVDTFRLQEQPPFDKISFRVLHQKIHTRISLLCCDHRKRMTSKRMSEGATKFLLSKVRDLQFFVGXEPMKDDATVLFAYYNDGDINPRLLYFSHXLMEIEC

SEQ ID NO: 7984 - protein, 287 aa, Zea mays
  misc_feature (44)..(44): Xaa can be any naturally occurring amino acid
MTIRLESSSVRSPANAATFGPSVDQLLHDLRFLYDALLNPESSXSKKPEVVGASAHSAAAKIIDCKQFIKHYDEHALRTPSNPFLLCVRCSIELLDHPKDYTTPPEELVLLPASATLGDLKVQASKAFQETYLMFQSFQTEQLPDFPNFSDTTPVKHVLGSGQLLRVRGRCTGDYRRIVQFRMERGLENWTVDCSCGAKDDDGERMLACDICGVWQHTRCSGISDFEEVPENFICRKCASPRKGDGRGGGGSNGGGTMEVTASGRCKDEIGASVGGAGKYGRMATVG

SEQ ID NO: 7985 - protein, 244 aa, Zea mays
PPFWPPAHLLPPLRNTHGRIDCKQFIKHYDEHALRTPSNPFLLCVRCSIELLDHPKDYTTPPEELVLLPASATLGDLKVQASKAFQETYLMFQSFQTEQLPDFPNFSDTTPVKHVLGSGQLLRVRGRCTGDYRRIVQFRMERGLENWTVDCSCGAKDDDGERMLACDICGVWQHTRCSGISDFEEVPENFICRKCASPRKGDGRGGGGSNGGGTMEVTASGRCKDEIGASVGGAGKYGRMATVG

SEQ ID NO: 7986 - protein, 671 aa, Zea mays
MVVNGRPLKRARARVEARDFARFPAAGDCGAAGTFREAVRGFLAKHARLLPLPSIFSPAAAAAPPHLLIWRVSLRVGEAGEEESGGGVELNVVEEDVLRSRSVYCDQCRVVGWSGHPVCVKRYHFIIENDSSHLSGRRRTCCLRCGTPMAAGESRVNGREGGSRFLTGRDIMSLWDRLCKVLHVRKVTVMDISKKHGMDYRLLHAVISGHPWYGQWGYKFGAGSFALTSDTYRNAVDMLSSINLALYFSHRSQIRTPLQNTIALYWALSNRQLVTLRDLFRFIMHLLHQGQKMSKPSADKHKELTSNELCAWTKEDLHRAEGAMLKVLQVVQTGQWVSWRALRGAASKAVDSQELLDYSLRGLGGKQLDNGLCVAVRCNAGTSAIEYRLESSSVRSPANAATFGPSVDQLLHDLRFLYDALLNPESMLSSQPEVVGASAHSAAAKIIDCKQFIKHYDEHALRTPSNPFLLCVRCSIELLDHPKDYTTPPEELVLLPASATLGDLKVQASKAFQETYLMFQSFQTEQLPDFPNFSDTTPVKHVLGSGQLLRVRGRCTGDYRRIVQFRMERGLENWTVDCSCGAKDDDGERMLACDICGVWQHTRCSGISDFEEVPENFICRKCASPRKGDGRGGGGSNGGGTMEVTASGRCKDEIGASVGGAGKYGRMATVG

SEQ ID NO: 7987 - protein, 425 aa, Zea mays
  misc_feature (186)..(186): Xaa can be any naturally occurring amino acid
  misc_feature (231)..(231): Xaa can be any naturally occurring amino acid
  misc_feature (291)..(291): Xaa can be any naturally occurring amino acid
  misc_feature (314)..(314): Xaa can be any naturally occurring amino acid
  misc_feature (328)..(328): Xaa can be any naturally occurring amino acid
MGCGPSIPDKYTIGGKGRKRRSVIQEVAVFVPTIRIPVASDIAHPLRGIVSKDLVDRLSTLRAHVASLAEEIYHADVSAVQELQHALEEYLPVVLGLTTKESRLESSVQFRWKTLDDDQECCLASAWYEVLSVVHMMAMLALFEANLLLIPKNSQGGGERKVAEDAKKDVVDSLLRASGCLDYSVXRILVQIPAQVKNGFPSYLQEGMLEAISIQALAQCVEIQLGLASEXHKKIPDVAYKKFQAHGHLFEQNKNSALQSVPDLPEFRMSLRPDGYELPITDSIWENVDGXTSDSEPQGAYDRRRGCSRHAAVXSLPNASFHCTTKSXQSSKTLMPPPWGVMKNMHKKIPDVANKKFQAHGHLFEQNKNSALQSVPDLPEFALSLRPDGYELPITDSIWENVDGQPQIQSLKEHMIDDEDEVGTK

SEQ ID NO: 7988 - protein, 197 aa, Zea mays
  misc_feature (87)..(87): Xaa can be any naturally occurring amino acid
  misc_feature (98)..(98): Xaa can be any naturally occurring amino acid
  misc_feature (121)..(121): Xaa can be any naturally occurring amino acid
  misc_feature (141)..(141): Xaa can be any naturally occurring amino acid
  misc_feature (149)..(149): Xaa can be any naturally occurring amino acid
  misc_feature (171)..(171): Xaa can be any naturally occurring amino acid
GARSGWLHAGVSVLRWPASAPHQRAPWAPNSALHSRASPRPDATLVGTRAAAEDFIETLACSEKTLSAAHRLCIAGFSLRTKRPSPXAVDTAKIEPCXQSKASDKRENNSTKKISAWLKKXWSDNDPILDTEDMIKKTNSXARTTDSAXLLCGANGLPHLSICGEQPHWIXYKSPGLLVLYIEHPDTLRTLRATSST

SEQ ID NO: 7989 - protein, 360 aa, Zea mays
  misc_feature (175)..(175): Xaa can be any naturally occurring amino acid
VGAARRELSAASLAVVDGEARYLVGTYKRSRVVFEHGRGCKLYDTDGREYLDMAAGIAVTALGHADPDVCATIAEQAGKVVHVSNVFYTKPQVGAPAPSDPPSPASLAMCSTHCSGRPIFLCFICRSASLSQVELAKRLVEVSFADRAFFASTGTEANEAAIKFSRKFQRAAHPXELSSSPLQCGFGRTGHLWAHEAYGVEPDIMTLAKPLANGIPIGVVLVKEKVAAAINYGDHGTTFGGGPLACQTAITVFDKITRPGFLAEVSRKGESFKQLLRAKLSGNPHVREVRGVGLLVGVELDVPAGPLVDACLDAGVIVLTAGKGNVVRLVPPLIVSEKELEHAADVIRDCLPALDVVAAA

SEQ ID NO: 7990 - protein, 198 aa, Zea mays
MEGQFQVGKEEVIQAWYMDDSEEDQRLPHHREPKEFIPLDKLSELGILSWRLNADDWENDENLKKIREARGYSYMDICDVCPEKLPNYEAKIKNFFEEHLHTDEEIRDCLEGCGYFDVRDQDDQWIRVAVKKGGMIVLPAGMYHRFTLDSDNYIKAMRLFVGEPVWTPYNRPHDHLPARKEYVEKIINRGGNQAVEAR

SEQ ID NO: 7991 - protein, 317 aa, Zea mays
  misc_feature (124)..(124): Xaa can be any naturally occurring amino acid
MADPSFLVGIVGNVISILVFASPIATFRRIVRSRSTEDFRWLPYVTTLLSTSLWTFYGLLKPGCLLVVTVNGAGAALEAAYVALYLVYAPRETKAKMAKVVVAVNVAFLAAVVAVAPAGAARRXRLFAVGLLCAALTVGMYAAPLGAMRTVVKTRSVEYMPFSLSFFLFLNGGVWSIYSLLVKDYFIGVPNAIGLVLGTAQLLLYLAYRKAPASKDDDEEAAAAASGDDGDDEEEEEGLTHLMGQQVEMAQRGRLRLHKGQSLPKPPPGGPLSSPRHGFGSIIKSLSATPVELHSVLYQHARFQPVKKDDDDVEAND

SEQ ID NO: 7992 - protein, 299 aa, Zea mays
  misc_feature (180)..(180): Xaa can be any naturally occurring amino acid
  misc_feature (276)..(276): Xaa can be any naturally occurring amino acid
MEAADYGKLFVGGISWETSEDRLREYFGRFGEVTEAVIMRDRSTGRARGFGFVVFADAAVAERVTMDKHTIDGRMVEAKKAVPRDDHSIVSKSNGSSTGSPGPGRTRKIFVGGLPSSVTEADFRRYFEQFGIITDVVVMYDHNTQRPRGFGFITYDSEDAVDKALHKSFHELNGKMVEVXPSAHGMGNISSLGSGNLARGAGDNNFGLPSGSYGRSNSTGTIGEPFSAAGNTYDVNNPDTYGSSSIYGGTAWRFTSSEVDMPFGHDIGNFDPTIKXDMSASHMCNYPVNNNQPSRGTTS

SEQ ID NO: 7993 - protein, 427 aa, Zea mays
  misc_feature (95)..(95): Xaa can be any naturally occurring amino acid
  misc_feature (206)..(206): Xaa can be any naturally occurring amino acid
  misc_feature (408)..(408): Xaa can be any naturally occurring amino acid
MVFDASGSRSAAASGNPLRVILTRGFARQVLVGRWLTVFASLLIMASSGATYIFGSYSGTLKSSLGYDQRTLNTVSFFKDLGANLGVFSGLINEXVTPPWVVLAMGAAMNLSGYLMVYLAVSGRTAPPPLWLVCLYFFVGANSQSFANTGALVTCVKNFPDSRGVVLGILKGFVGLSGAVYTQLYLALYGGDDAESLILLVAWLPXAAVSVVFVHTIRYMPYPRRRGGGRQETSSDSDPFFCFLYLSIALACFLLVMIVVQKQVPFSRAAYGVAATPLLILLLMPLGVVVKQEYKIYRERQLDAADPPPPTIISASATDASKKTEQQPAPAPPPTTSSFCGCVRTMFRPPARGEDYTILQALVSVDMLVLFVATICGVGGTLTAIDNMGQIGESLGYPARSVNTFRVXLISIWNYAGRVTAGYASEA

SEQ ID NO: 7994 - protein, 139 aa, Zea mays
LLCTDTYTEERKEFIELSAEILYGLIHARYILTSKGLAAMLEKFKNYDFGRCPRVYCCGQPCLPAGQSDVPRSSTVKIYCPKCEELNYPRSMYQGNIDGSYFGTTFPHLFLMTYPHLKPQKPPQQYTPRVFGFKLHKPS

SEQ ID NO: 7995 - protein, 288 aa, Zea mays
MNRGRETGGNLRESGLFSGCDGDGGAGMDRKRIKDVLEKHLERSSPSTSRGVVSKERERLAAGKLPASLGKAEKVSDGEEFETDSEDEDSDISGSESEGTSWISWFCTLRGNEFFCEIDDDYIQDDFNLCGLSMQVPYYDYALDLILDIESSDDTYTEERKEFIELSAEILYGLIHARYILTSKGLAAMLEKFKNRDFGGCPRVYCCGQPCLPAGQSDVPRSSTVKIYCPKCEELNYPISMYQGSIDGSYFGTTFPHLFLMTYPHLKPQKPPQQYTPRVFGFKHHKPS

SEQ ID NO: 7996 - protein, 319 aa, Zea mays
  misc_feature (199)..(199): Xaa can be any naturally occurring amino acid
  misc_feature (224)..(224): Xaa can be any naturally occurring amino acid
  misc_feature (236)..(236): Xaa can be any naturally occurring amino acid
  misc_feature (254)..(254): Xaa can be any naturally occurring amino acid
MERVCENNFVPFIRSGEWSDIGGRDYMEDAHVCISDLAKNFGSNSADDEVISFYGVFDGHNGKDAAHYVRDNLPRVIVEDADFPLELEKVVKRSFVQTDSKFAEKFSHHKGLCSGTTALTAMIFGRSLLVANAGDCRAVLSRRGTAIEMSRDHRPCCMNERKRVESLGGYVDDGYLNGQLAVTRALGDWHLDGMKTPGXVGEPGGPLSAEPELKMVTLTKDDEXFLIIGSDGIWDXFSSQNAVDFARRRLQDHXDLRLCCREMVDEAVRRGARDNLTAVMVSFHPDAPPPSRANKRTGRVTRSISAEGLHSLRVLLEGQ

SEQ ID NO: 7997 - protein, 119 aa, Zea mays
  misc_feature (37)..(37): Xaa can be any naturally occurring amino acid
MQAKARIHADPVHEFDQFDCLHDSLVLLILNKLEQAXDVRSLGRCSAVSKRFSGLVLLVHDVRVKIDRVVTMDGDSADDALNLSSPKPHNIISHLFKMMLVAIAQPFHDMRSPSSAGRL

SEQ ID NO: 7998 - protein, 389 aa, Zea mays
  misc_feature (156)..(156): Xaa can be any naturally occurring amino acid
MALHAAAPACAVFCRLPSPSPSHVGGRRSLPAVASPRGVVSAAPLRTRAVPTKAIVNSDGIPETSDSPHVVCFGELLIDFVPTVNGVSLAEAPAFKKAPGGAPANVAVGIARLGGSSAFIGKVGDDEFGYMLADILKQNNVNNQGLLFDPHARTAXLAFVSLRSDGEREFMFYRNPSADMLLEEKELDLDLIRKAKIFHHGSISLITEPCKTAHIAAARAAKDAGVLVSYDPNLRLSLWSSPEDARDGILSVWRTADIFKVSEEEVSFLTNGEDPYDDAVVKKLMHSNLKLLLVTEGPDGCRYYSKDFSGRVGGLKVSAVDTTGAGDAFVAGVLSQLATDFSLLQDEGRLREALKFANVCGALTVTQRGAIPALPTRQQVLDALTNFVA

SEQ ID NO: 7999 - protein, 570 aa, Zea mays
  misc_feature (459)..(459): Xaa can be any naturally occurring amino acid
MSLRTTAWLSARPGHHQPVQCLSAPEKPRRRSANYQPTSWDYNALLSLDSGRPGDQVHPSSYYKMKRRIRDMLLKKVEPSSKLQTIDAMQRLGISYHFEDEISNILYSVSNESTKAQYTYDNIAFTALKFRLLRENGFPTILGPLGYHNYEKFITKTPSLEDANTLLLLYEASYLAFGDEEKLDVARTFSAKALKQLMPFMLPHLREGVAHSLELPLHWRASRLETRWFIDYYARDRNMCPLLLQFAEIDFNQVQYEHQKDLAVVTRWWKKIGLGEKLPFARDRLMECFHYANGIVWDPKLGTCRQMLAKVSNLIVYLDDVYDVYGTIEELVLFTNAIARWDAIPNETLPEYMKALYSIIYDTSNEVAEHALKKHGCSMHYLLQKSWYDICLAFLVEAKWHHGNYRPSIQKYLENGWVSSSAPLLLLHAFSMLDSVVNMSTISPLQTKLRLVQHVSLIXRLCNDSATHLDELGRGDAPSFIALHMIENGGNENDSRKAMQEHILKSWKVINEEAFDSCQYSMPFNKACIDLARISHCVYQGGDGFGTPNGLKKKQIRDLFLDPIDICNKQ

SEQ ID NO: 8000 - protein, 509 aa, Zea mays
  misc_feature (162)..(162): Xaa can be any naturally occurring amino acid
  misc_feature (188)..(188): Xaa can be any naturally occurring amino acid
  misc_feature (366)..(366): Xaa can be any naturally occurring amino acid
  misc_feature (377)..(377): Xaa can be any naturally occurring amino acid
  misc_feature (430)..(430): Xaa can be any naturally occurring amino acid
  misc_feature (469)..(469): Xaa can be any naturally occurring amino acid
MATANGSSKGSFEVPKVEVRFTKLFIDGKFVDAVSGKTFETRDPRTGEVIASIAEGDKADVDLAVKAAREAFDNGPWPRMTGYERGRILHRFADLIDGHVEELAALDTVDAGKLFAVGKARDIPGAAHLLRYYAGAADKVHGATLKMAQRMHGYTLKEPVGXVVGHIVPWNYPTTMFFFKVGPALAGXGAPVVVKPAEQTPLSALFYAHLAREAGVPAGVLNVVPGFGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKRXEGATLVTGGKXPCGDNKGYYIEPTIFTDVKDDMTIAQDEIFGPVMALMKFKTVEEVIQKANNTXRYGLAAGIVTKNIDVANTVSRSIRAGAIWINCYFAFDPXDAPFGGYKMSGFGKDMGMDALDKYLQTKTVVTPLYNTPWL

SEQ ID NO: 8001 - protein, 168 aa, Zea mays
  misc_feature (114)..(114): Xaa can be any naturally occurring amino acid
  misc_feature (123)..(123): Xaa can be any naturally occurring amino acid
  misc_feature (147)..(147): Xaa can be any naturally occurring amino acid
  misc_feature (152)..(152): Xaa can be any naturally occurring amino acid
  misc_feature (154)..(154): Xaa can be any naturally occurring amino acid
MLSYLDLLSGDELLSHSFTYKELENGVLWEVKEKWVTLGPVDAYIGVHPSADGDEDESVDDTAVKEIDIVDTFRLHEQPPFDKRIICLLHNEYIKNLTAAVEPEKAYEFQKDVXDATNFLLSXLNDLQFFVVESMNDEASVAFAYYXDGATXSXTFLYFSHELKEIKC

SEQ ID NO: 8002 - protein, 139 aa, Zea mays
AGKPLLRKLKDGRILKWDVRSENALCTLREVFEGVHRRVGFNVELKFDDDLFYTEERLTCILKSVLKACGVARPKSPEQILSVVFEHANDRPIIFSSFQPDAAQLIRKLQDKYPVLFLTNGGTQVYADPRRNSLEEAVK

SEQ ID NO: 8003 - protein, 85 aa, Zea mays
GCGVALLLTLARSEVEEVHETAAGALWNLAFYSGNALRIVEEGGVPVLVKICSSSRSKMARFMSALALAYMFDGRYHFCYFFLVA

SEQ ID NO: 8004 - protein, 200 aa, Zea mays
LIPRVLTRAQVTLGNILKESGQEGIPVNKTWRLNERHYGSLTGLNKSETAAKYGEAQVQIWRRSFDTPPPPMEPDHPYYNTIVKDPRYAEGPSEAEFPMFESLKLTIARTLPYWNDVIIPQLKEGKSIIIAAHGNSLRGIVKHLDNLSDDAIMALNLPTGIPFVYELDENFKPVVSMKFLGDEETVRKAIESVAAQGKAK

SEQ ID NO: 8005 - protein, 89 aa, Zea mays
KLLHQLIIPGGTTGQLSEALGKLYGQSKQGASSDTVEPSKARGGAHENCITCIVPLRKGSDGTIKRFSTSGLDGKVVVWDLENHVSIAK

SEQ ID NO: 8006 - protein, 494 aa, Zea mays
MQVIYHAFSSSAYGARPTEQDPLIDMELLPLLTWLLLAHAMAYLAWMAAARRRQSRCYLLDYVCHKPREDRKLSTEAAGAVIQRNARLGLTDYRFLLRVIVRSGIGEETYAPRNILEGREDSPTLRDAVDEMDAFFDEAIAELFARTDVAPRDVDVLVFNVSMLSPAPSLSSRIARRYGLREDVAAYNLTGMGCSAGLIALDLARNALRTRPRALALVVSSESIAPNWYSGTDKSMMLANCLFRSGGSAVLVTNDPARRGRAKMELSCLVRANIGASDDAHTCAQQREDAEGRVGISLSKALPKAAVRAFAVNLRRLAPRVLPVAELARFAARLLARRLFPHLQQHSSSGKHKGDTAAPPKINFKAGVDHFCLHPGGTAVIEAVKQSLGLEDEDVEAARMTLHRWGNTSASSLWYVLSYMEAKRRLKVGDRVLMVTFGSGFKCNSCVWEVTGDMADDRGAWADCIHAYPPERLANPYMDNFGWINNVDGDTLMF

SEQ ID NO: 8007 - protein, 428 aa, Zea mays
SRPAGVALSASATPPPPARSLLFPHFTLTRDVNTCSLVVDTVGEYHSGVGAKRNGRRKGKKGKKGKQDAPVTDFVPVKTQIRLDENTANNEAAGAAAEPVFVVGEAVNDSLPVVASESDFSRGKYLIYIGGGERCKSMNHFIWGFLCALGEAQFLNRTLVMDLNVCLNARYTSSGKDEERDFRLYFDFEHLKQSASVIDQSQFWQDWGQWHKKDRLKNFYTEDIRMTPMKLRDIKDTLIMRKFGNVEPDNYWSRVCEGETEGIIKRPWHFLWKSRRLMEIVSAIASRMNWDFDSVHVVRGEKAQNTQLWPNLDRDTSPDSLLMALNDKVGAGRYLYIATNEPDKSFFNPLKEKYKTHFLDDFKYLWDENSEWFTETKELSNGQPVEFDGYMRIAVDTEVFLRGKRHVETFNELTRDCKDGVNTCSASS

SEQ ID NO: 8008 - protein, 361 aa, Zea mays
MAWRANPKPSQAEGKRGCERGAPSHYPAAASPHTPPSRAQGFGMEADAAAKRTRESGEDATAAGISAVIPGWFSEISPMWPGEAHSLKVEKVLFQGKSDYQNVMVFQSSTYGKVLVLDGVIQVTERDECAYQEMITHLPLCSIKDPKKVLVIGGGDGGVLREVSRHSSVEQIDICEIDKMVVDVSKQFFPHLAVGFEDPRVSLHIGDGVAFLKNAPEGTYDAVIVDSSDPIGPAQELFEKPFFQLVARALRPGGVVCTQAESIWLHIHIIEDIVVNCRQVFKGSVNYAWTTVPTYPSGVIGFMLCSTEGPAVDFQHPVFNIEEDEHPMKSKGPLKFYNSEIHTASFCLPSFAKRVIESKAN

SEQ ID NO: 8009 - protein, 398 aa, Zea mays
  misc_feature (109)..(109): Xaa can be any naturally occurring amino acid
MMGWGRGRHGEGHTAPPTGHCQSWIHPPLPSLALARVPISISSLFFSRAHGDGPSNPGIAPQTTSGDGMAALLAGGEGEHKEVRGRLAAAYERHIAPAVKLDVCAREAXPAGQQAASRRASKAASEWTTGWWTQFAVLVQRGLKERRHESFNKLRVFQVLSVAALAGLLWWRTPASHLQDRTALVFFFSVFWGFFPLYNAVFTFPLERPMLLKERASGMYRLSSYVASRAATDLPMELGLPTAFVLILYWMGGLDPRPGPFLLSLAVVLYSVLVAQSLGLAIGAVLMDVKQGTTLASVITMVFLIAGGYYVQHIPPFVAWLRWLNYSFYCYRLLLGIQFPDGGGYYDCGHGALCPVAEFPAIKAVGLNNHWVDACVMALMLVGYRVVAYIALDRLKPR

SEQ ID NO: 8010 - protein, 347 aa, Zea mays
MREGIAPQTTSGDGMAALLAGGGGGEGEHKEVRGRLAAAYERHIAPAVKLDVCAREATPGGQQAASRRASKAASEWTTGWWTQFAVLVQRGLKERRHESFNKLRVFQVLSVAALAGLLWWRTPASHLQDRTALVFFFSVFWGFFPLYNAVFTFPLERPMLLKERASGMYRLSSYVASRAATDLPMELGLPTAFVLILYWMGGLDPRPGPFLLSLAVVLYSVLVAQSLGLAIGAVLMDVKQGTTLASVITMVFLIAGGYYVQHIPPFVAWLRWLNYSFYCYRLLLGIQFPDGGGYYDCGHGALCPVAEFPAIKAVGLNNHWVDACVMALMLVGYRVVAYIALDRLKPR

SEQ ID NO: 8011 - protein, 217 aa, Zea mays
MATVARTLVAACPARSLLRLRSRRLPSSSSICPARQRAGVGSVRCMARRPDSSYSPLRSGQGGDRAPTEMAPLFPGCDYEHWLIVMDKPGGEGATKQQMIDCYIQTLAQVLGSEEEAKKKIYNVSCERYFGFGCEIDEETSNKLEGLPGVLFVLPDSYVDAENKDYGAELFVNGEIVQRSPERQRRVEPVPQRAQDRPRYSDRTRYVKRRENQSYQR

SEQ ID NO: 8012 - protein, 503 aa, Zea mays
  misc_feature (132)..(132): Xaa can be any naturally occurring amino acid
MAQSQQMASRKPPGLRLFGGAGSLRTYQTLVLVLTFFAYACFHMTRKITSIVKSALDPQTKMGFSHWGRLHLHTSEAPALNTGWLPFNTADGSALLGEIDVAFLAAYSIGMFFAGHIGDRIDLMIFLTIGMXGTAVFTALFGAGYWLNVHSFYYFRVVQMVSGLFQSVGWPSVVAVVGNWFGKSKRGLIMGIWNAHTSVGNIAGSLLAAFLLKFGWGWSFAVPSLIMALVGLMVYVFLPVSPEAMEIDSDGGELNCEKDAVKEPLLEPGQEVKHSAVGFLEAWRIPGVAPFALCLFFSKLVAYTFLYWLPFYISHTRIGGEYLSDAMAGSLSTIFDVGGVLGGVLAGHISDRLNARAITAASFTYCAIPALFLYRTYGSMSMAWNVSLMFVTGMFVNGPYALITTAVSADLGTHSSLNGNSRALATVTAIIDGTGSVGAAIGPLVTGYVSSRSWSAVFTMLMAAALLAGLLLSKLVCAELQGKTHSSVSKDAGGEHGAYSDEV

SEQ ID NO: 8013 - protein, 505 aa, Zea mays
  misc_feature (126)..(126): Xaa can be any naturally occurring amino acid
  misc_feature (158)..(158): Xaa can be any naturally occurring amino acid
RPGILLPVCRNTLTTLRSTALSHVIPFDDNINLHKVIALSIAIATAIHTLAHVTCDFPRLISCPTDKFMATLGSNFHYKQPTYLGLLESTPGVTGILMIIIMSFSFTLATHSFRRSVVKLPSPLHXHLAGFNAFWYAHHLLVLAYVLLVVHSYFIFLXTREWYKKTTWMYLIVPVLFYACERVIRKFRENNYHAGIVRAAIYPGDVLSIHMKKPQGFKYKSGMYLFVKCPEVSPFEWHPFSITSAPGDDYLSVHIRTLGDWTSELRMLFGKACQAQVTSKKATLTRLETTVVADAQTEDTRFPKVYIDGPYGAPAQNYRKYDILLLIGLGIGATPFISILKDMLNNLKSNEEVESIHGSEIGSFKNNGPGRAYFYWVTREQGSFEWFKGVMNEVAGSDHSNVIEMHNYLTSVYEEGDARSALIAMVQSLQRAKNGVDIVSGSKIRTHFARPNWRKVFCDLASAHKNSRIGVFYCGSPTLTKQLKDLSKEFSQTTTTRFHFHKENF

SEQ ID NO: 8014 - protein, 418 aa, Zea mays
  misc_feature (407)..(407): Xaa can be any naturally occurring amino acid
MAQLKAARATDVPPAMPDPDPDVVAADLGACVRHGRVDGLAAGSGRAEATATATTTAAAADQGRRRPPLVVVGHRGKGMNALASPDPRLRGDIRENTLRAFNAAAASHPAVAYVEFDVQVTRDGCPVIFHDNFIYTQQDGQVSAKRVTELNLDEFLSYGPQRDQGKAGKPLLRKLKDGRILKWDVQSEDALCTLREVFEGVHRRVGFNVELKFDDDLFYTEERLTCILKSVLKVVFEHANDRPIIFSSFQPDAAQLIRKLQDKYPVLFLTNGGTQVYADPRRNSLEEAVKLCVAGGLQGIVSEVRAILRQPSAVAKIKEANKLSLMTYGQLNNVAEVVYVQHLMGVDGVIVDLVQEIAEAVSAFTVVTAVQASGSQDGGGIVVGERMETAAVAVAGTPSFSPREVSXFLLRLIPELVQ

SEQ ID NO: 8015 - protein, 403 aa, Zea mays
MLANVCRRRLTIPLSPILAAAAAAASGKNPIHSNHARALLSQSYYSSAVQAAPDREPCPTTVSYLVSCGVSPAVAAARKVRIRDTDRADAVRALLRKYGFSEADITRTVRLDPLLLTFDPDRTIRPKLDFFVSLGIQPRLLATEPHILARSLEKHIIPCIEFFRTILRTDDNIRIAVSRVPRALMTDIESTMRPAVEAFLSHGLSMEAIAKLLMIHMGMIKTPPERIREAFHDLKALGLRVTDTGFLYGFRVICSLRRETMVRKVAVFKSFGVSESDLFRAFKTQPTILLVGDETIKKKFRFFLDVMKLEIADVMAQPLTLALSLEKNIMPRCAVLSILMKEGKLKRTQKLIPPLLSNSRVFSERYVLRHAKDVPDVVKAFEGKIKFQGFGESEVRTSVPLND

SEQ ID NO: 8016 - protein, 143 aa, Zea mays
MEVFGKSVIAEPSNVIFLSAILNTEGSNPSHKCDKRCQNENIFGNMYRCKLTGTTHICDKNCNQRILYDNHNSLCRVSGQFFPLSPLEQQAVRGIRRKHEVDSNEGCSFKRRRGAQLHPSPFERSYSAVSPIPSQVGDGMDLS

SEQ ID NO: 8017 - protein, 767 aa, Zea mays
MVKFSKRFEGQLVPEWKDAFVDYWQLKKDVKKLQAAAGEAAVAAPARAPAHWAMRLPFFHPLGQPPAAIQACTATVTKYYVHVHRKLATDRSVDGAVAGEVYDTAVADGAGFADAEAAKAFFQRLDQQLNKVNRFYEREEREFLERGESLRRQLQILLELKAAVTQQQQARRGGSAADTDDPSVSWSIQLGGQSLRVIAEKEEECEEKLNGGDATAKISSGEGPVSQGLSESGRLCKPNEEMTRTLSGQGRSVRINIPVTTPSRTVTAIRELLFGDMPSQSKKTGAHGTDGSEKLSINKRKVHQAEKMIRGALVELYKGLGYLKTYRSLNMMAFVKILKKFDKVTGKEVQQIYLKAVESSYYNSSDKAVRLMDDVEELFLRHFTEGDRRKAMVYLKPNQREESHCTTFFIGVSTGGFIALFIGYCIMARVAGMYTQQSNKVYMSTSYPVLSMFSLFFLHLFIYGCNIFMWRKTRINHTFIFEFTPTKELKYRDVFLICTASMTIVVGAMFAHLAIIVKGNSSGVVQAIPGSLLLVVMVDFFMADQLCSQVPLLRSLEYLACYYITGSYMTQDYGYCTRVKNFRDLAYAVSFLPYYWRAMQCARRWFDEGDINHIVNLGKYVSAMLAAGTKVAYENNNSTGWMSLVIIVSSIATIYQLYWDFVKDWGLLQFNSKNAWLRNDLILKQKYIYFVSMGLNLVLRLAWLQTVIHPNIGSLDSRVTLFFLAALEVIRRGHWNFYRLENEHLNNAGKFRAVKVVPLPFQEVEEE

SEQ ID NO: 8018 - protein, 354 aa, Zea mays
MFVIHKYNSTTERMQKKKKKKKKKKKKKEVFKPKTMEPVRKSVCVTGAGGFVASELVKLLLSRGQYAVRGTVRDPGASKNAHLKVLEGAEERLQLLKADLMDYNSIASAVAGCEGVFHVASPVLSHRPSNPEVEVIAPAVIGTTNVLKACYEAKVRRVVVVSSCGAVYANPIYPKGKVFDEDCWSDEDYCRKKEDWYLVSKTLSEREALAFAAKTGLDVVTVCPSLVFGPLMQPTVNLSSEMILKYFKDLETVENVLSNMVDIRDVADALLLTYEKPEASGRYICSSHAIKISDMINILKTMYPSYPYPKNFVEDDVNSVYSSEKLQKLGWTFKPIEESLRDTVESYKAFGILN

SEQ ID NO: 8019 - protein, 722 aa, Zea mays
MDDESKSAPKSDVNTDAGAEAAAAAAPLPPSSSETAETEARVEAADGESQVVERLVELVSEIAAISDFRNSYRRQFCNLSRRIRLLVPMLEEAKEAPTPLTVASEAALRRLREALHAARDLLQLGSSGSKIFLVLDREKIMKTFQDVTASLEQALAGISFDELNISDEVREQVELVHTQFKRAKERSDSSDDDLFNELMSLCNSSSSDSVDPDTLRRLSEKLQLVTIYDLNHESLTLHEMASGGDPGAVVEKMSMLLKRIKDFVQTEDPEMGAQASTATISTNDNSACPVIPDDFRCPISLDLMKDPVIVATGQTYERGYIEMWLEAGHDTCPKTQQKLANKSLTPNYVLRSLITQWCEANGIEPPKRPAQLRDAPLSCSAAEHSNVLELLQKLSSQNLEDQRGSAGMLRQLAKRSAENRACIGDAGAIPILVSLLSTTDVSTQEHVVTALLNLSIYEENKARIISSGAVPGIVHVLKRGSMEARENSAATLFSLSIVDENKVTIGCSGAIPALVQLLSNGSQRGKKDAATALFNLCIYQGNKGKAVRAGLVPILLELLMETESGMVDEALAILAILSGHPEGKTAIGAASAIPVLVGVIRNGSPRNKENAAAVMVHLCSGEQQQQHLAEAQEQGIVSLLEELAESGTDRGKRKAVQLLERMNRFLKQQSQAEAEAEAMAQAHAHAQAQAQAQPQILVQAQAHADMQAERSLLPTSSDISDR

SEQ ID NO: 8020 - protein, 227 aa, Zea mays
  misc_feature (124)..(124): Xaa can be any naturally occurring amino acid
SHPLNDGGGACGYGDLDIFRYGRYTAGLSAALFGRGGACGGCYELRCVNHIQWCLRGSPTVVVTATDFCPANMGLADDDAGGWCNFPREHLELSEAAFLRVAKAKAGIVPVQFRSWHMDMVVAXRVSCDRAGGMRFTITGSAHFLQVLITNVAADGEVAAVKVKGSRTGWIPMGRNWGQNWQCDADLRAQPLSFEVTGGRGRTVTAYSVAPADWMFAQTFEGKQFAE

SEQ ID NO: 8021 - protein, 153 aa, Zea mays
SEEKLAACKALGADVCINYRTEDFVERIKQETNGKGVDVILDNIGGSYLQRNLNSLGADGRLFIIGFQGGIAAEVNLQAVLARRLTIQAAGLRNRSLANKAEIVSEVEKNVWPAVAAGKVKPVIYKTFPLSEAAEAHRLMEASTHIGKILLLP

SEQ ID NO: 8022 - protein, 228 aa, Zea mays
  misc_feature (61)..(61): Xaa can be any naturally occurring amino acid
  misc_feature (125)..(125): Xaa can be any naturally occurring amino acid
RGWFLHAGGGACGYGDLDIFRYGRYTTGLSAALFGRGGACGGCYELRCVNHIQWCLRGSPXVVVTATDFCPANMGLADDDAGGWCNFPREHLELSEAAFLRVAKAKAGIVPVQFRSWHMDMVVAXRVSCDRAGGMRFTITGSAHFLQVLITNVAADGEVAAVKVKGSRTGWIPMGRNWGQNWQCDADLRAQPLSFEVTGGRGRTVTAYSVAPADWMFAQTFEGKQFAE

SEQ ID NO: 8023 - protein, 161 aa, Zea mays
  misc_feature (98)..(98): Xaa can be any naturally occurring amino acid
MAAYKLVLIRHGESAWNLENRFSGWYDADLSPAGHEEAKRGGQALRDAGYEFDICFTSVQKRAIRTLWTVLDAIDQMWLPVVRTWRLNERHYGGLTGXHKAETAAKHGEAQVKIWRRSYDVPPPPMEPDHPFYSNISKDRRYADFTEDQLPSCESLKDTIA

SEQ ID NO: 8024 - protein, 170 aa, Zea mays
NLASSDSLTHLRPSAAPSPSAAPRRRRPVFLPPTSAVPLFFPRLCPNFCIRISHEVVTAMAATGGVSTDDIPILQAENLTSNVKSVHYSRTFLSIIGGVVAGIWGFTGLTGFVFYFLIMMVASIGLLAKSKFSVQTYFDSWTRISIEGVFGGLMSFVLFWTFAYDIVHIF

SEQ ID NO: 8025 - protein, 610 aa, Zea mays
SLKSSDVPNGLQGEHVVAGWPRWLTEVAAEAVRGWQPRRAESFEKLDKIGQGTYSSVYKARDLENGKIVALKKVRFANMDPESVRFMAREIHILRRLDHPNVIKLEGLVTSRMSSSLYLVFEYMEHDLAGLAATPGLKFSEPQVKCYMQQLLSGLDHCHNRGVLHRDIKGANLLLDNNGILKIADFGLATFFNPKQKQHLTSRVVTLWYRPPELLLGATNYGAAVDLWSAGCILAELLSGKPIMPGRTEVEQLHKIFKLCGSPSEEFWANLKLSRATIFKPQHPYRRCVNDVYKDFPTTALTLLDHLLAVEPGNRGTAASALDSEFFTTKPYACDPSSLPKYPPSKEYDAKLRDEEARRQRAAAKGQEAEAGRRKQPPAPDGNSGLQHRRVQVNSKNSTYKFTPKEDVSGFPIDPPARAAADNGYPQRVPLMQAGRSSSTLGRSSGMDPKAQRFHTSQIVTTEMSGQSTASGQRGNAPKMSNLGESARRQYLREHRSSSRYSQLTAADPSDRPEWNHQFQERPSSSHRKDDAVANKEHTVVNGTKKNRIHYSGPLMPPGVNMDEILREHERQIQQAVRRARLDKGKGKHSGERDQSESLLCTTGNLRADR

SEQ ID NO: 8026 - protein, 507 aa, Zea mays
MASPAPASPAAAAAHCPPPRIGLAGLATMGQNLALNIAEKGFPISVYNRTAAKVDSTLSRARDEGSLPVLGHRDPRGFVLSLARPRAVVLLVQAGPAVDATIQALSPYLEPGDAIVDGGNEWYQNTERRIEEAAARGLLYLGMGVSGGEEGARNGPSLMPGGSADAYANIRDILQKAAAQTEDGACVTFVGPGGAGNFVKMVHNGIEYGDMQLIAEAYDVLRRLGGLSNSEIADVFAEWNRGELESFLVQITADIFTVADPLDGSGSGGGALVDRILDKTGMKGTGKWTVQQAAELAVAAPTIAASLDGRYLSGLKDERVAAAGVLEEEGMPAGLLETVNVDKKVLVDRVRQALYASKICSYAQGMNLLRAKSVEKGWNLNLAELARIWKGGCIIRARFLDRIKSAYDRNRELANLIVDREFAREMVQRQNAWRWVVARAVEAGISTPGMTASLSYFDTYRSSRLPANLIQAQRDLFGAHTYERIDCPGSFHTEWTKLARRSNGAAI

SEQ ID NO: 8027 - protein, 430 aa, Zea mays
MDDAGRPPPHAPVAVTASASASATAAPAPPQPSATAAVDRSSPDPDALYEEGMWQQMAMDSGATMQPGSYPERPGEPDCTYYLRTGLCRFGMSCRFNHPPDRNLAIASARMKGEYPERAGQPECQYYLKTGTCKFGPTCKFHHPREKAGIAGRVQLNTSGYPLRPNEKECAYYLKTGHCKYANTCKFHHPELFNVVPSSRGSPIYTSVHSSASAGPQSYTGTMPSWAFPRASFIPSPRWQSPSNYAPMIVPQGLVQMQSWNSYTGQLQSPGAQQTYGSSQQGEASTGNQGMLSPYRPSSFPVPQYALQRENVFPERPDEPECQYYMKTGDCKFGAVCKFHHPRVRSLPPPDCVLSPMGLPLRPGEELCKFYSRYGICKFGANCKFDHPTVVAPMVYAYGFSASASPASASTNVPMARRLLGSPPGSGYTS

SEQ ID NO: 8028 - protein, 431 aa, Zea mays
  misc_feature (396)..(396): Xaa can be any naturally occurring amino acid
MDDAGRPPPHAPVAVTASASASATAAPAPPQPSATAAVDRSSPDPDALYEEGMWQQMAMDSGATMQPGSYPERPGEPDCTYYLRTGLCRFGMSCRFNHPPDRNLAIASARMKGEYPERAGQPECQYYLKTGTCKFGPTCKFHHPREKAGIAGRVQLNTSGYPLRPNEKECAYYLKTGHCKYANTCKFHHPELFNVVPSSRGSPIYTSVHSSASAGPQSYTGTMPSWTFPRASFIPSPRWQSPSNYAPMIVPHGLVQMPSWNSYTGQLQSPGAQQTYGSSQQGEASTGNQGMLSPYRSSSFPVPQYALQRDNVFPERPDEPECQYYMKTGDCKFGAVCKFHHPRVRSLPPPDCVLSPMGLPLRPGEELCKFYSRYGICKFGANCKFDHPTVVAPMGXYAYGFSASASPASASTNVPMARRLLGSPPGSGYTS

SEQ ID NO: 8029 - protein, 946 aa, Zea mays
MHLKLWKPLSHCAALLLDKKNRPPRTPPAGAGAGSGGGRRLQESKLREALEEASEDGSLAKSRDAALLDGGDGGAEEGSVGRSRSLARLHAQRDFLRATALAAERAFQSPDALPVLEEALAKFLVMYPNYASASDVDRLRADEYPHLDKVCLDYCGFGLFSYLQSCNPADSSAAFTLSEITANLSNHALYGAAEKGTAEHDIKNRIMDYLNIPESEYCLVFTVSRGSAFRLLAECYPFGTNKRLLTMFDHESQSVNWMTQVARDKGAKAYSAWFKWPTLKICTTELRKLISTKKRRRKDSATGLFVFPVQSRVTGAKYSYQWMALAQQNHWHVLLDAGALGPKDMDSLGLSLFRPDFIITSFYRVFGADPTGFGCLLIKKSVMACLQSPSGGTGAGLVRIVPVFPQYLSDSVDGFDGVLDGLEDDNIIPIEEGSASNSHHAPQLPAFSGAYSSAQVREVIESEMDQDSSDRDGASTIYEESESVSVGEVMKSPVFSEDESSENSFWVDLGQSPLGSDHSEQSSKGKLGSPLPASWFSGRKSAKKASPKVPSKLSRSPIHDNHVMSFDAAVRSVSQEPGPEKGDPDEDNSHINIKNTPISEIEEDNKDAKVNKRFVKFSCANDTAEGEGNATSVFGSCTARENGSTSEICSESQGETKDSAIRRENEGDFRLLGRREAYNGRFNGGRFFGVEESERVPSMGHNVSFTLDDSKLCRNADAGETSGYGMADDDDDDDDAYSDYDEAQDGRKEPEIVCRHLDHVNMLGLSKTTLRLRYLINWLVTSLLQLRLPDSGDGEGAAAAAAPPLVYIYGPKIKYDRGAAVAFNVKDCGSGTSLINPETVQKLAEKEGLSLGVGFLSHIRLTDSQRHGAADVGLSSSSSPAAASGRREKKSTRKNAVVGTEVVTASLGFLTNFEDVYRLWAFVAKFLDSSFLEQERLSSIPEDAER

SEQ ID NO: 8030 - protein, 942 aa, Zea mays
MHLKLWKPLSHCAALLLDKKNRPPRTPPAGAGAGSGGGRRLQESKLREALEEASEDGSLAKSRDAALLDGGDGGAEEGSVGRSRSLARLHAQRDFLRATALAAERAFQSPDALPVLEEALAKFLVMYPNYASASDVDRLRADEYPHLDKVCLDYCGFGLFSYLQSCNPADSSAAFTLSEITANLSNHALYGAAEKGTAEHDIKNRIMDYLNIPESEYCLVFTVSRGSAFRLLAECYPFGTNKRLLTMFDHESQSVNWMTQVARDKGAKAYSAWFKWPTLKICTTELRKLISTKKRRRKDSATGLFVFPVQSRVTGAKYSYQWMALAQQNHWHVLLDAGALGPKDMDSLGLSLFRPDFIITSFYRVFGADPTGFGCLLIKKSVMACLQSPSGGTGAGLVRIVPVFPQYLSDSVDGFDGVLDGLEDDNIIPIEEGSASNSHHASQLPAFSGAYSSAQVREVIESEMDQDSSDRDGASTIYEESESVSVGEVMKSPVFSEDESSENSFWVDLGQSPLGSDHSEQSSKGKLGSPLPASWFSGRKKASPKVPSKLSRSPVHDKHVLSFDAAVRSVSQEPGPVEVVPDEDHSRNGIKNIHISEIEEDNRDGKVNKRFVKFSCANGPAEGSATSVFGTCTARENGSTSEICSETQAETKESAIRRENEGDFRLLGRREAHNGRFNGGGRFFGVEEPERVSSMGRKVSFTMDDSRLCRNSDAGETSGYGMAADDQDDDDAYSDYDEAQDGRKEPEIVCRHLDHVNMLGLSKTTLRLRYLINWLVTSLLQLRLPDSGDGEGAAAAAAPALVYIYGPKIKYDRGAAVAFNVKDCGSGTSLINPETVQKLAEKEGLSLGVGFLSHIRLTDSQRHGAADVGLSSSSSPAAASGRREKKSTRKNAVVGTEVVTASLGFLTNFEDVYRLWAFVAKFLDSSFLEQERLSSIPEDAER

SEQ ID NO: 8031 - protein, 148 aa, Zea mays
  misc_feature (24)..(24): Xaa can be any naturally occurring amino acid
VTDKIFSNTTTISEYLISEDLPDXFSGPEGPFDVDVFDSSVNYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRN

SEQ ID NO: 8032 - protein, 590 aa, Zea mays
  misc_feature (174)..(174): Xaa can be any naturally occurring amino acid
MGLFTVTKKATTPFEGQKPGTSGLRKKVTVFQQPHYLQNFVQSTFNALPADQVKGATIVVSGDGRYFSKDAVQIITKMAAANGVRRVWVGQNSLMSTPAVSAVIRERVGADGSKATGAFILTASHNPGGPKEDFGIKYNMGNGGPAPESVTDKIFSNTTTISEYLISEDLPDVXIQCQPAKYFLCFFDSFSGPEGPFDVDVFDSSVNYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLAWLSIIAFKNKDNLGGDKLVTVEDIVRQHWATYGRHYYTRYDYENVDAGAAKELMANLVSMQSSLSDVNKLVKEIRSDVSEVVAADEFEYKDPVDGSVSKHQGIRYLFGDGSRLVFRLSGTGSVGATIRVYIEQYEKDSSKTGRDSQDALAPLVDVALKLSKMQEYTGRSAPTVIT

SEQ ID NO: 8033 - protein, 184 aa, Zea mays
EDGIWAVLAWLSIIAFKNKDNLGGDKLVSVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKIGRDSQDALAPLVDVALKLSKMQEYTGRSAPTVIT

SEQ ID NO: 8034 - protein, 218 aa, Zea mays
  misc_feature (6)..(6): Xaa can be any naturally occurring amino acid
GATGWXFFGNLMDAGMCSICGEESFGTGSDHIREKDGIWAVLAWLSIIAFKNKDNLGGDKLATVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKTGRDSQEALAPLVDVALKLSKMQEYTGRSAPTVIT

SEQ ID NO: 8035 - protein, 229 aa, Zea mays
MGKRWIPLEANPDVMNQFIWGLGVSERAVQFCDVYGLDDELIALVPHPVLAVLFLYPFTSLDEENKEESSVSAKSTAGGKDLSKKVYFTKQTIGNACGTIGVIHAIGNATSQIKLVEGSYFGKFYKQTADMDPVQRAAFLEEDDEMEDAHSIAASAGDTNINLDVNVHFVCFSCVDGELYELDGLKSQPTPHGPSSPETLLQDAAEVIKARIAENPNSMNFNVMALSKK

SEQ ID NO: 8036 - protein, 315 aa, Zea mays
  misc_feature (260)..(260): Xaa can be any naturally occurring amino acid
  misc_feature (280)..(280): Xaa can be any naturally occurring amino acid
  misc_feature (293)..(293): Xaa can be any naturally occurring amino acid
  misc_feature (300)..(300): Xaa can be any naturally occurring amino acid
  misc_feature (309)..(309): Xaa can be any naturally occurring amino acid
MVFSVTKKETKPYEGQKPGTSGLRKKVTVFQQPHYLANFVQSTFNALPADQVKGATIVVSGDGRYFSKDAVQIIAKMAAANGVRRVWVGQDSLLSTPAVSAIIRERISADGAKATGAFILTASHNPGGPTEDFGIKYNMGNGGPAPESVTDKIFSNTKTVTEYLIAEDLPNVDISVIGVTSFTGPEGPFDVDVFDSATDYIKLMKTIFDFESIKKLLASPKFSFCFDGLHGVAGAYAKRMFVDELGASESSLLNCVPKEXFGGGHPDPNLTYAKELVDRXMGLGKTSNVEPPXEFGAAAXDGDADRNMXLGKRFF

SEQ ID NO: 8037 - protein, 436 aa, Zea mays
MHPKLFPENHVSRPDGNGSASFHPLPLPPASVSPKQTNASHQLVPKAEMPSVAGQWQKGKLLGSGTFGCVYEATNRHTGALCAMKEVNIIPDDAKSVESLKQLEQEIKFLSQFKHENIVQYYGSETIEDRFYIYLEYVHPGSIHKYVHQHCGSLTEAVIRNFTRHILKGLAFLHSQKIMHRDIKGANLLVDINGVVKLADFGMAKHLSTAAPNLSLKGTPYWMAPEVVRATLDKSAGYDLAVDIWSLGCTIIEMFTGKPPWSGLEGPAAMFKVLRTDPPIPDNLSPEGKDFLRCCFKRNPTERPTANKLLEHPFIQTLNHYSPHSVVHSFSGIKSPDTVHSSARDKVPWKSDSYMRGKHANGETSSARSSESLAYRLMTPLPNLGTNSLSPPPLSSASSSGSAAHTPNSMHFSVPYHQPSPLPKPNGKEAINLVSH

SEQ ID NO: 8038 - protein, 611 aa, Zea mays
MVRQQTAPKVVRHYPSESTLFPYELFVTIFGRDELHPFGLHPLGIFCWLYVKVELRPFGLHNLGNSCYANAVLQCLMFTRPLTTYLLEGLHSKNCSQNGWCFMCEFEKLIVEGKRRKIALSPTGILSHLNDIGSSFGPGKQEDAHEFLRYAIDAMQSVCTKEARKGGVLRSAEETTLVQLIFGGYLRSKIKCSRCHVSSEQCEPMLDLTVEIDGDISSLDEALVRFTSTEALDGENKYHCSRCKSYERAKKKLTIEEAPNILTIALKRYQSGKFGKISKAIRFPETLNIVCYMNPDTDDISPVYSLYAVVVHHDVMNAAFSGHYVCYVKDTHGKWFKADDSQVKPVSLDNVMSKCAYMLLYARCSPRAPSSVRQAISDPARPKKAKQKVVPGGTTWRGGSFNRHQDGQRHSNHTADDLTHAFDEYRNAPYSPSDSPSPSESSSLFSNSDAGSHSTVSTDSSESTRNSTSTEEYEYVFGAADQMYPGGPMGGAPVESDQMYPGGPMGGAPVESDYSTYSRSRSSLNTSSSGRDAYSAASSADHKHQVVGSGGQVEGDESTSLLYTDRSNQQLSSKLTDQYRQLDGSGHDPGETRGGVLLRRPSRDRTAQTFY

SEQ ID NO: 8039 - protein, 91 aa, Zea mays
MAMAAGRGLLALFSVVVVAGLTSAANGPFLSDSVFQPSAGSTGRSLLQAKNSCPVNFEFQNYTIITSKCKGPKFPAGPCCAALKEFAKKRP

SEQ ID NO: 8040 - protein, 311 aa, Zea mays
MEALNVSWNGLLALVLNVEGRRKGKEEPRNPPHRRHRQAGQQIASSDFRRVSDQAAAISLSPHSGIPPPLAASPLVHRPPNARDRPVSVHPRGSWNINLWEINRYFSNPQYYFHVNDQYVRNKLKVILFPFFHRGHWTRISEPVGGRLSYKPPIYDINAPDLYIPFMAFGSFIILSGFTLGFMGKFTPEAINLQFTRALIGWGFQLTVLKGLLYSMGGGEVPLLDLVAYGGYLFAGLSLAVVARLMWAYSYYVMMPWMSLCMGVFLVRTMKRVLFTEMRSSERHSSRQHYFLLFMAIVQFPLFFWLGSIGV

SEQ ID NO: 8041 - protein, 270 aa, Zea mays
MGAMYNNYRNPPGTHMPPQNSQPVQFDNPLYGASSGLIRSGIGVYGEKFLGSSSEFMQSNINRYFSNPQYYFHVNDQYVRNKLKVILFPFFHRGHWTRISEPVGGRLSYKPPIYDINAPDLYIPFMAFGSFIILSGFTLGFMGKFTPEAINLQFTRALIGWGFQLTVPEGLLYSMGGGEVPLLDLVAYGGYLFAGLSLAVVARLVWAYSYYVMMPWMSLCMGVFLVRTMKRVLFTEMRSSERHSSRQHYFLLFMAIVQFPLFFWLGSIGV

SEQ ID NO: 8042 - protein, 360 aa, Zea mays
RVDHASVEALFGTAAANRKPKPSDKESGESSASLGRSNTPEQIFLLEPRKSHNISIILKSLTVGRDEIIDALRDGQTELGTDVLEKLSRLHISKEEESTILRFSGDPDRLAPTEAFLLRLLLDVPNPIARVNALLFKVNYGAEVAQLKHSLRTLELASQELRTKGLFFKLLEAVLKAGNRMNAGTARGNAQAFNLTALRKLSDVKSTDGSTTLLHFVVEEVVRSEGKRLAINRNYSIRRSGSLARSGHEGGSSAAGFASQGPSREERQSEYMNLGLPIVGGLSTEFANVKRAALVDYDAVVSECAILDGRLNEIKRLLETCSDDGFARGLRGFVRAAEQELKALRGEQERVLELVQKTTE

SEQ ID NO: 8043 - protein, 194 aa, Zea mays
  misc_feature (132)..(132): Xaa can be any naturally occurring amino acid
MAAAAGAGARAKAAGALALALVLALAGANSEGDALSALRRSLRDPGGVLQSWDPTLVNPCTWFHVTCDRDNRVTRLDLGNLNLSGHLVPELGKLEHLQYLELYKNSIQGTIPSELGNLKNLISLDLYKNNIXSGTIPPSLGKVKSLVFLRVNGNHLTGPIPRGTSGISRLKSGRGRSKDLCGTGSPIWALGAPL

SEQ ID NO: 8044 - protein, 216 aa, Zea mays
  misc_feature (198)..(198): Xaa can be any naturally occurring amino acid
MAAGAGARAKAAGALALALVLALAGANSEGDALSALRRSLRDPGGVLQSWDPTLVNPCTWFHVTCDRDNRVTRLDLGNLNLSGHLVPELGKLEHLQYLELYKNSIQGTIPSELGNLKNLISLDLYKNNISGTIPPSLGKLKSLVFLRLNGNHLTGPIPRELSGISSLKVVDVSSNDLCGTIPTSGPFEHIPLSNFEKXPRLEGPELQGLAIYDTNC

SEQ ID NO: 8045 - protein, 554 aa, Zea mays
  misc_feature (168)..(182): Xaa can be any naturally occurring amino acid
  misc_feature (417)..(424): Xaa can be any naturally occurring amino acid
  misc_feature (500)..(510): Xaa can be any naturally occurring amino acid
  misc_feature (550)..(550): Xaa can be any naturally occurring amino acid
MGNACGGALRSKHQHSFKHAASSQRHHASSEYSASAAADDSPRKPPPPPATTDAHAPPPPPATAMRRGGAGAPPDLGSVLGHPTPNLRDLYALGRKLGQGQFGTTFLCTELATGIDYACKSISKRKLITREDVDDVRREIQIMHHLSGHTNVVAIKGAYEDQLYVHIXXXXXXXXXXXXXXXQRGHYSERKAAALTRIIVGVVEACHSLGVMHRDLKPENFLLANRDDDLSLKAIDFGLSVFFKPGQVFTDVVGSPYYVAPEVLLKSYGPAADVWTAGVILYILLSGVPPFWAETQQGIFDAVLKGAIDFDSDPWPVISDSAKDLIRRMLNPRSAERLTAHEVLCHPWIRDHGVAPDRPLDPAVLSRIKQFSAMNKLKKMALRVIAESLSEEEIAGLKEMFQTMDTDNSGAITYDEXXXXXXXXGSTLKDTEIRDLMDAADIDNSGTIDYIEFIAATLHLNKLEREEHLVAAFSYFDKDGSGYITVDELQQACKEHNMPXXXXXXXXXXXDQDNDGRIDYGEFVAMMTKGNMGVGRRTMRNSLNISMRDXPGAF

SEQ ID NO: 8046 - protein, 510 aa, Zea mays
MMIARRLLRSNNAPAQASSLLKHVTGTASLQGYADSLLGATVRHFGSAPSAQPEENGFKGHGMLAPFTAGWQSNDLHPLIIERSEGSYVYDINGNKYLDSLAGLWCTALGGSEPRLVKAATEQLNKLPFYHSFWNRTTKPSLDLAQEILSMFTAREMGKVFFTNSGSEANDSQVKLVWYYNNALGRPNKKKFIARSKAYHGSTLISASLTGLPALHQKFDLPAPFVLHTDCPHYWRYHLPGETEEDFATRLATNLENLILKEGPETIAAFIAEPVMGAGGVIPPPKTYFDKVQAIVKKYDILFIADEVITAFGRLGTMFGCDYYNIKPDLVSLAKALSNAYVPIGATLVSPEISDVIHSQSNKLGSFAHGFTYSGHPVACAVAIEALKLYRERDIPGHVKQIAPKFQDGIRALADSPIIGEIRGLGMIMGTEFTNNKSPTDLFPAEWGVGAIFGEECQKRGMLVRVAGDAIMMSPTLIMTPGEVDELVRIYGEALKATEERVAALQSKKN

SEQ ID NO: 8047 - protein, 726 aa, Zea mays
MSAIMLCTCSGDQSKFEDLPRSPESLATRDFSANCSSSKMASRETTPDDSQVNEVESDLKETLSLNYEEARALLGRLEHQRGNFDAALQVLQGIDIRSLRPRMTTAIAESVKPRMPPRSSRRKSSQVNGMLMHMSMHSVSLLLEAILLKAKSLDTLGRAADAAEECRTIIDIIESAWPYGVPDGTSEECKLIDIFHSALEYLPKLWMRSGCFDEAIIAYRRALAKPWNLGSQRSAKLQKELAVSLLYCGVEVKFPQEFSQERNLVTPGNNLEEAILLLLMLTRKLFLREIQWDPDLVNHLVYALSLSGHYEVLASHLEMLLPGTYTRSERWYILALCYSAAGMDDSALNIIRNGFSVLERKGKPHVPSLLLGAKLCCKNPKHASEGIKFANKAMKSFRSRDLHFISTTKHFLGVCYGPFSRSSTSYLDKSRLQDNALRLLQDAATTAKYNPEIMYSLAWENAMQRKLNAAVESATECLEMVMGGSVSAWKLLILVLSAQQNLQEAEAVADFAMDEAEKNDQLDILRLKAQIQASRGQFKSAVETFRVLLAAIQVKKEVWKLTTCNEVKCLQKLEMDAWLDLASIYSKLEAWHDSNICLDKAISIDFYYPKCWHVRGLLLEAQFLHKEALMAFSFALSIDPDYVPGMVCMAGILRNIGGDSLSIARTYLRNALRLEPTNHRAWLSLGLVLKAEGSLQEAADCFQAAYELRELSPIQDFSEQLPIMLH

SEQ ID NO: 8048 - protein, 483 aa, Zea mays
  misc_feature (51)..(51): Xaa can be any naturally occurring amino acid
MALTRIGLAGLAVMGQNLALNIAEKGFPISVYNRTTSKVDETVQRAKAEGXTFPVYGFHDPASFVKSIQKPRVVIMLVKAGAPVDQTIATLAAHLEQGDCIIDGGNEWYENTERREKAMEERGLLYLGMGVSGGEEGARNGPSLMPGGSFEAYKYVEDIVLKVAAQVPDSGPCVTYIGKGGSGNFVKMVHNGIEYGDMQLISEAYDVLKSVGKLTNSELHQVFSEWNKGELLSFLIEITADIFGIKDEHGDGYLVDKVLDKTGMKGTGKWTVQQAAELSVAAPTIEASLDSRFLSGLKDERVEASKIFQGDYYSTGSPVDKAQLVEDVRQALYASKICSYAQGMNIIKAKSAEKGWGLNLGELARIWKGGCIIRAIFLDRIKKAYDRNPGLASLLVDPEFAQEIMDRQAAWRRVVCLAINNGVSTPGMSASLAYFDSYRRDRLPANLVQAQRDYFGAHTYERVDMPGSFHTEWFKIARNISNN

SEQ ID NO: 8049 - protein, 482 aa, Zea mays
MALTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMGVSGGEEGARNGPSLMPGGSFEAYKYVEDIVLKVAAQVPDSGPCVTYIGKGGSGNFVKMVHNGIEYGDMQLISEAYDVLKSVGKLTNSELHQVFSEWNKGELLSFLIEITADIFGIKDEHGDGYLVDKVLDKTGMKGTGKWTVQQAAELSVAAPTIEASLDSRFLSGLKDERVEASKIFQGDYYSTGSPVDKAQLVEDVRQALYASKICSYAQGMNIIKAKSAEKGWGLNLGELARIWKGGCIIRAIFLDRIKKAYDRNPGLASLLVDPEFAQEIMDRQAAWRRVVCLAINNGVSTPGMSASLAYFDSYRRDRLPANLVQAQRDYFGAHTYERVDMPGSFHTEWFKIARNISNN

SEQ ID NO: 8050 - protein, 503 aa, Zea mays
MGTRFQSFLLLFLLSCLIFISATSSEQKGDGTLRIGLKKRKLNRANRLASQLFLKNRGSWSSKGFFHLNDGNSDTVPPKNYLDAQYYGDITIGTPPQKFTAIFDTGSSNLWMPSSKCYLSVACYFHSKYTASESSTYKKNGKPASIRYGTGAISGYFSNDDVKIGDLVIKDQEFIEATNEPGITFLVAKFDGILGLGFKEIAVGNSTPVWYNMVEKGLVKEQIFSFWLNRNPQDQEGGEIVFGGVDPKHFKGEHTYVPVTRKGYWQFDMGDLHIAGKPTGYCSNGCSAIADSGTSLLTGPTSVITMINHAIGAVGVASKECKTVIGQYGKTMLNSLLSQADPRKVCSQIGLCGFNERMGIKSVLDDGTSDLINEAMCSVCEMATVWMQSELNQNETQERILSYAAELCDHIPSPNQQSAVNCEKVSSMPIVTFTIGGKPFDLSPQDYIFKIGDGVQSQCTSGFTAMDIPPPRGPLWILGDIFMGPYHTVFDYGKARVGFAKSA

SEQ ID NO: 8051 - protein, 188 aa, Zea mays
  misc_feature (73)..(73): Xaa can be any naturally occurring amino acid
PYSDPLADGPVIQASATRALAKGTTFEDVISMVKGVIPDLSCPVALFTYYNPILKRGVPNFMSIVKEAGVHGXLLTTPTTPNERMEKIAQASEGFIYLVSTVGVTGTRANVSGKVQSLLQDIKKVTEKPVAVGFGVSTPEHVRQIAGWGADGVIIGSAVMKTLEEAASPEEGLKKLEEFAKNLKAALP

SEQ ID NO: 8052 - protein, 682 aa, Zea mays
MDLARSGGAAAADDGGEIERHEPAPEDMESDPAAAREKELELERVQPWREQVTLRGVVAALLIGFMYSVIVMKIALTTGLVPTLNVSAALMAFLALRGWTRVLERLGVAHRPFTRQENCVIETCAVACYTIAFGGGFGSTLLGLDKKTYELAGASPANVPGSYKDPGFGWMAGFVAAISFAGLLSLIPLRKVLVIDYKLTYPSGTATAVLINGFHTKQGDKNARMQVRGFLKYFGLSFVWSFFQWFYTGGEVCGFVQFPTFGLKAWKQTFFFDFSLTYVGAGMICSHLVNISTLLGAILSWGILWPLISKQKGEWYPANIPESSMKSLYGYKAFLCIALIMGDGTYHFFKVFGVTVKSLHQRLSRKRATNRVANGGDEMAALDDLQRDEIFSDGSFPAWAAYAGYAALTVVSAVIIPHMFRQVKWYYVIVAYVLAPLLGFANSYGTGLTDINMAYNYGKIALFIFAAWAGRDNGVIAGLAGGTLVKQLVMASADLMHDFKTGHLTMTSPRSLLVAQFIGTAMGCVVAPLTFLLFYNAFDIGNPTGYWKAPYGLIYRNMAILGVEGFSVLPRHCLALSAGFFAFAFVFSVARDVLPRKYARFVPLPMAMAVPFLVGGSFAIDMCVGSLAVFVWEKVNRKEAVFMVPAVASGLICGDGIWTFPSSILALAKIKPPICMKFTPGS

SEQ ID NO: 8053 - protein, 169 aa, Zea mays
MVNTTAAMVSGGKGGVLPLASLNHISIVCKSVEESLDFYMNVLGFTPIRRPGSFDFDGAWLFNYGIGIHLLQSERPDSLPAKKEINPKDNHISFQCESMVAVERRLKELGIPYIQRCVEEGGIYVDQIFFHDPDGFMIEICNCDNLPVVPLADQTFAMAACKRVASVKQ

SEQ ID NO: 8054 - protein, 73 aa, Zea mays
MAVVRAPLGAVAVAALVVAIFMPAAAAAQAPAPAPTSDGTSIDLGIAYILMLVALVLTYLIHPLDASSPYKLF

SEQ ID NO: 8055 - protein, 528 aa, Zea mays
  misc_feature (491)..(491): Xaa can be any naturally occurring amino acid
  misc_feature (516)..(517): Xaa can be any naturally occurring amino acid
MAAGGGGSIADEKAPVAEAFGGHLEAAEMTEAEEEHSGGVKSRLSGLLWHGGSAYDAWFSCASNQVAQVLLTLPYSFAQLGMLSGVLFQLFYGLLGSWTAYLISILYLEYRTCREREKAADFRNHVIQWFEVLDGLLGRHWRNAGLAFNCTFLLFGSVIQLIGCASNIYYVNDRLDKRTWTYVFGACCATTVFIPSFHNYRVWSFLGLVMTTYTAWYMAVASLVHGQVEGVQHSGPTRIVLYFTGATNILYTFGGHAVTVEIMHAMWRPQKFKAIYLLATLYVLTLTLPSAAASYWAFGDELLTHSNALALLPRTPFRDAAVVLMLIHQFITFGFACTPLYFVWEKLIGLHDCRSLCKRAAARLPVVVPIWFLAIIFPFFGPINSAVGSLLVSFTVYIIPALAHMVTFRSPQSRENAVERPPRFAGGWTGAYVINSFVVAWVLVVGFGFGGWASITNFVQQVNTFGLFAKCYQCPPHLTAAPPAAFMPPPXHQWPRRPPCHRRRRRSMPPASSSLXXQPRFRLRLRRR

SEQ ID NO: 8056 - protein, 364 aa, Zea mays
MGSRVSGPYMDSPPPPRPPSPPRHPPHPQGERHGGGEMPYQDADHRLRALVGSVEGFGRHAIGGLYGAIHRVTSLQDDGPGSLREACRAEEPLWIVFEVSGTIHLHSYLRVSSYKTIDGRGQRVVLTGKGLQLKSCHHVIICNLVFEGGRGHDVDGIQVKPDSTNIWIDRCTLADYDDGLIDITRQSTDITVSRCHFMRHDKTMLIGADPTHVGDRCIRVTIHHCFFDGTRQRHPRLRFGKVHLYNNYTRSWGIYAVCAGVEAQIVSQCNIYEAGGGPPKKTTVFKYMPEKAGDREDVVAGSISSEGDAFLNGALPCLIDNPGSVFRPEEYYQQWTMEPASPALKDIIQLCAGWQPVPRPPYDR

SEQ ID NO: 8057 - protein, 367 aa, Zea mays
  misc_feature (84)..(84): Xaa can be any naturally occurring amino acid
MGSRVSGPYMDSPPPPPPRPPSPPRHPPHPQGERHVGGEMLYQDTDHRLRALVGSAEGFGRHAIGGLYGAIHRVTSLQDDGPGXVLREACRAEEPLWIVFEVSGTIHLHSYLRVSSYKTIDGRGQRVVLTGKGLRLKSCHHVIICNLVLEGGRGHDVDGIQVKPDSTNIWIDRCTLADYDDGLIDITRQSTDITVSRCHFMRHDKTMLIGADPTHVGDRCIRVTIHHCFFDGTRQRHPRLRFGKVHLYNNYTRSWGIYAVCAGVEAQIVSQCNIYEAGGGPPKKTTVFKYMPEKAGDREDVVAGSISSEGDAFLNGALPCLIDNPGSVFRPEEYYQQWTMEPASPALKDIIQLCAEWQPVPRPPDDR

SEQ ID NO: 8058 - protein, 192 aa, Zea mays
APRCWRWWPWSSWTRTRLPPSRSIQNSGQHFSTQEQTPQICVVGSGPAGFYTAQHLLKHHSRAHVDIYEKQLVPFGLVRFGVAPDHPEVKNVINTFTQTARSDRCAFYGNVEVGRDVTVQELRDAYHAVVLSYGAEDHQALDIPGEELPGVFSARAFVGWYNGLPENRELAPDLSCDTAVILGQGNVALDVA

SEQ ID NO: 8059 - protein, 205 aa, Zea mays
MIPPPPTQLHLLSASTCTHRAPNGGGMEAGGEEFAIGVVISAKTTLGEEFEGQIVAFDRPSNLLEGVGRAESGERRNVRVLKANYIREFSVLSKGDDPLDPAGCMLDLNSIYAREDAALRQAEIEAERIGVGVTPEAQNIFDALSKTLPVQWDKTDIVVMKEVRVRSPYLPENVSGGTAAANERVKKVIDFERKRLHSRAPGQFS

SEQ ID NO: 8060 - protein, 213 aa, Zea mays
  misc_feature (169)..(169): Xaa can be any naturally occurring amino acid
MEAGGEEFAIGVVLSAKTTLGEEFEGQIVAFDRPSNLLVIHILPKSLMLVTRISMFVCPCCCSVSLTGRSQEGVGRAESGERRNVRVLKANYIREFSVLSKGDDPLDPAGCMLDLNSIYAREDAALRQAEIEAERIGVGVTPEAQNIFDALSKTLPVQWDKTDIVVMKXEVRVRSPYLPENVSGGTAAANERVKKVIDFERKRLHSRAPGQFS

SEQ ID NO: 8061 - protein, 194 aa, Zea mays
  misc_feature (138)..(138): Xaa can be any naturally occurring amino acid
MPTKRSVGTLGDKDLSGKKVLLRADLNVPLDDGQRIADDNRIRASVPTIKFLMGKDARVVLASHLGRPKGVTPKYSLKPLVPRLSELLGVDVVMANDCIGEEVEKLAAALPDGGVLLLENVRFYKEEEKNDPEFAKKXLASVADLYVNDAFGTAHRAHASTEGVTKYLRAAVAGFFMQKELDFLLEQLPPEKAF

SEQ ID NO: 8062 - protein, 162 aa, Zea mays
  misc_feature (66)..(66): Xaa can be any naturally occurring amino acid
  misc_feature (85)..(85): Xaa can be any naturally occurring amino acid
  misc_feature (111)..(111): Xaa can be any naturally occurring amino acid
  misc_feature (120)..(120): Xaa can be any naturally occurring amino acid
MFSPYIGRILEVDWNRDYAFIEFDDPRDSDDDHYDLNGRLINVSRIITEFPKVDARGYAGSRDYMXTRPPPRTCHCFNCRMHAHXLRDCKDDDCSNKRYRYSESCHIERNXCHNSPRNLXRPYKSYSRSPSPRDGRDRSSQLQYEARTISDPDPHLDLSWVD

SEQ ID NO: 8063 - protein, 135 aa, Zea mays
MAAAAKIAPSMLSSDFANLASEAERMVRLGADWLHMDVMDGHFVPNLTIGAPVIESLRKHTKAYLDCHLMVTNPSDYVEAFGKAGASGFTFHIEVARDNWKELTQSIKAKGMRPGVSLKPGTPVEDVFPLVEAET

SEQ ID NO: 8064 - protein, 359 aa, Zea mays
DHEIHDRMKDMFWSPDKFVRAPGGSSSNVALALAAIGGRVAFMGKLGDDDYGQSLLYHLNINGVQTRAVYMDPSAPTAVSLMKVRTEGSLKTNCVKPCAEDRFLPSDINPAVLKEAKMFYYNSSALLEPTTESSLLKAIDVSKKFGGTIFFDLNLPLPLWSSSKETKSLIKEAWEAANIIEVTKQELEFLCGIKPSEKFDTNDNDKSKFTHYSSEVIMKLWHSNLKVLFVTNGTSKIHYYTETHNGWVRGTEDAPITPFTGDMSQSGDAIVAALMRMLVINPHLITDKVYLHKAVKHAIKCGVIDQWVLARERGFLPKERADPTGEQYEVRSITEREYRTLPDAMQSENSSTSELAYVE

SEQ ID NO: 8065 - protein, 411 aa, Zea mays
CRQWLRSIKKHAFVASPYPVIITLEDHLPSQLQEKVAKMVVEVFGNILYYPPDDTHELKELPSPEQLKGRVLLSTKPPKEYLETKLSDSTKEGDADLHLGKGTGDDAVWGKEVPDFRTEIQSAEKDDENDDVDDEEEQKLQPHIAPQYKHLITIRAGKPKDSLADALKSDPEKVRRLSLSEQQLAKAAKDHATEIVRFTQRNILRIYPKGTRVTSSNYNPFVGWVHGAQMVAFNMQGYGRALWLMHGFYKANGGCGYVKKPDFLMQTEPQVFDPREPQPVKKTLKVKVYMGDGWRMDFKQTHFDQYSPPDFYTRVGIAGVPADSVMKKTNAIEDNWTPVWEKEFSFPLTVPELALLRVEVHEYDMSEKDDFGGQTVLPVSELRPGIRAVALFDRKGMKYNHVKLLMRFEFA

SEQ ID NO: 8066 - protein, 261 aa, Zea mays
MGAAPSSDDSSRAGDGRAVASSAASGTGTGSNSNQAQSKRAPPPHKFHEIVALAQEATTAGGGGGGGTAAAADLEDQACSTGVYLAGKTKKYWVDEKTRCNCFVLFARALSITWGDDPRYWIWHPVRETSDAEIVEAASLQNVCWLEVHGRLELSHLTPGCSYDVAFQVMLTEPAYGWSVPVNLRLRFPDGTVQARKEKLQGMPTEQWLELRAGEVKAPAQPGGAGRSGELEISLFEYDGGLWKKGLLIKGIKIVPKESDY

SEQ ID NO: 8067 - protein, 259 aa, Zea mays
MGAAPSSDDSSRAGDGRAVASSAASGTGTGSNSHQAQSKRAPPPHKFHEIVAQEATTAGGGGGGGTAAAADLEDQACSTGVYLAGKTKKYWVDEKTRCNCFVLFARALSITWGDDPRYWIWHPVRETNDAEIVEAASLQNVCWLEVHGRLELSHLTPGCSYDVAFQVMLTEPAYGWSVPVNLRLRFPDGTAQARKEKLQGRPTEQWLELRAGEVKAPAQPGGAGRSGELEISLFEYDGGLWKKGLLIKGIKIVPKESDY

SEQ ID NO: 8068 - protein, 432 aa, Zea mays
MDRIVGGKFKLGRKIGCGSFGEIYLATHVDTYEIVAVKIESSKTKHPQLFYEAKLYNTLQGGSGIANVKWCGVDGEENVLVIDLLGPSLEDLFCYCGRKFTLKTVLMLADQMITRIEFMHSKGYLHRDIKPDNFLMGLGRKANQVYIIDFGLAKRYRDSTTNRHIPYRENKSLTGTARYASCNTHLGIEQSRRDDLVSLGYVLLYFLRGSLPWQGLKAATKAQKYDKICEKKISTPIEVLCKSCPVQFSSYFHYCHSLAFDQRPDYAFVKRLFRDLFISQDYEFDYVFDWTVLKYKQGHKQKQSPGAPIARPIQAHGPKQAGVNGVINHNEAQEHVETSRPTGQAAWSQDKQATNNDRNPDVRHTVNLRQDMAAGKAQLTTSVALPSSQWKNYSDSRHKGQFDAVHHNQGIVNITSSSNSWLPTFQHNAPGK

SEQ ID NO: 8069 - protein, 100 aa, Zea mays
  misc_feature (13)..(13): Xaa can be any naturally occurring amino acid
  misc_feature (33)..(33): Xaa can be any naturally occurring amino acid
KIKDWSNVVVAYXPVWAIGTGKVAPPAQVQEVXPPLRDWLKTNASPEVAEFTRIIYGGSVTAANCKELAAQPDVDGFFVGGASLKPEFIDIINAAPVKSA

SEQ ID NO: 8070 - protein, 98 aa, Zea mays
  misc_feature (22)..(22): Xaa can be any naturally occurring amino acid
  misc_feature (44)..(44): Xaa can be any naturally occurring amino acid
KDWSNVVVAYEPVWAIGTGKVXTPAQAQEVHASLRDWLKTNVSXEVAESTRIIYGGSVTAANCKEIAAQPDVDGFLVGGASLKPEFIDIINAATVKSA

SEQ ID NO: 8071 - protein, 107 aa, Zea mays
TRPAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 8072 - protein, 203 aa, Zea mays
RPTRPLRQEFHVAAQNCWVKKGGAFTGEVSAEMLVNLGVPWVILGHSERRALLGESNEFVGDKVAYALSQGLKVIACVGETLEQREAGSTMEVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 8073 - protein, 321 aa, Zea mays
MSWSVKGRRPHLPAGTWCSAACAPLPNQLNHAQEHCTTPARHRPRTKPTETEHPHPPGVELGTEEKKNTHTHTRVRVLSLPHPRAPPPPPPVPLPPPPPPGRLVAMAYRADDDYDYLFKVVLIGDSGVGKSNLLSRFTRNEFSLESKSTIGVEFATRSIHVEDKVVKAQIWDTAGQERYRAITSAYYRGAVGALVVYDVTRHVTFENVERWMRELRDHTDANIVMMLVGNKADLRHLRAVPTEDAKAFAERQNAFFMETSALEAMNVEDAFTEVLAQIYRVVSKKALDIGDDPAAPPRGHTINVGGKDDVSAVKKSACCSS

SEQ ID NO: 8074 - protein, 161 aa, Zea mays
MMEPGAPYFGAMGSSASGAGGGFYQPFNSNLAGAGSSTGIQSFPCVRLRGLPFDCNDIDVCKFFVGLDIVDCLLVNKNGRFTGEAFVVFPTAMQAEFALHRDRQNMGRRYVEVFRCKKHEYYCAIANEVNQGGYFEPEYRRSPPSPRPRKPSEDKGSMEYT

SEQ ID NO: 8075 - protein, 303 aa, Zea mays
MNTSPSRYRAMMGGWGGSDGYEGSKRTRMMMESNPYFAVNAGSPLDVSKRARMMEPGAPYFGAMGSSASGAGGGFYQPFNSNLAGAGSSTGIQSFPCVRLRGLPFDCNDIDVCKFFVGLDIVDCLLVNKNGRFTGEAFVVFPTSMQAEFALHRDRQNMGRRYVEVFRCKKHEYYCAIANEVNQGGYFEPEYRRSPPPPRPRKPSEDKGSMEYTEVLKLRGLPYSATTEDIIKFFLEYELAEENVHIAYRTDGKATGEAFVEFPTAEVAKTAMCKDKMTIGTRYVELFPSTPEEASRAKSRGRH

SEQ ID NO: 8076 - protein, 217 aa, Zea mays
MEYTEVLKLRGLPYSATTEDIIKFFLEYELAEENVHIAYRSDGKATGEAFVESISIFIFRECAWQRNRQNMGRRYVEVFRCKKQEYYSAIANEVSQGGYFESEYRRSSPPPRPPKKPAEDKGSMEYTEVLKLRGLPYSATTEDIIKFFLEYELTEENVHIAIRSDGKATGEAFVEFPTAEVAKTAMCKDKMTIGTRYVELFPSTPEEASRARTRGRH

SEQ ID NO: 8077 - protein, 251 aa, Zea mays
MMEPGAPYFGAMGSSASGAGGGFYQPFNSNLAGAGSSTGIQSFPCVRLRGLPFDCNDIDVCKFFVGLDIVDCLLVNKNGRFTGEAFVVFPTSMQAEFALHRDRQNMGRRYVEVFRCKKHEYYCAIANEVNQGGYFEPEYRRSPPPPRPRKPSEDKGSMEYTEVLKLRGLPYSATTEDIIKFFLEYELAEENVHIAYRTDGKATGEAFVEFPTAEVAKTAMCKDKMTIGTRYVELFPSTPEEASRAKSRGRH

SEQ ID NO: 8078 - protein, 218 aa, Zea mays
MEASLLVAPKPSIPRTIFSARRAGRSWRCLVVAATIKQQLGTRSESVDVDAPVEHLAPPSKATTGARGGLLAAVATTTSSCTAVLPCHALSGAGAVESGPWWWASSLDTLYRAAAVLGDLDPATARAVAGVAGPVLSAFGFLFILRIVMSWYPRLPVTEFPYVVAYAPTEPFLAVTRRVIPPLGGVDVTPVVWFGLVSFASKILVGPQGLLVLLSQQR

SEQ ID NO: 8079 - protein, 169 aa, Zea mays
  misc_feature (12)..(12): Xaa can be any naturally occurring amino acid
  misc_feature (65)..(65): Xaa can be any naturally occurring amino acid
  misc_feature (70)..(70): Xaa can be any naturally occurring amino acid
  misc_feature (80)..(80): Xaa can be any naturally occurring amino acid
  misc_feature (116)..(116): Xaa can be any naturally occurring amino acid
MLVHQDLLSDDXSSPDCFTYHDLENGVLRHGQGKWLTQGPVDVHIGANPSAEGGEDDRGDDTAGXVIDIXDTVPLYSERXPPFDKKSFVSYITRYIKNLTAVLEPQKAYEIKKAVXGATKFLLNKLKDLPFFVGESMKDEASAEFAYYKDGATNPTFLYFSHVLKEIKS

SEQ ID NO: 8080 - protein, 294 aa, Zea mays
MGKDDVVESGAGGGEFAAKDYTDPPPAPLVDAAELGSWSLYRAVIAEFIATLLFLYVTVATVIGYKHQTDASASASGAGADAACGGVGVLGIAWAFGGMIFVLVYCTAGISGGHINPAVTFGLFLARKVSLVRALLYMVAQCLGAVCGVGLVKAFQSAYFDRYGGGANSLASGYSRGAGLGAEIVGTFVLVYTVFSATDPKRNARDSHVPVLAPLPIGFAVFMVHLATIPVTGTGINPARSLGAVVVYNKDKPWDDHWIFWVGPLLGAAIAAFYHQYILRAGAIKALGSFRSNA

SEQ ID NO: 8081 - protein, 90 aa, Zea mays
  misc_feature (64)..(64): Xaa can be any naturally occurring amino acid
MPNVKSAGGAGASAIPAGGDGEVEAGFAKLQGEDFEYYMQTYSIMLGRNSKKSTVDVDLSSLGXGGMNISRHHARIFYDFQRRRFRARRH

SEQ ID NO: 8082 - protein, 244 aa, Zea mays
MGVAFSQYRMVADGEAASPAPAPVPPTGAAAASGGGTEKKKQADDSSSSSSTTTKWVPHKFSEIVGGASDAEPGEEVFRGIYLALPDQQQKTKKYWVDVSTKANCFMLFPRGFSITWSSDTRYWSWCNLTPEEKRGVDPEEAAMEVAYLKDVCWLEIRARLEMSHLTPGFTYVVAFVAKLEPNGYGWSEPVDRQIKCPGDIDGKPRQQRKESLWKTVDGKKWTDLNVGEVKAEAGQKGEMEIAM

SEQ ID NO: 8083 - protein, 317 aa, Zea mays
MGSGNLIVKKVVKHSSFDLDIQLDKSWMEDVTCPICLDYPHNAVLLRCTSYEKGCRPFVCDTDQTRSNCLERFKSAYELPSNAKVSSFAMPPLDSIIHIVPSNANNRPSCPLCRGDVIGWIVIGEARQHLNQKKRCCEEDCCSFVGNFNELQKHTQQKHPDSRPSEIDPARQVDWENFQQSSDIVDVLSTIHAQVPNGIVLGDYVIEYGDDDTGEDYEVFRRVRTNWWSCIFCRAFSRSSRSRRRTRARERIGSGRRNGNQVNLENFNLEVPTQSVELREIRFDEIDDEYIVTGAIPSIAAPGRMASFHYRDTRYGR

SEQ ID NO: 8084 - protein, 241 aa, Zea mays
TACSETVKFGHVIFFWNGNRSGYFDQNLEKYEEIPSDAGIPFNVQPKMKALEIAQKARDAILSQKFDQVRVNIANGDMVGHTGDMEATIVGCKAADEAVKVHVHGLVRQALRCDHLSIFPRVFPSYRLIQSVSCRSSSTPLSKWAGVFVVTADHGNAEDMAKRDESGEPLRDKDGKVQTLTSHTLNPVPIALGGPGLAPGVRFRTDLASAGLANVAATVMNLHGFEAPDHYEPTLIQVVDE

SEQ ID NO: 8085 - protein, 382 aa, Zea mays
LLLQGASERGAKRIRVHVLTDGRDVADGSSVRFVEMLEEDLARLREKGVDARIASGGGRMYVTMDRYENDWQVVKRGWDAHVLGEAPHRFRSALEALRKLREEDPKKASDQYLPPFVVVDGSGEPVGPVRDGDAVVTFNFRADRMVMLAKALEYEGFDRFDRVRFPRTRYAGMLQYDGELKLPRHYLVAPPEIQRTSGEYLARNGVRTYACSETVKFGHVTFFWNGNRSGYFDQNLEKYEEIPSDAGIPFNVQPKMKALEIAQKARDAILSQKFDQIILDAVEQVGGVFVVTADHGNAEDMAKRDKSGEPLRDKDGKVQTLTSHTLNPVPIAIGGPGLAPGVRFRTDLASAGLANVAATVMNLHGFQAPDHYEPTLIQVVDE

SEQ ID NO: 8086 - protein, 228 aa, Zea mays
  misc_feature (111)..(111): Xaa can be any naturally occurring amino acid
THSDNTCMSRATQPPSKRTSAAPVAAVAAAGPAHAQGEETSLWGSGAPCGACKFLRRRCVPGCVFAPHFGGSGGGGAGAAQFAAVHKVFGASNVAKMLSQVPLALCRDACXTVCYEAQARIADPVYGCVGTILALQHQVALVQAELTIAQTELLNRRMALATVHPAYSVVSPTSQMVNCSALSQTLDFIDTEPKCLPLPPPLLPSQQQRGEEHERGSPTDVFAHIPEK

SEQ ID NO: 8087 - protein, 139 aa, Zea mays
NVGLFYRLVENKKIKKDPQRLRTRGRTRGRTRGRTQCAGEMKKGLFGVMHYLMPKRGILSLHSGCNMGKDGDVALFFGLSGTGKTTLSTDHNRLLIGDDEHCWSDNGVSNIEGGCYAKCIDLAQEKEPDIWNAIKFGTV

SEQ ID NO: 8088 - protein, 145 aa, Zea mays
LRCFGAAFIMLHPTKYAAMLAEKMQKYGATGWLVNTGWSGGRYGVGKRIRLPYTRKIIDAIHSGELLTANYQKTEVFGLEIPTEINGVPSEILDPINTWTDKAAYKENLLRLGGLFKKNFEVFASYKIGDDSSLTDEILAAGPNF

SEQ ID NO: 8089 - protein, 359 aa, Zea mays
  misc_feature (263)..(263): Xaa can be any naturally occurring amino acid
MQSKHRVFAEDLLLAAAAEGEDHFDRVPDSLVLLIFNKLADARSLGRCSAVSRRFSALVPLVDDACLRIDRVIPADAADAGAPRPRAALSHLLKSVLLAVLKPFAHCDAKSASPQKHAQQQQQQHHSPAQVLRNFSSIRSLRMELPVSDVGTDDGVVLRWKAVFGSTLQSCVILGGTRVDRAGPPHAPSSGSAPPAGDDDGGSIPESLYTNGGLKLRVVWTISSLIAAATRHYLLREIVKEHPTLERVALTDAGGQGTLSMGXDQLREFRDRPLAAAPAAAANRTQVPACNMKLRYAPLLELSDGTRIHGATLVVIKPVGDAGGKDLDELGAGAFDGPLREAVAALGKRRAYLLEMNGF

SEQ ID NO: 8090 - protein, 204 aa, Zea mays
  misc_feature (67)..(67): Xaa can be any naturally occurring amino acid
SDVSGSDGEDTSWISWYCNLRGNEFFCEVDDDYIQDDFNLCGLSSQVPYYDYALDLILDIESSHVMXCVGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKLSQRYVPRVFGFKLHKP

SEQ ID NO: 8091 - protein, 192 aa, Zea mays
GEDTSWISWYCNLRGNEFFCEVDDDYIQDDFNLCGLSSQVPYYDYALDLILDIESSHGDMFTEEQNELVESAAEMLYGLIHARYILTSKGLAAMLEKYRNYDFGRCPRVYCCGQPCLPVGQSDIHRSSTVKIYCPKCEDIYYPRSKYQGNIDGAYFGTTFPHLFLMTYEHLKLQKPLQRYVPRVFGFKLHKP

SEQ ID NO: 8092 - protein, 490 aa, Zea mays
  misc_feature (97)..(97): Xaa can be any naturally occurring amino acid
MLRAAASRCARGAVRRLSSSAVMEASPVAVGSRWQSLLDEGDWSYHREWWGEEDGPGEGVQTVFRRHSECGNGVVSVSAYPASLPASEHWPAMERWXLQESNSRLYPESASSDQFKVLGYQWRVMRFNDHTRQSTAKVMTCYRTSGQRSLFLMQQPHVLAVPYVKSMVSAGLTALSCSSYDLPQAASGQNTMKILCIGHGGGSLPLFLASKFRGATIHIVEIDPVVVSASVESMGFPASPVKGLSPESMLPSDADDLLWGGIHDRIFLHTADAEDFIASDGNEYDIVFIDAYDGDDVFPRKLWDVDGAFMKSLEKRVHPVHGTVVVNLHSDSDSEAAEGNADFQSALPMGRHVSQVCRAYMQHFGVAFTAAVPWLCNITLVACRAGGMAGGARRGLSRRDLVLGKLLSKSDTVERALGLPFPCLPYIKNGFTMPTDIKDYACCTKEMAGNILQARVGAAVAVHKRLDYCDSGNRMREVMAAAAAGSGART

SEQ ID NO: 8093 - protein, 73 aa, Zea mays
MIEVVLNDRLGKKVRVKCNEDDTIGDLNKLVAAQTGTRPEKIRIQKWYNIYKDYITLKDYEVHDGMGLELYYN

SEQ ID NO: 8094 - protein, 579 aa, Zea mays
  misc_feature (177)..(177): Xaa can be any naturally occurring amino acid
  misc_feature (337)..(337): Xaa can be any naturally occurring amino acid
  misc_feature (362)..(362): Xaa can be any naturally occurring amino acid
MASISGAAAPPSSAVCRLRLRRHLLLRPSHLRLRAPHSIADLSRSSNSAPSPARPALGSGPENGSGGVRAVEKDPIKLWERYVEWLYQHKELGIFVDVSRMGFTEEFLRQMEPRMQQAFVDMRELEKGAIANPDEGRMVGHYWLRDPALAPNSFLRNKIETALDRILAFSQDVVSGXGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLVGAALMDEETRNTVVSHYXITRTTCSDGMIIYIVSCQTCLSFYXQVKANPAALLALCWYWASEGIGKKDMVVLPYKDSLLLLSRYLQQLVMESLGKEFDLDGNRVNQGLTVYGNKGSTDQHAYIQQLREGVQNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAMYGTSDLCSFCFSVK

SEQ ID NO: 8095 - protein, 90 aa, Zea mays
SARACSHSSAIFDFMIESGYTVCVFNISDLGFSAYLCYMAMYLIFVEFGIYCMHIQSHDIKPLYKHLYATHHIYNMANTLSPIAGLAFHP

SEQ ID NO: 8096 - protein, 113 aa, Zea mays
FHSYTFKLHVRGCFQGIDIKEMLVGAALMDEETRNTVVKANPAALLALCWYWASEGIGKKDMVVLPYKDSLLLLSRYLQQLVMESLGKEFDLDGNRVNQGLTVYGNKGSTDQH

SEQ ID NO: 8097 - protein, 304 aa, Zea mays
ICYIYDEDVSCFSGSKKIYLVCALGASKNAHLKELERAGERLQLLQADLLDYSSVASAIAGCEGVFHVACPVPSGRSSNPEVEVIGPAVVGTTNVLKACYEAKVKRVVVVSSVSAVFSNPNWPKDKVFDEDSWSDEDYCRKNEDWYYLSKTLSEREAFAFAAKSGLDVVTICPSLVFGPLMQSIVNTSSKVLLNYFKGDRETVENRLRNMVDVRDVADALVLAYENPEASGRYICSSHPLKVSDMINILKTLYPSYPYPKHFVETDGNITCSSEKLQKLGWTFRAIEETLRDSVESYKAFGILN

SEQ ID NO: 8098 - protein, 326 aa, Zea mays
MAHYQQGRRQQVDEYGNPVPGGHGVQGQQLGEAAGGYGVAGTGSYGGQQQAGYGPTGTGTHDAGGYGGSGHPGYGATGTGVHDAGGPGAYGAVTGTRAHGTHGGVTGIQDGAAGLTGGGLHGATGMGTTTGTGAHGATGMLDTGVLGGGGHAATGMPAGHGTRPGATGVAGTGGAFPHAAEHKTGGGILRRSGSSSSSSSSSSEDDGMGGRRKKGLKEKIKEKMPGGHREGQGQATATGAYGGTGYVAGPTTGGPHEKKGVVEKIKEKIPGGHKDYDQHQHTTAATGGGGGYGGTTDTTYGTTTTEGTHEKKGFMDKIKEKLPGQH

SEQ ID NO: 8099 - protein, 240 aa, Zea mays
  misc_feature (221)..(221): Xaa can be any naturally occurring amino acid
MASTSSIGDVGASDAKSRVEDVWKKMNGGFPNKMPKPAMTKLSSTATEKKNKPTNNWMTVLGLSPSKACNSSQGSKNGLKWTQHETREDAKKLAAKALAAAKNAAAVASGRGKVEITEVRDFAGKDIEIKKLVDPNSKEAIEKAKAAGAAPSAVDSILEQIRKKQKLSVLDKTKKDWGEYKEENRGLEEELDAYKKSSNQYLDKQSFLQRTDYREFERERXDARLSMMAKRRTDMREDDV

SEQ ID NO: 8100 - protein, 502 aa, Zea mays
MATTRIEAEKKPKTKIVCTLGPASRSVPMIEKLLRAGMNVARFNFSHGSHEYHQETLDNLRAAMENTGILCAVMLDTKGPEIRTGFLKDGKPIQLIQGNEITISTDYDLKGDEKTICMSYKKLPEDVKPGMVILCADGTISFTVLSCDKQAGLVQCRCENSATLGERKNVNLPGVIVDLPTLTDKDKEDILAWGIPNKIDMIALSFVRKGSDLVEVRKVLGKHAKNIMLMSKVENQEGVANFDEILANSDAFMVARGDLGMEIPIEKIFLAQKVMIYKCNIQGKPVVTATQMLESMIKSPRPTRAEATDVANAVLDGTDCVMLSGETAAGAYPDLAVQTMAKICIEAESTLDYGDVFKRIMEHSPVPMSPLESLASSAVRTANSARAALILVLTRGGSTAKLVAKYRPGMPILSVVVPELKTDSFDWACSDEAPARHSLIFRGLVPVLSAASARASHAETTEEAIEFAMQHAKSKGLCHNGDSVVALHRVGTASIIKILTVK

SEQ ID NO: 8101 - protein, 506 aa, Zea mays
  misc_feature (365)..(365): Xaa can be any naturally occurring amino acid
MAAEPPAYLLLLPLIAIPLIVFLVLSRRRDDQRRFPPAPWALPVIGHLHHLAGAPPHRALRDLARRHGPLMTLRFCELRVVVASSPDAAREILRTHDVDFASRPIGPMLQLVFRGAEGLIFAPYGDGWRQLRKICTLELLSARRVHSFRPVREDEVGRLLGSVASAAAAGLPVNLSERITAFVADAAVRAIIGSRSEHRDEFLRLLMDGLKIIPGLSLPDLFPSSRLAMLVSSVPGKIERRRKGLLDIVDPIILEHQEKRAAGGIDEDEDLLDVLLRLQKDMDSQYPLTTDNIKSVLIDMFGASSETSATTLKWTMAELMRNPAVMRKAQDEVRGALAGHDEVAEDSLVNLRYLQLVIKETLRPXLHPPAPLLLPRECRSPCQVLGYDVPRGTMVLVNAWAIGRDPALWDAPEDFVPERFEESGRDFKGMDFEFIPFGAGRRMCPGMAFGLAHIELALAALLFHFDWKLPEGVVAEEIDMAEAVAITAPPRSDLVVLPVTRLPVSI

SEQ ID NO: 8102 - protein, 204 aa, Zea mays
  misc_feature (40)..(40): Xaa can be any naturally occurring amino acid
  misc_feature (67)..(67): Xaa can be any naturally occurring amino acid
  misc_feature (96)..(96): Xaa can be any naturally occurring amino acid
  misc_feature (104)..(104): Xaa can be any naturally occurring amino acid
  misc_feature (112)..(112): Xaa can be any naturally occurring amino acid
  misc_feature (117)..(117): Xaa can be any naturally occurring amino acid
  misc_feature (132)..(132): Xaa can be any naturally occurring amino acid
  misc_feature (161)..(161): Xaa can be any naturally occurring amino acid
  misc_feature (166)..(166): Xaa can be any naturally occurring amino acid
  misc_feature (180)..(180): Xaa can be any naturally occurring amino acid
  misc_feature (185)..(185): Xaa can be any naturally occurring amino acid
WHTKRTVCTLLLSDLKRNKEDMHTYLNDPVDNAHNISDHXRIRASVPTMKILLKKMATDILASRLSXTKDGTPEYGLNPLVTHLSEILGDEGGMFXDRIGEETXTNIAALPXGSMLXLDNVIFYEEDEKNEXENAKNLASDADLNANDAFGTAHTARASTXGVTKXLKPADAGYRMQNEXDHLVXCVVHPKKPFAALAGASKGS

SEQ ID NO: 8103 - protein, 367 aa, Zea mays
MACNRGVKEQEDPSAASAAPAPAAVARARAARPPRPRSRKGLGVRHLLKPCRFLAAVQRANARVREAGEATLVAALAAAQKESERENEVVADVCGGWKSEDGSLNCGYSSIRGRRVNMEDFYDIKSSRVDDKQINFFGVFDGHGGTHAAGYLKQHLFENLLKHPAFIGDTKSAMSQSYKKTDADFLDTEGNIHVGVGSTASTAVLIGNHLYVANVGDSRAVLSKAGKAIALSDDHKPNRSDEQKRIEDAGGVVVWSGTWRVGGILAMSRAFGNRLLKQFVVADPEIQDLEIDGDTEFLILASDGLWDVVPNEHAVAFVKDEDSPEAAARKLTEIAFRRGSTDNITCIVVEFCHDKMVDGSPPSTNKS

SEQ ID NO: 8104 - protein, 183 aa, Zea mays
  misc_feature (140)..(140): Xaa can be any naturally occurring amino acid
  misc_feature (157)..(157): Xaa can be any naturally occurring amino acid
MNRVLACASSLLTCREVLQEQVSSTRSRLGMFVIEDKGGAIALMLASLLFLGTWPAVLTLLERRGRLPQHTYLDYSITNLLAAELIALTFGQLGDSRRGMPNFFTQLGQDNWPSVLFAMAGGVVLSVGNLSTQYAWAYVXLSVTEVISSSMVVVIGXEILFPGVACFLVAVIFGSAVHSSMQL

SEQ ID NO: 8105 - protein, 199 aa, Zea mays
  misc_feature (156)..(156): Xaa can be any naturally occurring amino acid
  misc_feature (189)..(189): Xaa can be any naturally occurring amino acid
AFRRRSRRWGLPVTRQRSSWCRPVPVGMATSSSASGGGAAGGAPGLKTYFKTPEGRHKLQYEKTHSPSVLHYNHSSGGKTVSEMTVAYLKEKPVGQGSTPSTPSSSSGMRSAAARLLGTGNGSRTLSFAGSNGVSRAVSGSSRVGWRRWYVNGASXGSQAVANYDGKGTYIIFNTADTLFISDLNSHEXDPVKSIHFQH

SEQ ID NO: 8106 - protein, 497 aa, Zea mays
MAGAAAVETAAAAAAAAAAANGKACCHAAKGPGYATPLEAMEKGPREKLVYVTCVYNGTGINKPDYLATVDLDPSSPTYSQVIHRLPVTHIGDELHHSGWNSCSSCHGDPSAKRRFLILPSLLSGRVYVVDTATDPRAPSLHKVVESEDIAENTGLGFPHTSHCLASGDIMISCLGDKEGNAAGNGFLLLDSEFNVKGRWEKPGHSPLFGYDFWYQPRHKTMISSSWGAPAAFRTGFDLQHVQDGLYGRHLHVYDWPGGELKQTLDLGDTGLLPLEVRFLHDPSKDTGYVGCALTSNMVRFFKTADGSWSHEVAISVKPLKVRNWILPEMPGLITDFVISLDDRYLYFVNWLHGDIRQYNIEDPAKPFLAGQVWVGGLLQKGSDVVYVTDDGQEQQYNVPQVKGHRLRGGPQMIQLSLDGKRIYVTNSLFSRWDEQFFGDDLVKKGSHMLQIDVDTEKGGLAVNPNFFVDFGTEPDGPALAHEMRYPGGDCTSDIWI

SEQ ID NO: 8107 - protein, 272 aa, Zea mays
MIKHSRPPKARDYDPKTDRDGTEAVERECEVGPAAAAGGMSLHADLLGDPVARIRHSPHYLMLVAETSGPDGRIVALVRGTVKSVASGKSRPGAPAFARVGYILGLRVAPSHRRMGIARQLVHRLEQWFELMGAEYAYMATDRSNEASLRLFTGRCGYSKFRTPSLLVHPVHSHRLRAPRRATVVRLGARDAERLYRSRLAHVEFFPADIGAVLGNALSRGTFLATVGGYEWGGVDRFLACPPASWAVASAWDCGGVFRLQVRGASRLRRAA

SEQ ID NO: 8108 - protein, 361 aa, Zea mays
MEVTPNHTLTVTGWAAMNESAGKVEPFVFKRRENGPDDVTIKVQYCGMCHTDLHFINNDWGITTYPLVPGHEITGVVTKAGRNVTGFRVGDRVGVGCIAASCLDCDRCRRSEENYCDRVALTYNGVFWDGSVTYGGYSRALVADKRFVVRVPDALPLDAAAPLLCAGVTVYSPMKHHGMLGHPGASLGVVGLGGLGHVAVKLAKAFGLRVTVVSTSPAKEAEARARLGADRFVVSTDDAQMRDAARSLDYVIDTVSAKHSLGPILDLLKVSGKLVLVAAPDQPVELPSFPLIFGKRTVSGSMTGGIRETQEMLDLCARHNITGDIELVSTDGINAALARLARNDVRYRFVIDIAGDSTSKL

SEQ ID NO: 8109 - protein, 378 aa, Zea mays
  misc_feature (156)..(156): Xaa can be any naturally occurring amino acid
MATLNPFELLGADDNDDPSLLIAAAAAAAQKAEAKKSAVAPAGKAAQPAATTKFPTKPAPPSQTVRDARGGGSSARGGFGRGERGRGRGGRGYGQNRGFSGDNGNEFQGGYGGGGYGDGAVTGGSEGERERDTRPPYRGGGRRGGYRNVEFGDDSXRPPRRNYERHSGTGHGYEMKRDGAGRGNWGTATDELIAQDAEDSPKMEEAAPVAEKQGEQIDAPAADENKDNKDATANEEEEKEEDKEMTLEEFEKIREEKRKALLALKAEERKVEVDKDLRSLQPLSNKKENDEVFIKLGSDKDKKKENAERDERAKKSVSINEFLKPAEGERYYGGRGRGRGRGDRGGFRGGYGGGYSRGPAAAAPSIEDQAQFPSLGGK

SEQ ID NO: 8110 - protein, 442 aa, Zea mays
FGSRCSSTLGFVDLSTNRLTGDLPSCLNGNLNNKVVKFDGNCFRVDPAHQHEDKYCQQSHNGRGSKKDVGLVVTVVGILFVILVLSLLLMASNKRSCQKVLAEQQIQQKHTQDNLLSGMSSELLVNARCISQAVKLGTQIQPSYHIFSLEELKEATKSFERSAFLGEGAIGKLYKGRLENATLIAIRCLPLHQRYSIRNLKLRLDLLAKLRHPNLVCLLGHCIDSAVDESTVKRVFLVYEYVPGGTLSSYLSACSPDKTLKWCDRLQVLIAIAKAVHFLHTGIIPGSLSNRLKSSSILVDEHHTAKLSDYGLSIITEEIYRHELLCSEMENLEDDVCSFGYILLEVLMGPKLNEKGGPFILKDLVVSMSTLEERDQVVDPVIIGTCSQDSLSIVVSIMIKCLSIECSARPSMEEVLWNLQYAAQVQTMADSDQRSEVSSQAC

SEQ ID NO: 8111 - protein, 428 aa, Zea mays
  misc_feature (306)..(306): Xaa can be any naturally occurring amino acid
SRPAGVALSASATPPPPARSLLFPHFTLTRDVNTCSLVVDTVGEYHSGVGAKRNGRRKGKKGKKGKQDAPVTDFVPVKTQIRLDENTANNEAAGAAAEPVFVVGEAVNDSLPVVASESDFSRGKYLIYIGGGERCKSMNHFIWGFLCALGEAQFLNRTLVMDLNVCLNARYTSSGKDEERDFRLYFDFEHLKQSASVIDQSQFWQDWGQWHKKDRLKNFYTEDIRMTPMKLRDIKDTLIMRKFGNVEPDNYWSRVCEGETEGIIKRPWHFLWKSRRLMEIVSAIASRMNWDFDSVHVVRGEKAQNXQLWPNLDRDTSPDSLLMALNDKVGAGRYLYIATNEPDKSFFNPLKEKYKTHFLDDFKYLWDENSEWFTETKELSNGQPVEFDGYMRIAVDTEVFLRGKRHVETFNELTRDCKDGVNTCSASS

SEQ ID NO: 8112 - protein, 618 aa, Zea mays
MGRGSCGCRHPLLAVLLPLLLVLAMVPESAQLQSSQTWSLLKIQQLLSYPPVLRTWGNGTDFCYGGDYKTASAFVECYGDSVTQLHIMGPGGAPPLPKTFNLDALFTTLTRLPDLRVLTLTGLGLWGPLPGKVSRLASLEIVNVSGNYLYGQLPEGLSRLGGLQTFIADDNMLSGELPGWLGRLASLAVLSLRNNSLQGAVPESVRDMGSLRSLALACNNLSGQVPDLSALTNLQAVDLSNNSLGPAFPRLGRKVASVVLSGNRFGNGVPAEEVASLYLLERLDVSRNRFVGPLPPALLALPSIEYLSVAGNRFTGLLAANMSCGENLRFVDVSSNLLTGTLPSCLKTLPSSSNSKQVTVLAASNCLSGGAGSTQHPALFCQNQALAVGIVPVQARGGGKAKGKAGAVAGAVAAALAAALLAGVAAFLFARRAAVRRAKARPPRRLVEHAASSMSVGGGGAYPSQLFADARYILQTVNLGALGVPAYRSFSLVELEAATNDFEVSRLMGQDAHGQMYRGTLGNGTVVTIRSLWVRRSQTSHAFNRHVEMISRLRHRHLESAVGHCFHCIPDDTTEARLALLFEYVHNGNLRSRISRECHPCSSRGRHCRRRSDVDHHT

SEQ ID NO: 8113 - protein, 133 aa, Zea mays
HACRLICEPCNMLFSALIISGGFGSYLFGMSDKIAKQATEAKDANNIKDPHLGWMIGFLFLVSFIGLFALVPLRKIMIVDYKLTYPSGTATAYLINGFHTPEGAKLAKKQVKTLGKYFMFSFFWGFFQWFYTA

SEQ ID NO: 8114 - protein, 114 aa, Zea mays
SGGFGSYLFGMSDKIAKQATEAKDANNIKDPHLGWMIGFLFLVSFIGLFALVPLRKIMIVDYKLTYPSGTATAYLINGFHTPEGAKLAKKQVKTLGKYFVFSFFWGFFQWFYTA

SEQ ID NO: 8115 - protein, 341 aa, Zea mays
SVPLPFPPLARRLHADPGDMPRYDDRYGGTRLYVGRLATRTRSRDLEHLFGRYGRIREVELKRDYAFIEFSDHRDADEARYQLDGRDVDGSRIVVEFAKGVPRGSGGSREYMGRGPPPGTGRCFNCGVDGHWARDCKAGDWKNKCYRCGERGHIERNCQNSPRSLRRERSYSRSPSPRRRRDRDDRRSRSPSYSRSPMRSASPPVKEKERSPAPDGSRSPRSRSPQDQVMSPPPKDNGEGNGSDRGGSPRGRENSRSCSRSRSPSGSNRSPAANGRSRSPGGERSPSPGGERSPSPRGERSPSPRADRSPSPNGNGNNDAAADVDADAAARSGSPTGSKSP

SEQ ID NO: 8116 - protein, 386 aa, Zea mays
PPPPPPLPKTLPTLFFPSLSFHLHSNGGPTRPAAAAAQKAETKKSAVAPAGKAAQPAATTKFPTKPAPPSQTVRDARGGGSSARGGFGRGERGRGRGGRGYGQNRGFSGDNGNDFQGGYGGGGYGDGAVTGGSEGERERDTRPPYRGGGRRGGYRNVEFADDSERPPRRNYERHSGTGHGYEMKRDGAGRGNWGTATDELIAQDAEDSPKMEEAAPVAEKQGEQNDAPAADENKGNKDATANEEEEKEEDKEMTLEEFEKIREEKRKALLALKAEERKVEVDKDLQSLQPLSNKKENDEVFIKLGSDKDKKKENAERDERAKKSVSINEFLKPAEGERYYGGRGRGRGRGERGGFRGGYGGGYSRGPAAAAPSIEDQAQFPSLGGK

SEQ ID NO: 8117 - protein, 159 aa, Zea mays
  misc_feature (110)..(110): Xaa can be any naturally occurring amino acid
LLVTAIVVGTVFLWKVEKLSLVDSFYCVCATITTLGYGDKSFSSQLGRTFAVFWIITSTIILALFFMYLAEIYTERRQKMLAKWVLTRRVTTMDLEAADLDSDRKVGAVXAEFVVYKLKELGKISQEDISSFLEEFDKLDIDQSGTLSTYDLTQAQSGQ

SEQ ID NO: 8118 - protein, 128 aa, Zea mays
MNPSSCLSFACEDLAMAAADELVCGEEPVARRRPKTTIACTLGPASRSAEMISRLLRAGMCVECFNFSYGSHEYHQEMLDKLHAAMQLTGILCDAMLDIKGPETTTGFLKDGKAIQSIVGQEITISTD

SEQ ID NO: 8119 - protein, 168 aa, Zea mays
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDAFKKNVESATKYLLSKLKDLQFFVGESMHDDGGVVFAYYKEGAADPTFLYFAHGLKEVKC

SEQ ID NO: 8120 - protein, 146 aa, Zea mays
MPMSRISGSLSSPKVDVAIDMGNPFLNLTLDGFWKIGTVAATRSVAEDTYHIIRKGNISSHDFKKMLKKMCKEGAYWGTVAGVYVGLEYGTERIRGTRDWKNAMIGGAVTGALASAASNNKKDKIAIDAITGAAVATAAEFINYLT

SEQ ID NO: 8121 - protein, 789 aa, Zea mays
MAQQLPCVSSPRPLLAVPAGRWRAGVRGRPNVAGLGRGRLSLHAAAARPVAEAVQAEEDDDDDDEEVAEERFALGGACRVLAGMPAPLGATALRGGVNFAVYSSGASAASLCLFAPGDLKADRVTEEVPLDPLLNRTGNVWHVFIHGDQLHGMLYGYRFDGVFAPERGQYYDVSNVVVDPYAKAVVSRGEYGVPAPGGSCWPQMAGMIPLPYNKFDWQGDLPLGYHQKDLVIYEMHLRGFTKHNSSKTKHPGTYIGAVSKLDHLKELGVNCIELMPCHEFNELEYFSSSSKMNFWGYSTINFFSPMARYSSSGIRDSGCGAINEFKAFVREAHKRGIEVIMDVVFNHTAEGNEKGPILSFRGIDNSTYYMLAPKGEFYNYSGCGNTFNCNHPVVREFIVDCLRYWVTEMHVDGFRFDLASILTRGCSLWDPVNVYGSPMEGDMITTGTPLVAPPLIDMISNDPILGNVKLIAEAWDAGGLYQVGQFPHWNVWSEWNGKYRDTVRQFIKGTDGFAGAFAECLCGSPQLYQAGGRKPWHSINFVCAHDGFTLADLVTYNSKYNLSNGEDNRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTKFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 8122 - protein, 444 aa, Zea mays
MATITVVKARQIFDSRGNPTVEVDIHTSNGVKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGQDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 8123 - protein, 763 aa, Zea mays
  misc_feature (303)..(303): Xaa can be any naturally occurring amino acid
  misc_feature (353)..(353): Xaa can be any naturally occurring amino acid
  misc_feature (366)..(366): Xaa can be any naturally occurring amino acid
  misc_feature (373)..(373): Xaa can be any naturally occurring amino acid
ARDHYLEHPNRKNPTQSTRDETSRAHPSVAFANPSLASFFSSSRGSNLRPPARRRRESPISPTPRSPRKRGQGTRIPQLPAISGTAMEVAAAAAGKPLTPEEEALRRSTDCVYFLASPLTCKKGNECDFRHSEGARMNPRDCWYWLNGSCLNPKCAFRHPPIDGLFGAPTSGLPPVSAHYGAYNLGKQMVPCYYFQKGNCLKGDRCPFYHGPQTASNDLAEQGAKVSSFIISLWMHPGSLRTMVISLRLGLQLKWMQKENKRQMTMTRERASPTTTRHLKAMTTNLKMKMCTKTTRISMITTXCSESRGFIALDAAVSFVMLLEKSSSIFCCRCLLGRGKALWPIIIDLLCSXVDQVVYITADDFXSDFVVLXDDEYVTTYFFARAHHESEQFNDGMGVNGRIGQYDGYERKRRRSSSERNLDRHYHPDGRFLHRELDRGEIDGSDLRHQLRRRRINGPSTTISPERANGDRHGRDEPYRERAHDGGHHTYRDRYQGPRGSNLSSRLQARIKLPRRSPDRVDTRFEDERDRRRFRDMFSPMRRMDFHGGRHQEAGHNQERGHRKLSELVSTVRHADGLSARRDAVGSTHFAARRNLGEPRKANGLVESEASLDFEGPKPLSVILQRKREAAQGNNYEKFAEVAVTQTGSLDETEKKSCDNVTRFADCKSGSGDEEYKEQDHILVDAHRQSSDHGDKFEAGYAAEVDAEGKQEADDYDQREGESDDYETFEGHDYKSEDENVYQDDEDFDDNDDFARKVGVLLP

SEQ ID NO: 8124 - protein, 146 aa, Zea mays
MDEKTQDKVEAAVLEILRGSDMESLTEYKVRTAAADRLGIDLDLPLHKRFVRRLVEDYLKSLAEEEDQKQKGGSRKEGKKKQQRQEEEEQEEDEEKEGEEEEEEEEDKGGEGKKEFDDNGDLILCRLSKNRRVTLQEFKGKTLVSI

SEQ ID NO: 8125 - protein, 128 aa, Zea mays
MAGGTVAHATLNGPIVVKEIFNGLTLGLIAGGISKIHDGSKTNYPRCPPSRRRRRRRKSPSSPARQMAGGRVAHATLKGPSVVKEIFIGLTLGLIAGGMWKMHHWNEQRKTRSFYDMLDKGQIVVVEE

SEQ ID NO: 8126 - protein, 255 aa, Zea mays
MPRYDERDRYGGNTRLYVGRLPSRTRTRDLEDLFGRYGRVRHVDMKHEFAFVEFSDPRDADEARYNLDGRDFDGSRMIVEFAKGVPRGQGGGGDRDRGRGGDREYMGRGPPPGSGRCFNCGIDGHWARDCKAGDWKNRCYRCGDSGHIERDCQNSPKNLKRGKSYSRSPSPRRGRVRDRSYSRSRSRSYSRSVSPRRDERRSRSPRDSRSPRRSPRDSRSPRRSPRDSRSPMKSPRGSRSPMRSPRDSRSPMRSA

SEQ ID NO: 8127 - protein, 167 aa, Zea mays
  misc_feature (110)..(110): Xaa can be any naturally occurring amino acid
MQHFVSFLKKKKKKKKKKKNKNKKKKKKKKKKKKKPCCPPATPKGSSSTPGGKMGANRKDGPPRNLMHKLPRRMKGSSKPNKGLNLIGPPGSGKETQPPIIKEENCLGHXTTGEMLRAAGPTKKPLGIKAKKAMKKGELVSKDLVGGIIDEAMKKPSCQKGFILEGF

SEQ ID NO: 8128 - protein, 419 aa, Zea mays
MELLPVEVVGNILSHLGVARDVMIASAVCRKWRDACRRHLRLLSFNSNDFPRDMTTRQLEIVITQTIFQTIGLQRLSIHIDNTHEFSAAPVIAWLMYTRETLRSLSYNVRTIPNVSILEKCGRQKLEVLDLELDHNTITGVEPSYQRFTCLKSLSLRHVSILALDLSLLVAACPRIESLALDVLEVVTSELQSTMELTSHTLKSLFAKSVGVDKIILDADNLEVLHLNALNLDLFELNGKGTLKHFKIDDVSVTHLDIGDNTDHLEAVDVSNFTIVWPKFYSMISRASNLRMLRFWGVVFDDEDEIVDSETIAVSFPLLRHLSLSYELRDGLLHYSLQGSSLLENVSVLELGWTVISEHFGPWVFGMIGRCPNLKKLVIHGVLSETKTREDRQMLASFTSFIVCVMRKYVHVDVQFEYE

SEQ ID NO: 8129 - protein, 252 aa, Zea mays
  misc_feature (222)..(222): Xaa can be any naturally occurring amino acid
  misc_feature (230)..(230): Xaa can be any naturally occurring amino acid
MATAGKVIKCKAAVAWEAGKPLSMEEVEVAPPQAMEVRVKILFTSLCHTDVYFWEAKGQTPMFPRIFGHEAGGIVESVGEGVTELAPGDHVLPVFTGECKECPHCKSAESNMCDLLRINTDRGVMIGDGKSRFSIDGKPIYHFVGTSTFSEYTVMHVGCVAKINPEAPLDKVCVLSCGISTGLGASINVAKPPKGSTVAIFGLGAVGLAAAEGARIAGASRXIIGVDLNXPSRFEEARKFGCTEFVNPKDHT

SEQ ID NO: 8130 - protein, 159 aa, Zea mays
MLFRTETESKDPEIDTLSFTELRDKLLALDPLDKDHVVKINKAEAEYWKKSEGYRMGWSDEILGFDCGGQQWVSENCFPTGTLAKPSMKDLDYIDKLLQLIEKEEIPAPGPIEQRWTARSKSPMSPASSSEEDDVFSWVINLFLSNSSYVFCMLICAAI

SEQ ID NO: 8131 - protein, 312 aa, Zea mays
MPRYDDRHGNTRLYVGRLAPRTRSRDLEYLFSKYGRIREVELKRDYAFIQEFSDPRDADDAQYNLDGREVDGSRIIVEFAKGVPRGSGGSREYMGRGPPPGTGRCFNCGMDGHWARDCKAGDWKNKCYRCGESGHIERNCQNSPRNLRREKSYSRSPSPRGGRGRSRSYSRSRSYSRSRSPSGSPRGGRRERDERRSRSLSYSRSASPRRSVSPAKEKERSRTPNGSRSPSPRAEVSPPLKDNGARNGSDHEGSPGGGENSKRSRSPSDGYRSPVANGRSPSPRDDRSPSPKGNNEDDERPGSPRGSQSPLN

SEQ ID NO: 8132 - protein, 358 aa, Zea mays
  misc_feature (280)..(280): Xaa can be any naturally occurring amino acid
SGRGTTSSLAPSAALMSTCGGGGRPRRGTNTLVVAAPATGEEAAPALSPNSVVEVNSEAEVPYRLAVDPRGDGVFCAFPNGCMLYRWESQEGEGPQRLALEPDQDALAELKDVGLQLAVSFSGEGSILAIGGEDGYLRVFNWPTMGSVLTEIDTKTSIKDLTISSDEKFLAVNRSSGPCRVWDLQSSEVVASLPRETGEIFGFCRFSNKADNSHVLFITVMEGDYGKIVSWNTTSWTRTGSKKITREAISAFAVSPNGALLAIGTIEGSIIVVGSKDMQXTLVTVKKTQLVFVTSLTFSQDSRTLLSTSFDSSARVTSVGSPKSNGTSIWPMLLVVILAILVYYCTQHKEDILAMLQR

SEQ ID NO: 8133 - protein, 389 aa, Zea mays
MDGGAGEEGKQERHLVLAHKLFLLSHPSVDDLSKVALRAEVLDTVKSDDMATLFESLVAGGVLEGDAALLAEMRGRIDEEIRKLDEKIADAEENLGESEVREAHLAKSLYFIRVGEKEKALEQLKVTEGKTVAVGQKMDLVFHTLQIGFFYMDFDLISKSIDKAKNLFEEGGDWERKNRLKVYEGLYCMATRNFKKAASLFLDSISTFTTYEIFPYDTFIFYTVLTSVITLDRVSLKQKVVDAPEILAVIGKVPHLSEFLNSLYNCQYKSFFVAFSGLTEQIKLDRYLQPHFRYYMREVRTVVYSQFLESYKSVTMEAMATAFGVTVDFIDQELSRFIAAGKLHCKIDKVAGVLETNRPDERNAFYQATIKQGDFLLNRIQKLSRVIDL

SEQ ID NO: 8134 - protein, 112 aa, Zea mays
ENFQAESLDGITGDKWDPVMLGGAESGDTIGVHGHGADMETGLRCQGGADAWEVQCVCGAQDDDGERMVACDACNVWHHTRCVGIADGAPVPPLFLCISCSGALMAAGPISG

SEQ ID NO: 8135 - protein, 561 aa, Zea mays
MSEGDATQLALEKGLPQVSNDDGSSSPATMHKLKVDTEDAGSKIESPTPEKLESRSKGVVVSSLARNLLAERYKDRFANQFLEDEGDIDDEDYNDSISPGMSRSQRSRSIELLEKHKDLLNLFNRMESSIRLLRLRKRMATFNNIATQVEILAKRKLSYCHLAQMKYLFPEAIQIKRVLLHDEKSLCMYADMEIILVMDVVEYTSPDHSPSMAICDAFYSKLLTFLDAHHKGTDIPEAILPEPFNLRSRGQLNLEASHNGHAAEPHLQGTTKDGFSNASHFPQSFRKLMSQKVITDGAERTQLLLDPTKLSSVSAYDTEGTNRSPKKQDKHASVTVNSEISATPSRHLISRCQEGTPKQETSESPLLAQTPATQTPKRQLPTPLEKLEATCGHISEPRSASSARRSLNTSLKFEGGSPSYHDRMEHVATSKIGIFSEDSSSFNKSLEENGPVFFTDREKINLADPVGVQEKMASLRSTFGIVCDISHSIKNSLITKQELFHNILANNLEIEQMGEIEEQLHILEDLAPDWISKVINGGEIFYSFETIADQNSVWERLVEAV

SEQ ID NO: 8136 - protein, 482 aa, Zea mays
  misc_feature (20)..(20): Xaa can be any naturally occurring amino acid
  misc_feature (103)..(103): Xaa can be any naturally occurring amino acid
  misc_feature (368)..(368): Xaa can be any naturally occurring amino acid
  misc_feature (456)..(456): Xaa can be any naturally occurring amino acid
MAGMAEETVRELRASFAGGXTRPAEWRAAQLKGLIRMIDEKEAEISAALHEDLAKPHMESFLHEISLTKSSCKFALKGLKNWMKPEKVPAAITTFPSSAQIVXSPLGVVLIISAWNYPFILSIDPVIGAIAAGNAVVLKPSEIAPATSSLLAKLLPEYVDNSCIKVVEGSVPETTALLEQRWDKIFYTGNGTVGRIVMAAAAKHLTPVALELGGKSPVIVDSNVDLHVAAKRIVVGKWGCNNGQACIAPDYIITTKSFAPELVASFKRVLERFYGEDPLQSADLSRIVNSKQFKRLTNLIEEKRVADKIVYGGKADEKQLKISPTLLLDVPEDSEIMTGEIFGPLLPIVTVEKIEESFDLINAKPKPXLAAYLFTKNRKLQEEFVASVPAGGMLVNDTALHLTNPYMPFGGVGDSGMGCYHGKFGFDCFSHKKGVLIRGFGGEANARYPPYTSGEXKILRGLINGSFIALILALLGFPREKR

SEQ ID NO: 8137 - protein, 173 aa, Zea mays
LYISTLTPRSLFFSRSGSAAVAATDVSGAGGKAKKGAAGRKAGGPTKKSVSRSSRAGLQFPVSRVGRYLKKGRYAQRVGTGAPVYLAAVLEYLAAEVLELAGNAARDNKKTRIIPRHVLLAIRNDEELGKLLAGVTIAHGGVLPNIHTVLLPKKVAEKAAKEPKKAAKSPKKA

SEQ ID NO: 8138 - protein, 200 aa, Zea mays
CAALEAAGSDTAGFISMMKKNSTLPVSNNGSPITEGVSFDDERRRDLFLKDQIPRSVAYGGYVAVAAISIGTLPQVFPQLKWYYILVAYIFAPVLAFCNAYGTGLTDWSLASTYAIVYRNMAILGVDGFSSLPKNCLTLCYIFFAAAIVVNLVRDLVPKKVARFIPLPMAMAIPFYLGSFFAIDMFIGTAILFAWETINK

SEQ ID NO: 8139 - protein, 486 aa, Zea mays
  misc_feature (215)..(215): Xaa can be any naturally occurring amino acid
  misc_feature (255)..(255): Xaa can be any naturally occurring amino acid
MRTLVTVKNLEAGRETEPFTAALLFSSPSSPPHALPSTVRRASPPAATATGPPISGTRRSSPSLLHAMAIRRGGSQSYGFPIYCAAWLPLAHILKPDRPAAEADADAPSPSPPPPPMVLLGGGGGKGRNGVPNKLVMAALAAGEEAAPALSPDTVIEVRTQEEVPYRMAVHPRGDGVFCAFPNGCKLYRWESQEGEGPQRLALEPDQEALAELKXIGLQLAVSFSGEGSILAIGGEDGHLRVFKWPAMGPVLTEXSDTKTSIKDLTISSDERFLAVNRSSGPCRVWDLQSSEVVASLPRETGEIFGFCRFSNKADNSHVLFITVMEGDYGKIVSWNTTSWTRTGSKKITREAISAFAVSPNGALLAIGTIEGSVVIVDSKDMRTLRNGTFYFPVPRSPPPSRVRPASPPPPTATRPPLSGTLRSSPSLLHAMAILRRRGQFSGFPISRPGSLPLAPSLQPDRPSDLADPGAPSPSPPPPAFLSQID

SEQ ID NO: 8140 - protein, 571 aa, Zea mays
  misc_feature (172)..(172): Xaa can be any naturally occurring amino acid
YLKDNWKNLWEALSYTSQALSQNLAGLRKRSPIRKISSTLNYYLEDNWKRVWVLAVWIGIMAGLFIWKFIQYRNRYVFDVMGYCVTTAKGAAETLKLNMALILLPVCRNTITWLRNTKAARALPFDDNINFHKTIAAAIVVGVVLHAGNHLVCDFPRLISSSEVKYAPLRQXFGENKPTYLDLVKVNAFWYSHHLFIIVYLALIVHGQFLYLIHVWYRKTTWMYLAVPVCLYVGERVLRFFRSGSYSVRLLKVAIYPGNVLTLQMSKPPAFRYKSGQYMFVQCPAVSPFEWHPFSITSAPGDDYLSIHVRQLGDWTRELKRVFAAACEPPVGGKSGLLRADETTKKALPKLLIDGPYGSPAQDYSKYDVLLLVGLGIGATPFISILKDLLNNIIKMEEEEEASTDLYPPVGPNKPHIDLSTLMTVTSRPKRVLRTTNAYFYWVTREQGSFDWFKGVMNEIAELDQRNIIEMHNYLTSVYEEGDARSALITMLQALNHAKNGVDIVSGTKVRTHFARPNWKKVLSKIASKHPFAKIGVFYCGAPVLAQELNKLCHEFNGKSTTKFEFHKEHF

SEQ ID NO: 8141 - protein, 496 aa, Zea mays
IRLERALPFDDNINFHKTIAAAIVVGVVLHAGNHLVCDFPRLISSSEVKYAPLRKYFGENKPTYLDLVKGVEGITGIIMVVCMLIAFTLATRWFRRSLVKLPRPFDKLTGFNAFWYSHHLFIIVYISLVIHGECLYLIHDWYKRTTWMYLAVPVGLYVGERTLRFFRSGSYSVRLLKVAIYPGNVLTLQMSKPPTFRYKSGQYMFVQCPAVSPFEWHPFSITSAPGDDYLSIHVRQLGDWTRELKRVFSAACEPPVGGKSGLLRADETTKKALPKLLIDGPYGSPAQDYSKYDVLLLVGLGIGATPFISILKDLLNNIIKMEEEEEASSDLYPPIGRSKAHVDLDTLMRITSKPKRVLKTTNAYFYWVTREQGSFDWFKGVMNEIAELDQRNIIEMHNYLTSVYEEGDARSALITMLQALNHAKNGVDIVSGTKVRTHFARPNFKKVLSKIATKHPYAKIGVFYCGAPVLAQELSKLCYEFNGKSTTKFEFHKEHF

SEQ ID NO: 8142 - protein, 185 aa, Zea mays
MDSEHWISRLAAAKRFYAAQLGHSDRAGMDELEMDEEVRPEFPCPYCYEDHDVGSLCAHLEEEHPFEPLSLLSRDLREAHLQVLLGGGGQRSSDNSSSSSATNISADPLLSSFGLGFPTSDAEQASKSTVSIPDDATTVKEAPAQARKLSIDSSLTSEERELKRKQARVRATFVQDLLLSTLFGD

SEQ ID NO: 8143 - protein, 229 aa, Zea mays
MDSEHWISRLAAAKRFYAAQLGHSDRAGMDELEMDEEVRPEFPCPYCYEDHDVGSLCAHLEEEHPFEPQAAACPVCSEMVTKDMVNHITTQHGYLFKNRRRLRRFIIPGSQALSLLSRDLREAHLQVLLGGGGQRSSDNSSSSSATNISADPLLSSFGLGFPTSDAEQASKSTVSIPDDATTVKEAPAQARKLSIDSSLTSEERELKRKQARVRATFVQDLLLSTLFGD

SEQ ID NO: 8144 - protein, 354 aa, Zea mays
MCVEEPKDAERFGFGDPGVEEPAKFPLAQMERVCENTTSADFRQKLSNFVPVIRSGDWSDIGGRQYMEDTHVCIPDLAKNFGFPSLDNEVVSFYGVFDGHGGKDAAHFVCDNLPRMIVEDSDFPLQLEKVVRRSFMQIDCQFAETCSLHRASSSGTTALTAMVFGRSLLVANAGDCRAVLSRCGTAVEMSMDHRPCSLSEKLRVESLGGYVDDGYLNGLLGVTRALGDWHLEGMKGAGETGGPLSADPELKMTTLTKDDEFLIIGSDGIWDVFSNQNSVDFARKRLQEHNDVKLCCREIVEEAIRRGATDNLTAVLVSFHLEAPPRIRVDRPGRVERSISAEGLNSLRILLGRQ

SEQ ID NO: 8145 - protein, 270 aa, Zea mays
  misc_feature (261)..(261): Xaa can be any naturally occurring amino acid
REKLRAIQEVDGPPSPSPPPPRVCVTGGGGFIASWLVKLLLSRGYAVHATLRDPSDPKNAHLMQLDGAAESLSLFKADVLDRAALAAAVAGCQGVFHVASPVPAEKIVDPESEVMVPAVKGTLNILEVCSSLKVQKVVVVSSTAAVHYDPNWPQGKPKDESCWSDRKVCKDNEIWYSLAKTVAEETVWEYAEKYRLNAVAVCPCIVLGPQLQCAVNTTSELLLYVITGGPNALNDVLWHIVDVRDVADALLLLYEKPESSXRYICAPNTL

SEQ ID NO: 8146 - protein, 317 aa, Zea mays
MGSGNLIVKKVVKHSSFDLDIQLDKSWMEDVTCPICLDYPHNAVLLRCTSYEKGCRPFVCDTDQTRSNCLERFKSAYELPSNVKVSSLAVPPLDSIIHIVPSNANNRPSCPLCRGDVIGWVVIGEARLHLNQKKRCCEEDCCSFVGNFNELQKHTQQKHPDSRPSEIDPARQVDWENFQQSSDIVDVLSTIHAQVPNGIVLGDYVIEYGDDDTGEDYEVFRRVRTNWWSCIFCRAFSRSSRSRRRSRARERIGSGRRNGNQVNLENFNLVVPTQPVELREIRFDEIDDEYIVTGAIPSIAAPGRMASFHYRDTRYGR

SEQ ID NO: 8147 - protein, 231 aa, Zea mays
MISPDAARNVVGIIGNVISFGLFLSPVLTFWRIYKAKDVEEFKPDPYLATLLNCMLWVFYGIPVVHPNSILVVTINGIGLVIEAVYLTIFFLYSDSQKRKKAFAILAVEILFMVAVVLGVILGAHTHEKRSMIVGILCVIFGSMMYASPLTIMSRVIKTKSVEYMPFLLSLVSFLNGCCWTAYALIRFDLYVTIPNALAFFDDAFHRVIGFDNVRQTQCVSFIAYKPPGSE

SEQ ID NO: 8148 - protein, 584 aa, Zea mays
MSAGSTASLLAAVICLALAVLAPVVPGDGATLESVPDLVKAMYLNVESFPCVRLLNLSGEIGCSNPGSEKVIAPIVRLRKGSDQLVQPSTILLSLDQMSDFFLRVSNDPELHQKVAGVLVESNGVNNDLQELSPDRKFPQDDFAPYSNHSHDWNPAGSGIMWNKYNFPVFLLSEESTNTLQKISEKNEKTGNGYKANVAEFDLVMQTTKAQTHDSASCLKEQSCLPLGGHSVWTSLPPLNNGSTEHPKPLILAIASQDSASFFRDRSLGSDSPISGLIALLTAVDALSHIHGLSKLKKQLVFAVFNGEAWGYLGSRKFLQELDEGAASVNGISSLKIDQVLEIGSVGKAILEEYPSFYVHAEGNPSASKEILDALQSASKSLGSDNVKVKQAASSNPGVPPSSLMSFIGKNTSTSGVVLEDFDSHFSNRFYHSYLDNPVNINSSSIAAAAALVARSLYILASDDSVVDLITLNTIKVNVSLVEELIGCLLTCNPGLSCGLVKRFISPSNPCPSHYVGVFLDDPSGTQFPSYADDTSRFVWNFLADRTNSAGNKSSCTGKCGDEGEVCVGAEVEGGGRCVVSTTR

SEQ ID NO: 8149 - protein, 226 aa, Zea mays
MDHEKVAPIDEKAPHGVSQPTVSSQEEYTGDWREQEDFMTRNGLNLKSFQRRPKGGELVVLDKSMKTRHLHMIAIGGSIGAGFFVGSGAALAKGGPASLLLDFSIMGVMIFNVVYALGELAVMYPVSGGFYTYSTRFIDPSWGFAMGWNYVFQWAIVLPLEINVAAITLEYWPGARNVHVAVWMLIFWLFIVIINVFGTLGYAEEKFWSSLLKLSATVIFMIIALV

SEQ ID NO: 8150 - protein, 587 aa, Zea mays
  misc_feature (195)..(195): Xaa can be any naturally occurring amino acid
MSSSDPDDAPDGGEDSPLFRRSGGPSSGGTVGDVPVSQSLIKAASNVCFSLFVLAVLVVTVVAVTYQPPDPWLQSSAAITTSLSRVLPNSTFLVPDDSLLPTGEDFNSSTAVPAPVRDDDDAAAAVSAASAAAAGNRTCDPDAPLNCSDPRVLAAVKAFNARAFFRKSIVFLSYEAPVSGPKPVFCHYHRYCDVXWRFRNRREKSWRRYRDYRRFSLASGDGCALDIVSVGKFRSGTNAARRPYPKGSKSKRPRVSPPPVDAEINDTIPADGAEAEFKKGKYLYYMRGGDHCKSMNQFVWSFLCGLGEAKFLNRTFVMDLNICLSGAHTVDGKDVDGKDFRYYFDFEHLKESVPVVEEGDFLKDWKRWDKKKGPGRITVRKVPSYKVTPMQLKRDKSNIIWRQFNGHEPENYWYRVCEGRAAKVIQRPWYAIWKSKRLMNIVTEIAGRMDWDYDGLHVVRGWKAQNKQMYPNLDSDTSPDALVDKVTKLVKPMRDLYIATNEPFYNYFDKLRSHFHVHLLDDYKELWSNTSEWYNETTTLSRGKPVPFDAYMRVIVDTEVFYRSKTQVETFNNLTRDCKDGINTCNL

SEQ ID NO: 8151 - protein, 162 aa, Zea mays
  misc_feature (141)..(141): Xaa can be any naturally occurring amino acid
  misc_feature (150)..(150): Xaa can be any naturally occurring amino acid
  misc_feature (159)..(159): Xaa can be any naturally occurring amino acid
VALAAAAAAGDQTPAPPKRPSIVLHAFLFLLAYLALGVTFYAAAPANFTSSAGPTHPVADALYFCIVTLCTIGYGDITPATPAAKLFSISFVLVGFGFVDILLSGMVSYVLDLQEHLLITALNNPTSARKHLHNYIFDIKXGRMRIRMKXALALGVVAXCVC

SEQ ID NO: 8152 - protein, 71 aa, Zea mays
MRFAGWYLKIAAVGASIGAAMELFMIHTGFYEKVTVLESEKRAWESSPEAQAMREALNPWHKHDEQEQQKK

SEQ ID NO: 8153 - protein, 212 aa, Zea mays
MSVTKFIKCVTVGDGAVGKTCMLICYTSNKFPTDYIPTVFDNFSANVSVDGSIVNLGLWDTAGQEDYSRLRPLSYRGADVFVLAFSLISRASYENVLKKWVPELRRFAPNVPVVLVGTKLDLRDHRAYLADHPGASAVTTAQGEELRKQIGAAAYIECSSKTQQNVKSVFDTAIKVVLQPPRRREAVPARKKNRRGSGCSIMNLVCGSTCAA

SEQ ID NO: 8154 - protein, 155 aa, Zea mays
  misc_feature (121)..(121): Xaa can be any naturally occurring amino acid
MDSEHWISRLAAAKRFYAAQLGHADRAGMDELDMDGDENAGRPDFACPYCYEDHDVASLVAHLEEDHPFEPHAAPCPVCSEKVSKDMLNHITMQHGYLFKNRRRLRRFAVPGSQSLSLLSXDLREAHLQVLLGGGGHRSSNNMPQIFQLILLCHH

SEQ ID NO: 8155 - protein, 193 aa, Zea mays
MDSEHWISRLAAAKRFYAAQLGHADRAGMDELDMDGDENAGRPDFACPYCYEDHDVASLVAHLEEDHPFEPHAAPCPICSEKVSKDMLNHITMQHGYLFKNRRRLRRFAVPGSQSLSLLSRDLREAHLQVLLGGGGHRSSNNNATNISADPLLSSFGLSFPTLDAEETSKLSTPAQSDVPVLKETAARVAVKY

SEQ ID NO: 8156 - protein, 209 aa, Zea mays
MDSEHWISRLAAAKRFYAAQLGHAGADRAGMDELDMDGDENAGRPDFACPYCYEDHDVASLIAHLEEDHPFEPHAAPCPICSEKVSKDMLNHITMQHGYLFKNRRRLRRFAVSGSQSLSLLSRDLREAHLQVLLGGGGHRSSNNNAANISADPLLSSFGLSFPTLDAEETSKLSTPAQSDVPVLKEAAARPWRSSMDSLLQGKKGSKPA

SEQ ID NO: 8157 - protein, 176 aa, Zea mays
  misc_feature (105)..(105): Xaa can be any naturally occurring amino acid
  misc_feature (116)..(116): Xaa can be any naturally occurring amino acid
MHASGAISYRKEKNKKDTAVAPFQGLKSTASLPIARRSSRSLGNVSNGGRIRCMQVWPAYGNKKFETLSYLPPLSTDDLLKQVDYLLRNGWIPCLEFSKVGFVYXENSTSPCYYDXPYWAMWKLPMFGCNDATQVYKELQEAIKSYPDAFHRVIGFDNIKQTQCVSFIAYKPPGSD

SEQ ID NO: 8158 - protein, 121 aa, Zea mays
  misc_feature (19)..(19): Xaa can be any naturally occurring amino acid
MPCLNVSTNVNLEGVDTSXILAEASKSVANIIGKPEAYVMVVFKGSGPMAFGGTQEPPASGELVSIGGLNPYVNKKLSAGIAFILESKLFVPKSRFFLKFYDSKAHPAQENAQCLHALHQK

SEQ ID NO: 8159 - protein, 170 aa, Zea mays
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCTDATQVYKELQEAIAAYPDAFHRVIGFDNVRQTQCVSFIAYKPPGSE

SEQ ID NO: 8160 - protein, 146 aa, Zea mays
MSEHLFEDTFVVTRLDPDGKKFDRVSRVEARSEQLDMYMQLDVATDVYPMHAGEKFNMVIAPTLNLDGTPDTGYYTQAGRKTLADNYEYVMQGKLYKISEDTSSSQNAKVEMYASFGGLLMLLRGDPSTAASFELDQRLFLLIRKV

SEQ ID NO: 8161 - protein, 181 aa, Zea mays
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 8162 - protein, 181 aa, Zea mays
  misc_feature (52)..(52): Xaa can be any naturally occurring amino acid
MASSMLSSATMVASPAQATMVAPFNGLKSSAAFPATRKANNDITSITSNGGXRVNCMQVWPPIGKKKFETLSYLPDLTDSELAKEVDYLIRNKWIPCVEFELEHGFVYREHGNSPGYCDGRYWTMWKLPLFGCTDSAQVLKEVEECKKEYPNAFIRIIGFDNTRQVQCISFIAYKPPSFTG

SEQ ID NO: 8163 - protein, 261 aa, Zea mays
  misc_feature (249)..(249): Xaa can be any naturally occurring amino acid
MARPEENAKFPSCDAYFDTIQSKKKLPLALQESQTAAFAQIPVASFPDVPSGRVTEIPGETSVLDAVRILSEHNIRAAPVLNPEPGAPADWQGRYLGIIEYSAIILWVLDNADLAAVALSAGSATAAGVGMGAVGAVGVAALGATGPAAVAGLTAAAVGAAVAGGLTAEKGVAKDGVTAADHLGEDFYKVLLQQEPFKSTTVRSIVESYPWSPFVPVTLDSSMLAVLLLLSKYRLRNVPVIEPDKPVIXKNFITQTGGVKG

SEQ ID NO: 8164 - protein, 178 aa, Zea mays
MDSGSDSDGAPEELTAVQGVEKHEEISQVEKDSAIRVTREGKERRKRWAQRRTSSKPDKKAPKEVVEDEGTKQSEETDTMPGMLPTSVIEILAAREKQTFASDSEEENVKQKVQKRKKRMKTAGPETILLKDVRSTQHVKNALDFLEQRKKQVPRSNAVLKNASKALRLLSSKGNFLS

SEQ ID NO: 8165 - protein, 244 aa, Zea mays
HASELLEDLQGRSGSYVETASLSHQHTRAKHWKPKFLSSEKKTIAILGDRSIDSEDPLEHVIDGTSSEEEDATQNHLSLVNKDENQQTMADLFQEVFNPTNMDGAMKSMRSTGAGNYGRMQQIMQMEKDWHVEFLRQYSREHSYSGDLKGTTVQILSRSLEGKLTVCSCMFQEKGNDATISNASADGTMDESRTRRTIIFSPKICNNVDLLVGNIIHIFPPWKEVKIQEEHVIICTYFSHHHRT

SEQ ID NO: 8166 - protein, 159 aa, Zea mays
MADLFQEVFNPTNMDGAMKSMTSTGAGNYGRIMQMEKYWHVEFFSIAESTVIQVVLLVAVGDLKGTTVQIMSRSLEGKLTVCSCMFQEKGNDATISNASADGTMDESRTRRTIIFSPKICNNVDLLVGNIIHIFPPWKEVKIQEEHVIICTYFSHHHRT

SEQ ID NO: 8167 - protein, 258 aa, Zea mays
  misc_feature (92)..(92): Xaa can be any naturally occurring amino acid
  misc_feature (152)..(152): Xaa can be any naturally occurring amino acid
DSARAPERCYPQPRRARPPPQPRRSRARPASTPRGADIAPSMLSSVFANLAFKVERMVRLCYDCLHMDFMNVHFVPNLTIGDTVIQSLRKHXTKAYLHCHLMVTKPSDYVEPFGKAGASGFTFHIEVARDNWQDLIQSIKSKGMRPGVSLSXGTPVEEVFPLVEAENPVELVLVTTVEPGFGGQKFMPEMMDKVRTLRKKYPSLDIEVDGGLGPSTIDVAASAGANCIVAGSSIFGAADPGAIISVLRKSVEGSQNKN

SEQ ID NO: 8168 - protein, 124 aa, Zea mays
MDVLLGSGRFLARRPPLALVPRCSRGSPDKSGSDKGETSADWDKAWSAFKKKGKRTLFSDFSPDKYVTWNPRRSEYPLSEEVDPIKRSERSNLMLWTSPQFTLVGAIIIVLTLLIYTLVVPPPK

SEQ ID NO: 8169 - protein, 199 aa, Zea mays
  misc_feature (38)..(38): Xaa can be any naturally occurring amino acid
  misc_feature (89)..(89): Xaa can be any naturally occurring amino acid
  misc_feature (166)..(166): Xaa can be any naturally occurring amino acid
LEAGRDRCSSVDVHLMIVEAGHIVPDFIKASAGIVSVXHCDATSTIHLSRIIPPITSLAGKARVVLNPATPLTDSDYAHDVVDLTLIIXVNPGIGGHSFIESRVSENCRTVYMLCAKNVVNSCIEADGGVAPINAYEVIETDTDAIDVGSADIENPDYAEVIIRIXTIQRPLAVGAYGAGRVLIYSVQGYQRCDLHTCV

SEQ ID NO: 8170 - protein, 507 aa, Zea mays
MDVYIYQALLLSVLAVALLQLVKMALKPRPRLPPGPWKLPVIGSMHHLVNVLPHRALRDLADVHGPLMMLQLGQTPLVVASSKETARAVLKTHDTNFATRPKLLAGEIVGYEWVDILFAPSGDYWRKLRQLCAAEILSPKRVLSFRHIREEEVMLRVEEIRAAGPSTPVNLSVMFHSITNSVVSRAAFGKKRKNAAEFLAATKAVVGLSSGFNIPDLFPAWTTVLAKLTGMTRSLKEIHKTVDTILEEIIEERKRIRDEKIMGGAAAEDVDENLVDVLIGLQEKGGFGFQLTNSIIKAIILDMFAGGTGTSGSAMEWGMSELMRNPPVMKKMQALIREAFRGKTVVTEGDLQASNLQYMKLVIKEALRLHPPAPLLVPRESIEECELDGYTIPAKSRVIINAWAIGRDPKYWNDADEFKPERFEDGSRDFTGSSYEFLPFGSGRRMCPDFNYGLASMELAFVGLLYHFDSSLPDGVKEVNMGEVPGLGVCRRTPLMLCATPFVPVPA

SEQ ID NO: 8171 - protein, 276 aa, Zea mays
MAPRKFFVGGNWKCNGTGDDVKKIVTFLNEAEVPSEDAVEVVVSPPFVFLQQAKGLLRPDFAVAAQNCWVRKGGAFTGEISAEMLVNLQVPWVILGHSERRALLNESNDFVADKVAYALAQGLKVIACIGETLEQREAGTTMEVVSAQTKAIAEKTSDWTNVVLAYEPVWAIGTGKVASPAQAQEVHDGLRKWLHANVGPAVAESTRIIYGGSVNGANCKELAAQPDLDGFLGLAALHSSPEFVVIIKSATVKSSSCLVVFEMHAVACRSGFCLSL

SEQ ID NO: 8172 - protein, 77 aa, Zea mays
  misc_feature (15)..(15): Xaa can be any naturally occurring amino acid
  misc_feature (21)..(21): Xaa can be any naturally occurring amino acid
  misc_feature (60)..(60): Xaa can be any naturally occurring amino acid
MDSEHWISRLDAANXAYNAAXPSNTAITPEMDELHRYQEFRADVPCPYCYEDHDVRSLRXNLEEDHPFERPAASCPV

SEQ ID NO: 8173 - protein, 194 aa, Zea mays
  misc_feature (78)..(78): Xaa can be any naturally occurring amino acid
MGKRWIPLEANPDVLNQFIWGLGVHEEDVQFCDVYGLDDELLAMVPQPVLAVLFLYPLTSLDEEKEESSVSAATSTSXGQVEGSYFEKFYKQTADMDPAQRAAFLEEDDEMEDAHSVAASAGDTDANVDVNEHFVCFSCVDGELYELDGLKSQPTPHGPSSPETLLQDAAEVIKARIAENPNSMNFNVMALSKK

SEQ ID NO: 8174 - protein, 704 aa, Zea mays
  misc_feature (253)..(253): Xaa can be any naturally occurring amino acid
  misc_feature (363)..(363): Xaa can be any naturally occurring amino acid
MRPSAAAAPLPPSSSEKAATGARVEAAVVESQVVERLVELVSEIAAVSDHLSNGVSSSCNLSRRIRLLVPMLEEAKEAPTPLTVASKAALRRLREALHAARDLLQLGSSGSKIFLVLDREKIMKTFQDVTARLEHALAAISFDELNISDEVREQVELVHTQFKRAKERSDSSDDDLFNELMSLCNSSSSDSVDPDTLRRLSEKLQLVTIYDLNHESLTLHEMASGGDPGAVVEKMSMLLKRIKDFVQTEDPEXRPQASTATISTNDNSACPVIPDDFRCPISLDLMKDPVIVATGQTYERGYIEMWLEAGHDTCPKTQQKLANKSLTPNYVLRSLITQWCEANGIEPPKRPAQLRDAPLSCSXAEHSNVLELLRRLARRPGEDQRGSAGMLRQLAKRSAENRACIGDAGAIPILVSLLSTTDVSTQEHVVTALLNLSIYEENKARIISSGAVPGIVHVLKRGSMEARENSAATLFSLSIVDENKVTIGCSGAIPALVQLLSNGSQRGKKDAATALFNLCIYQGNKGKAVRAGLVPILLELLMETESGMVDEALAILAILSGHPEGKTAIGAASAIPVLVGVIRNGSPRNKENAAAVMVHLCSGEQQQQHLAEAQEQGIVSLLEELAESGTDRGKRKAVQLLERMNRFLKQQSQAEAEAEAMAQAHAHAQAQAQAQPQILVQAQAHADMQAERSLLPTSSDISDR

SEQ ID NO: 8175 - protein, 515 aa, Zea mays
MANIDMAKILADLDRGASGGDARVPKTKLVCTLGPASRTVPMLEKLLRAGMNVARFNFSHGTHEYHQETLDNLRQAMHNTGILCAVMLDTKGPEIRTGFLKDGKPIKLTKGQEITVTTDYDIKGDENTIAMSYKKLPVDVKPGNVILCADGTISLAVLSCDPDAGTVRCRCENTAMLGERKNCNLPGIVVDLPTLTEKDKEDILGWGVPNDIDMIALSFVRKGSDLVTVRQVLGQHAKRIKLMSKVENQEGVVNFDEILRETDAFMVARGDLGMEIPVEKIFLAQKMMIYKCNIAGKPVVTATQMLESMIKSPRPTRAEATDVANAVLDGTDCVMLSGESAAGAYPEVAVKIMARICIEAESSLDHEAVFKAMIRSAPLPMSPLESLASSAVRTANKAKAALIVVLTRGGTTAKLVAKYRPRVPILSVVVPVLTTDSFDWTISSEGPARHSLIYRGLIPLLAEGSAKATDSESTEVILEAALKSAVQKQLCKPGDAIVALHRIGVASVIKICIVK

SEQ ID NO: 8176 - protein, 289 aa, Zea mays
CQSWLAKCNSVNLTLHFHLVENQEGVVNFDEILRETDAFMVARGDLGMEIPVEKIFLAQKMMIYKCNIAGKPVVTATQMLESMIKSPRPTRAEATDVANAVLDGTDCVMLSGESAAGAYPEVAVKIMARICIEAESSLDHEAVFKPMIRSALFPMSPLESLASSAVRTANKAKAALIVVLTRGGTTAKLVAKYRPRVPILSVVVPVLTTDSFDWTISSEGPARHSLIYRGLIPLLAEGSAKATDSESTEVILEAALKSAVQKQLCKPGDAIVALHRIGVASVIKICIVK

SEQ ID NO: 8177 - protein, 170 aa, Zea mays
  misc_feature (24)..(24): Xaa can be any naturally occurring amino acid
  misc_feature (54)..(54): Xaa can be any naturally occurring amino acid
  misc_feature (77)..(77): Xaa can be any naturally occurring amino acid
  misc_feature (100)..(100): Xaa can be any naturally occurring amino acid
  misc_feature (126)..(126): Xaa can be any naturally occurring amino acid
MSPYSDLLCALQLLAYSFIYQELXNALLRQVHPKRPTPRPADVHIGANPSAEAXHDKRADDTPAKACDIVDTFCLQXRNTPFDNNSFGSYINKYSHDISXAVLEPAQSGCSLKKGAQGATKSLLSXLKDLRFFVAESMNDDAPEVFAYYQDGATNPTFLYFSHGLNEIKS

SEQ ID NO: 8178 - protein, 250 aa, Zea mays
MGRKFFVGGNWKCNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAYALSQGLKVIACVGETLEQREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAATV

SEQ ID NO: 8179 - protein, 215 aa, Zea mays
  misc_feature (188)..(188): Xaa can be any naturally occurring amino acid
  misc_feature (202)..(202): Xaa can be any naturally occurring amino acid
MANIDMAKILADLDRGAGDARLPKTKLVCTLGPASRSVPMLEKLLRAGMNVARFNFSHGTHQYHQETLDSLRQAMHNTGILCAVMLDTKGPEIRTGFLKDGKPIKLTKGQEITVTTDYDIKGDENMIAMSYKKLPVDVKPGNVILCADGTISLAVLSCDPDAGTVRCRCENTAMLGERKNCNLPGIVXDLPTLTEKDKENFXGGGVPNDIDLMLY

SEQ ID NO: 8180 - protein, 295 aa, Zea mays
  misc_feature (190)..(190): Xaa can be any naturally occurring amino acid
  misc_feature (264)..(264): Xaa can be any naturally occurring amino acid
  misc_feature (285)..(285): Xaa can be any naturally occurring amino acid
RDASPPNLESHLAALRRSTPTPTPPPPLPPPIPRAGMNVARFNFSHGTHQYHQETLDSLRQAMHNTGILCAVMLDTKGPEIRTGFLKDGKPIKLTKGQEITVTTDYDIKGDENMIAMSYKKLPVDVKPGNVILCADGTISLAVLSCDPGAGTVRCRCENTAMLGERKNCNLPGIVVDLPTLTEKDKEDIXGWGVPNDIDMIALSFVRKGSDLVTVRQVLGQHAKRIKLMSKVKNQEGVVNFDEILRETDAFMVARGDLGMEIQXRRFSCAEMMIYSCTFAGKLVXLLPDARVDDQ

SEQ ID NO: 8181 - protein, 279 aa, Zea mays
  misc_feature (203)..(203): Xaa can be any naturally occurring amino acid
  misc_feature (229)..(229): Xaa can be any naturally occurring amino acid
  misc_feature (250)..(250): Xaa can be any naturally occurring amino acid
MANIDMAKILADLDRGAGDARLPKTKLVCTLGPASRSVPMLEKLLRAGMNVARFNFSHGTHQYHQETLDSLRQAMHNTGILCAVMLDTKGPEIRTGFLKDGKPIKLTKGQEITVTTDYDIKGDENMIAMSYKKLPVDVKPGNVILCADGTISLAVLSCDPDAGTVRCRCENTAMLGERKNCNLPGIVVDLPTLTEKDKEDILXGWGVPNDIDMIALSFVRKGSDLVTVXRQVLGQHAKRIKLMSKVENQXEGVVNFDEILRETDAFMVARGDLGMEIPV

SEQ ID NO: 8182 - protein, 406 aa, Zea mays
  misc_feature (237)..(237): Xaa can be any naturally occurring amino acid
  misc_feature (252)..(252): Xaa can be any naturally occurring amino acid
  misc_feature (275)..(275): Xaa can be any naturally occurring amino acid
MANIDMAAVLADMERDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLAVLSCDPAAGTVRCRCENTAMLGERKNCNLPGIVVDLPTLTEKDKEDILEWGVPNDIDMIALSFVRKGSDLVTVRQLLGQHAXKRIKLMSKVENQEGXVNFDDILRDSGPCIGARGDLGVXECCASTPGRKADDFKAALIVVLTRGGTTAKLVAKYRPRVPILSVVVPVLTTDSFDWTISSEGPARHSLIYRGLIPLLAEGSAKATDSESTEVILEAALKSAVQKQLCKPGDAIVAFHRIGVASVIKICIVK

SEQ ID NO: 8183 - protein, 262 aa, Zea mays
  misc_feature (203)..(203): Xaa can be any naturally occurring amino acid
  misc_feature (215)..(215): Xaa can be any naturally occurring amino acid
  misc_feature (232)..(232): Xaa can be any naturally occurring amino acid
  misc_feature (242)..(242): Xaa can be any naturally occurring amino acid
  misc_feature (252)..(252): Xaa can be any naturally occurring amino acid
MICSSLLRVSSRSAVRPSHSFSQSASNLPRICAINRWQRGYATEAKEHDLVIIGGGVAGYVAAIKAGQEGLKVACIEKRGMLGGTCLNVGCIPSKSLLNNSHMYHQILHDTKKRGIEVGDVKLNLQQMMAAKNTSVDGLTKGVEFLFKKNKVEYIRGTAAFSGEHEVTVNKTEGGETTLRAKNILIATGSEATPFPGLTIDEXRVVTSTGAISLXKVPKKMVVIGGGIIGLXEMGSVWSRLXAEVTVVEFLXIGGPGMDANI

SEQ ID NO: 8184 - protein, 542 aa, Zea mays
MAASARTTSSLPYLVAVSSPAAHRHGASHPIRASVGEATMDVVSEAELREKGFLGMRKTKLVCTVGPACVEALPALARGGMGVARINLCHGGREWHRAAMRSVRRLNEEGGFCVTLMVDTEGSQLLVADHGGATSVKAEDGSEWIFTNKKADEAHQFTMHVNFDKFSEGILVGDELVIDGGMATFEVTEKIGNDLRCKCTDPGLLLPRAKLSFWRNGKIVQRNFGLPTLSTKDWADIEFGIAEGVDCIALSFVNDANDIKQLKAYLSRRSLEHIKVFAKIESLESLKNLKDIIEASDGVMVARGDLGVQIPLEQIPAIQESIVKLCRHLNKPVIVASQLLESMVEYPTPTRAEVADVSEAVRQYADAVMLSAESAIGAYPQKALSVLRAASERMESWSREENMQKLLPRHQLAIALPDRISEQICSCAVEMANNLAVDAIFVYTKHGHMASLLSGNRPNPPIFAFTDNANSRKSMNLYWGVIPLHLPLSNSMEDNFNKTISLMRSKGSVKPGDTVLVVSDFDLNQPCAAPSVFQSIQVRLVE

SEQ ID NO: 8185 - protein, 166 aa, Zea mays
MASEHAAGGDAKHHQKQSLMDKAKGFVAEKIAHIPKPEATLDGVTFKGLSRECITLHSSVNVSNPYDHRLPICEVTYTLRCAGKEVASGTMPDPGWIAASGSTALEIPAKVPYDFLVSLVRDVGRDWDIDYELQVGLTVDLPIVGNFTIPLSTSGEFKLPTLKDLF

SEQ ID NO: 8186 - protein, 167 aa, Zea mays
  misc_feature (98)..(98): Xaa can be any naturally occurring amino acid
MASEHAAGGEAKHDQKQSLMDKAKGFVVEKIAHIPKPEATLDGVTFKGLSRECITLHSSVNVSNPYDHRLPICEVTYTLRCAGKEVASGTMPDPGWIXAASGSTALEIPAKVPYDFLVSLVRDVGRDWDIDYELQVGLTVDLPIVGNFTIPLSTSGEFKLPTLKDLF

SEQ ID NO: 8187 - protein, 166 aa, Zea mays
MASEHAAGGEAKHDQKQSLMDKAKGFVAEKIAHIPKPEATLDGVTFKGLSRECITLHSSVNVSNPYDHRLPICEVTYTLRCAGKEVASGTMPDPGWIAASGSTALEIPAKVPYDFLVSLVRDVGRDWDIDYELQVGLTVDLPIVGNFTIPLSTSGEFKLPTLKDLF

SEQ ID NO: 8188 - protein, 123 aa, Zea mays
  misc_feature (18)..(18): Xaa can be any naturally occurring amino acid
  misc_feature (45)..(45): Xaa can be any naturally occurring amino acid
ASSSTYLADDGFAAPLLXGVSYTYDDVIFLPGYIGFPADAVDLSXRLSRRIPLSIPCVASPMDTVSEAAMAAAMASLGIAAVVHCNTEPHAQAAIVRAAKSRRLPFVSAIVVQLEATNPVTDA

SEQ ID NO: 8189 - protein, 152 aa, Zea mays
RPRRFAVDADDALLERGHDTTGRSLLQAKKDCPVSFEGANYTVITSRCKGPLYQPTLCCGALKDFACPYSTYINDVSTNCAATMFSYINLYGKYPPGLFANTCHEGDKGLTCPEDTPQIEPGQKASGAAAVAAPAAALAAAALAVSLLLMSC

SEQ ID NO: 8190 - protein, 378 aa, Zea mays
MNYLRSRSLKRLLSLGRRSNADECAEECVDVDPPPNKPTWRCFSYEELNQATNGFHQDNMVGKGGYGEVYRGVLDDGSAVAVKRLAPTAAADEKKEKDFLTELGTVGHVRHPNVSALLGCCVDRGLHLVFHFSTRGSVSANLHDLKLPAMSWKQRHGIAVGTARGLRYLHKGCARRIIHRDIKASNILLTADYEPQISDFGLARWLPSEWTHHAIAPIEGTFGCLAPEYFTHGIVDEKTDVFAFGVFLLELISGRKPVDGSHMDRLTQAKPYLSDGVVQGLVDPRLGDGYDGGQLRRLMFVASLCVRAAAVWRPTMTQVVELLESGEISQEQWQMPEKEEQDELWDFDDLDDFDEDDYDDESDSPSISSSACSIHPDD

SEQ ID NO: 8191 - protein, 132 aa, Zea mays
METYTTDDALTIMGFGKFQALVLFYAGMGWVAEAMELMLLSFLGPFIREEWNVSPENESLLSSVVFAGMLLGACAWGFVSDKYGRRCIQHLSGQPVQELRPPLVGLVGLFALSLLSPCCGAAIRWKHSLCLR

SEQ ID NO: 8192 - protein, 727 aa, Zea mays
  misc_feature (139)..(139): Xaa can be any naturally occurring amino acid
  misc_feature (172)..(172): Xaa can be any naturally occurring amino acid
MDGRKRKGKFRNSLRRMAMECLCSGEQLKASDETMRSSDSTITKDFSASGYSSRNGEIEQYLDNGNIEEAELSLREGICLNYEEARALLGRLEYQRGHVEAALRVFDGIDISALVPKMKISIARKTDRRKTHSQWGLPXMPLHAVSLLMEAIYLKARALHDLGKDKEARAHXCRMILDIVEAAVPEGLPAGFGKGCKLNEIICKAVELLPELWKSGGFSLETISSYRRSLLNNWNLDGETIARIQKKFAVFLLYSGCEARPPNLHSQLDGSFVPRNNIEEAILLLMILLRKSNLKRIEQDPSVMHHLTFALSMSGQLIPLAGQFEELLPGVLDKKEWLYSVALCYLAEEDDLSALNLLKIILKSGEDSVQLIELLLASKACIEMSIHTEGAFYARRAIANMQGGCKPMAGLANLLLGVALSNQARSAISDTDRASWQCEALEALGNAEKNIHGKDSRALYSLSLENAVQRKLELAAFYAKRLVKLEAGSELRSWLLLARILSAQKLFADAETVVDAALDQTGKWCQGDLLRTKARIQAAQGQFREAVETYTQLLAIIQLRTKSLTAGVCLPKGNKDDKGLETETWYDLALLYLGMAQWRDAEVCVLKIRSISPYSALAWHATGKIYEAKGLRKEALGAFFRALDLDPKHVPSLISTATVLQQLGDRPLPSIRCFLTDALQLDRTNHVAWFNLGLLYKEEGGRSAAEAAECFQAAAFLKETAPSEPFR

SEQ ID NO: 8193 - protein, 295 aa, Zea mays
RGRLSRGQYRNPKEFAEDVRLTFHNAMTYNPKGQDVHFMAEQLSGIFEAQWPEIEAEVNYLASCPPLPKKFPPPPIDLHFLERSDSMRHHMALDTNSRPISHTPTYTRTPSMKKPRAKDPNKRDMTIDEKRKLSENLQNLPPEKLDAVVQVIKNKNLSVMQHDDEIEVEIDSMDAETLWELDRFVANYKKNLSKQKRKAERAMLARQDAELRAQRLIQQPQPTPVPQEPVGEKSLKQVAKGEQLPTSASEKNDENRQNVSGSSNSSSSSSDSGSSSSDSDSDSSSSDGSDAANSS

SEQ ID NO: 8194 - protein, 251 aa, Zea mays
  misc_feature (178)..(178): Xaa can be any naturally occurring amino acid
MAGAAAAAAAVASGISVRPVAAPKISRAPRSRSVVRAAVSLGEKAYTVQKSEEIFNAAKELMPGGVNSPVRAFKSVGGQPIVFDSVKGSHMWDVDGNEYIDYVGSWGPAIIGHADDEVNAALIETLKKGTSFGAPCALENVLAQMVISAVPSIEMVRFVNSGTEACMGALRLVRAFTXGREKILKFEGCYHGHADSFLVKAGSGVATLGLPDSPGVPKGATVGTLTAPYNDAEAVKKLFEDTKGEIAAVFP

SEQ ID NO: 8195 - protein, 292 aa, Zea mays
MPSRPQSILGLSAVPFPRRNPSSSPRRRAVRCPSPRLRAPSLLPSHLMFFSRNAFRDLDPIDSPASMASSKKVATRDEWERKLRDVKIRKEDMNRLVMNFLVTEGFVDAADKFRIESGTQPEIDLAIIADRMEVKRAVQSGNVQEAIEKINDLNPTILDMNPQLYFHLQQQKLIELIREGKTNEALEFAQEELAPRGEENQTFLEEIEKTVALLIFKGVKNCPYRELLDVSQRLKTASEVNAAILASQSHGKDSKLPSLLKMLKWTQNHLDERAAYPAINDFTTAVVEDPSI

SEQ ID NO: 8196 - protein, 75 aa, Zea mays
MSGNGAKKVVDAAVKAGRTIIDWDGMAKLLVTDEARKEFAALRRAFDDVNHQLQTKFSQVSDLAFLLLPPWADLT

SEQ ID NO: 8197 - protein, 170 aa, Zea mays
MSGNGAKKVVDAAVKAGRTIIDWDGMAKLLVTDEARKEFAALRRAFDDVNHQLQTKFSQEPQPIDWEYYRKGIGSKVVDMYKEAFESIEIPKYVDTVTPQYKPKFDAVIAELKEAEKEHQKESERIEKELAEMEEMRKKISTMTADDYFEKYPELRKKFDDEIRNDNWGY

SEQ ID NO: 8198 - protein, 207 aa, Zea mays
GGEGLNEGETFPQSLSLSLSLAILLAMLRRSRHGGVRLGRNLLSLWRRALCGRRRRRGGYRRLQQQQQKPCAGSGCTPGRTATATARKLAPVLRWGRSLARRLRLGWRPAGGGGHRMLPDGGGEPAVTTPKGQVAVYVGGEGEASQSLRYVVPVVYFNHPTFGELLREAEEEFGFQHPGVISIPCPAARFERAAALAAAAKKGFGRW

SEQ ID NO: 8199 - protein, 366 aa, Zea mays
  misc_feature (285)..(285): Xaa can be any naturally occurring amino acid
MHPKARIHADPVREVDHFDCLPDSLVLLILNKVEDVRSLGRCYAVSKRLCGLVSLVHDVYVKIDRVVAVDGDAEGTLNLSSPKPRSIFSHFLKLMLFTIIKPFHNMRSPNGTARPLFPQLSQHSPAQVLRNFTHVRNLRIELPSGDVGTEEGVLLKWRAEYGSTLENCVILGGTRVDRKPVGGEHEPALEDNGSMPESFYTNGGLKLRVVWTISSLIAASTRHYLLRSIINGHPTLQSLVLTDADGQGTLCMGAKQLEEFRENQLSTSACSNRTQVPACNMEHTXLHVAGWDLKLKYAPYVELPGGMALQGATLVAIKPSPEGSNGSHPNRKEAEGFVFGAFDGPFKAAVKALMKRRTYLLEMNGF

SEQ ID NO: 8200 - protein, 354 aa, Zea mays
MHPKARIHADPVREVDHFDCLPDSLVLLILNKVEDVRSLGRCYAVSKRLCGLVSLVHDVYVKIDRVVAVDGDAEGTLNLSSPKPRSIFSHFLRLMLFTIIKPFHNMRSPNGTARPLFPQLSQHSPAQVLRNFTHVRNLRIELPSGDVGTEEGVLLKWRAEYGSTLENCVILGGTRVDRKPVGGEHEPALEDNGSMPESFYTNGGLKLRVVWTISSLIAASTRHYLLRSIINGHPTLQSLVLTDADGQGTLCMGAKQLEEFRENQLSASACSNRTQVPACNMKLKYAPYVELPGGMALQGATLVAIKPSPEGSNGSHPNRKEAEGFVFGAFDGPFKAAVKTLMKRRTYLLEMNGF

SEQ ID NO: 8201 - protein, 149 aa, Zea mays
  misc_feature (120)..(120): Xaa can be any naturally occurring amino acid
  misc_feature (133)..(133): Xaa can be any naturally occurring amino acid
MGVLRKKHNKKSRRPSFKSVLTSILATQAAIFLLLLAGVSLAGTAVAFIASMPLFVVFSPILVPAGVATGLLATGLAAAGSSGAMAVSLILWVFKRVTGKEPPKIMSKVLKKVFPGGGAXLNWQQNQKPTQRXAPAAAPSAAPAAAPST

SEQ ID NO: 8202 - protein, 249 aa, Zea mays
  misc_feature (176)..(177): Xaa can be any naturally occurring amino acid
  misc_feature (183)..(183): Xaa can be any naturally occurring amino acid
PHRRLWVKDRSQAWWDQCNSPDFPEAEFRRAFRMGRETFDMICEALGSAVAKEDTMLRAAIPVRQRVAVCIWRLATGEPLRLVSKRFGLGISTCHKLVLEVCGAIKSVLMPRFLQWPDEAAAGRFKEGFERSFGVPGVIGAMYTTHIPIIAPKISVAAYFNRRHTERNQKTSYSIXXLQGVVXPDRAFTDVCIGWPGSMPDDQVLEKSMLHQRAAAGMMHDACLVGGASYPLMDWVLVPYTHQNLTWTQ

SEQ ID NO: 8203 - protein, 138 aa, Zea mays
SFGACPHNYSGRYPWRRGAGYKRTSAAAKIAPSMLSSDFANLASEAERMVRLGADWLHMDIMDGHFVPNLTIGAPVIQSLRKHTKAYLDCHLMVTKPPDYVEPFGKAGASGFTFHIEVARDNWQDLILSIKSQGMLAW

SEQ ID NO: 8204 - protein, 263 aa, Zea mays
  misc_feature (189)..(189): Xaa can be any naturally occurring amino acid
  misc_feature (211)..(211): Xaa can be any naturally occurring amino acid
  misc_feature (217)..(218): Xaa can be any naturally occurring amino acid
MLVLINRYFRSRNSSPAGGGGEEMAPAATSSDHLCLPGCVPVRAKRASSSASTSAAAAATATTARASRHNFVRAAASGLLAGAHFTNHESLPPLPYAYAEFVAAFPQYAHGALARADAIRGEEYQHLDRHVCLDYTGINLFSHAQMSASLPSTSSAPPPSSAWQPPFFDIAYKSTSLRAQVQCGDNAAXRGRAASGAAVTRRIMASLKIPXDEYAMXXTATGNAAFRLLAESYSFQPGKQLLPVYDYKSEAVGAMADSARRRA

SEQ ID NO: 8205 - protein, 202 aa, Zea mays
  misc_feature (99)..(99): Xaa can be any naturally occurring amino acid
GRGAEATDVANAVLDGTDCVMLSGESAAGAYPEVAVKIMARICIEAESSLDHEAVFKAMIRSAPLPMSPLESLASSAVRTANKAKAALIVVLTRGGTTXAKLVAKYRPRVPILSVVVPVLTTDSFDWTISSEGPARHSLIYRGLIPLLAEGSAKATDSESTEVILEAALKSAVQKQLCKPGDAIVALHRIGVASVIKICIVK

SEQ ID NO: 8206 - protein, 172 aa, Zea mays
MGLHGGVVVLRAAVLAAVLGFVAAAGFISNDALLERGHDTTGRSLLQAKKDCPVSFEGANYTVITSRCKGPLYQPTLCCGALKDFACPYSTYINDVSTNCAATMFSYINLYGKYPPGLFANTCHEGDKGLTCPEDTPQIEPGQKASGAAAVAAPAAALAAAALAVSLLLMSC

SEQ ID NO: 8207 - protein, 345 aa, Zea mays
MPAAAFFSAALPPPSRTLSRRLVVSRAAAAAASASASSSSGWQGGGGVEFQGKVGFLGLGIMGAPMASNLIKAGCDVTVWNRTKSKCDPLLSLGAKYEPTPAQVASSCDVTFAMLADPQSAAEVACGSSGAAEGLAPGKGYVDVSTVDGATSKLIGERITSTGASFLEAPVSGSKKPAEDGLLIFLTAGDESLYKRVAPLLDVMGKSRFYLGDVGNGAAMKLVVNMVMGSMMVSFSEGLLLSEKVGLDPNTLVEVISQGAISAPMFSLKGPSMVKAAYPPAFPLKHQQKDLRLALALAESVSQSIPTVAAANELYKAAKSLGLSDHDFSAVIEALKAKVQSQSSQ

SEQ ID NO: 8208 - protein, 170 aa, Zea mays
  misc_feature (37)..(37): Xaa can be any naturally occurring amino acid
MAPTVMMASSATAVAPFQGLKSTASLPIARRSSRSLXNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 8209 - protein, 202 aa, Zea mays
  misc_feature (169)..(169): Xaa can be any naturally occurring amino acid
RARLSDSAEPQYAGSGRGLRLRHTSPGVPLVFPYIYRSMCVVIFIGTNGQTYFITASLVTSIQNFPKSRGPTVGILKGFMGLTSAILTQVYTVMHTPDHAALIFMVAVGPSLVAIGLMFVIRPVGGHRQIRPSDKNSFMFIYTVCLLLASYLVGAMLIQDFLQPSYDVXVVFLTVILFVFLISPSAFPVIGSSCRKKAQHLM

SEQ ID NO: 8210 - protein, 648 aa, Zea mays
MAPHLLAVAVAVAAIIATVSLLAPGAAAYPWPVCGTSNDFEPNSTYQANLNLLAAMLPNNVSASPVLYATAVVGAVPEQVWGMGLCRGDANASSCLACLTQAFQDLPNDCSYNKDAAIYYDPCTLHYSDVHTLADDDTGPTTMSYNINNNANVTSDPARFERLLAALVNATAEHAASNSTRRFATGEADADFDRQFPKVYALAQCTPDQTPAQCRKCLAGLISQSLDGFQNNIGGRVLWVNCTWRYETSPFFNGPAMVRLASSSSPPAAAAAGGGERKYSVFIVVLAVVLPTLAALNLVFCFCFWRRPAPQAKQSQPMYSTEAEDVETVDSMMIDVSALRAATGNFDESNKLGEGGFGAVYKGVLPDGDEIAVKRLSKSSTQGVEELKNELALVARLRHRNLVRLVGVCLEQQERLLVYEFVPNRSLDLVLFGTDTREPLSWEQRYRIINGIARGLQYLHEDSQLKVVHRDLKASNILLDVEMNPKISDFGLARIFGRDQTQAVTSRVVGTYGYLAPEYLMRGNYSVKSDAFSFGVMVLEIVTGRKNNGSSHKSGDLLTTVWEHWEAGTVAELVDPSLGGSFPEGDVLRCIHIGLLCVQGDPAARPVMSSVVTMLGTDTVTLQAPSKPGFFARKSGTSTTVSADDGSI

SEQ ID NO: 8211 - protein, 259 aa, Zea mays
MDRKRIKDALEKHLERSSPFTSRGVVSKERERLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAMLEKFKNYDFGRCPRVYCCGQPCLPAGQSDVPRSSTVKIYCPKCEELNYPRSKYQGNIDGSYFGTTFPHLFLMTYSHLKPQKPSQQYTPRVFGFKLHKPS

SEQ ID NO: 8212 - protein, 220 aa, Zea mays
MDRKRIKDALEKHLERSSPSTSRGVVSKERERLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAMLEKFKNYDFGRCPRVYCCGQPCLPAGQSDVPRSSTVKIYCPKCEELNYPRSKYQGSILLI

SEQ ID NO: 8213 - protein, 123 aa, Zea mays
VGSGHVLLLLSPFDIELFCFRSPQLEKFKNYDFGRCPRVYCCGQPCLPAGQSDVPRSSTVKIYCPKCEELNYPRSKYQGNIDGSYFGTTFPHLFLMTYSHLKPQKPSQQYTPRVFGFKLHKPS

SEQ ID NO: 8214 - protein, 152 aa, Zea mays
  misc_feature (41)..(41): Xaa can be any naturally occurring amino acid
  misc_feature (103)..(103): Xaa can be any naturally occurring amino acid
  misc_feature (128)..(128): Xaa can be any naturally occurring amino acid
  misc_feature (130)..(131): Xaa can be any naturally occurring amino acid
  misc_feature (133)..(133): Xaa can be any naturally occurring amino acid
LLCTDTYTEERKEFIELSAEILYGLIHARYILTSKGLAAMXEKFKNRDFGGCPRVYCCGQPCLPAGQSDVPRSSTVKIYCPKCEELNYPISMYQGSIDGSYFXTTFPHLFLMTYPHLKPQKPPQQYTXKXXSXFKHHKPVMTEAALSAETPF

SEQ ID NO: 8215 - protein, 184 aa, Zea mays
MAAAAIHQFAESITWHAWSPDQSMIAFCPNNHEVHIYKFFTDKWEKLHVLSKHDQIVSGIDWSNSSNKIVTVSHDRNSYVWTQEGSDWIPTLVILKLNRAALCVQWSPKENKFAVGSGAKSVCLCYYEQENNWWISKVIRKRHESSVTSLAWHPNNIYLATTSTDGSCTVFSTFIKGVDTGGSQ

SEQ ID NO: 8216 - protein, 383 aa, Zea mays
MAEDRSPKPIHCKAAVCRAAGEPLTIEEIVVDPPKAYEIRIRVICTSLCHTDITFWKAKVAPVFPRILGHEAYGVVESVGEHVEGFAAGDTVVPTFLGQCERCASCASEHSNVCDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGVDLNPDKEEVGRSFGVTDFVNPSQLDKRSVVEVIVEMTGGGVDYSFECIGVPSVMTDAFRCTKMGKGKTIVLGLGRDSDEVCLPSLELLFGRCVMGSLFGGLKPKTHIPVLAKKCMDKELQLDALVTHELGLQDINKAFDLLLQGKSLRCILWMDKDK

SEQ ID NO: 8217 - protein, 383 aa, Zea mays
MAEDRSPKPIHCKAAVCRAAGEPLTIEEIVVDPPKAYEIRIRVVCTSLCHTDITFWKAKVAPVFPRILGHEAYGVVESVGEHVEGFAAGDTVVPTFLGQCERCASCASEHSNVCDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGVDLNPDKEEVGRSFGVTDFVNPSQLDKRSVVEVIVEMTGGGVDYSFECIGVPSVMTDAFRCTKMGKGKTIVLGLGRDSDEVCLPSLELLFGRCVMGSLFGGLKPKTHIPVLAKKCMDNELQLDALVTHELGLQDINKAFDLLLQGKSLRCILWMDKDK

SEQ ID NO: 8218 - protein, 270 aa, Zea mays
CDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGVDLNPDKEEVGRSFGVTDFVNPSQLDKRSVVEVIVEMTGGGVDYSFECIGVPSVMTDAFRCTKMGKGKTIVLGLGRDSDEVCLPSLELLFGRCVMGSLFGGLKPKTHIPVLAKKCMDKELQLDALVTHELGLQDINKAFDLLLQGKSLRCILWMDKDK

SEQ ID NO: 8219 - protein, 554 aa, Zea mays
ANKHSAAVADTGEVFTWGCNKEGQLGYGTSNSASNCIPRMVEYLKGKVLRGVSAAKYHTIVLGADGEVFTWGHRLVTPRRVVVARCLKKGGNINLKFHRMERLQVISVAAGTTHSTALTADGALFYWVSSDPDLKCQQIFSMCGRNIVNISAGKYWTAVATSTGDVFMWDAKKRKDETPIFTRVHGVKRATFVCVGETHMLVLSSIYHPEYPPKPKSQGLKSMLEWNGGTEELGEDILFDDVQPNSGLSGSSGEMSKGVPSLKSLCEKVAVEYLLEPKNAIQLLEIADSLEAKELKKHCEDLAIRNLDYIFTVGAPSIMNASSEILVNLEKLLDEKSSEPWSQRRLPTMTATYPAVIDSDVEEDEAREFPKTRKCGKSASRPSAMSSDDSFLQKDCTAEQAVSKQVRALRKKLQQIEILEAKQLAGHQLDSQQVAKLESRAALEGELAELGIPSEIYSTSSACPAEGRTNRKPEVSKKQKRKNKQSTQTPSVKNELGQQIPITELQVLQVNASAEKEAYAADPIKPMEAAAFSNTKDTASPPEKKPSQPTPSKK

SEQ ID NO: 8220 - protein, 568 aa, Zea mays
MPTSSTNPSTEFLYLGTLATPPPPGPQHPGTSSSLRPGSPELRPLPPLPRVGPPSGEFLSRSSASDPSTVPPAAAADASSSSLSPSSPSESSPTLGSKPGPFPPRRHPPAALAEPPIPRRTKRRPLPPKGAAEPVAAHGWNPFVPLPPRPAVASSDDGDSDQMMDLRKSRPLHSDKLKPGSLHMKDEVIQLYLNNSAAVAAPREVCLLGALRCHGIGMIVGALGVSKEQLKDALLEGNVHGLGVEALQMLTQMVLSNEEELKIKYFKDDSLNRLCPVDVFLKAMLDVPFVFKRVDAMLYIASFYLEINRLRMSYATLEGACQEMRSSRLFHKVLEAVVNFGNFMSTNSGSPSSKGLEPNTVLKIADVKGADGKAALMQFIVQEIVKPEGYDVMQHGSGACKMSTNTLQCDAECRKHGLEVVAKLAAQLSNTKKAASIDIKRLSQSVSELGMGLGKVHDVVRLNSMVTSVDSARRFHNSMSTFLRHAEEEILKLQSQESICLSSVKEMAEWFIGESVNDEAHMFRIFAGVKEFLAMLDHICKEAGEVSSNNWVGATTASWMAAPMGMMP

SEQ ID NO: 8221 - protein, 155 aa, Zea mays
MVVNGRPLKRARARVEARDFARFPAAGDCGAAGTFREAVRGFLAKHARLLPLPSIFSPAAAAAPPHLLIWRVSLRVGEAGEEESGGGVELNVVEEDVLRSRSVYCDQCRVVGWSGHPVCVKRYHFIIENDSSHLSGRRRTCCLRCGTPMAAGESR

SEQ ID NO: 8222 - protein, 153 aa, Zea mays
  misc_feature (105)..(105): Xaa can be any naturally occurring amino acid
MVVNGRPLKRARARVEARDFARFPAAGDCGAAGTFREAVRGFLAKHARLLPLPSIFSPAAAAAPPHLLMWRVSLRVGEAGEEESGGGVELNVVEEDVLRSRSVYXCDQCRVVGELLSSLFRPFFLRFFFVFFVVVICVGYVYVLVIPVLVCAP

SEQ ID NO: 8223 - protein, 278 aa, Zea mays
MVVNGRPLKRARARVEARDFARFPAAGDCGAAGTFREAVRGFLAKHARLLPLPSIFSPAAAAAPPHLLIWRVSLRVGEAGEEESGGGVELNVVEEDVLRSRSVYCDQCRVVGWSGHPVCVKRYHFIIENDSSHLSGRRRTCCLRCGTPMAAGESRCALCNFDMDGEEIEECAYLHLDDPTHLLHAVVHANGYGHLLRVNGREGGSRFLTGRDIMSLWDRLCKVLHVRKCASPRKGDGRGGGGSNGGGTMEVTASGRCKDEIGASVGGAGKYGRMATVG

SEQ ID NO: 8224 - protein, 625 aa, Zea mays
  misc_feature (95)..(95): Xaa can be any naturally occurring amino acid
MDQLVNFIIRPPRADYSPNDDLLEQEFMLKGRWFLRKDLEDKQTGHATLRCNSGGDLYTYPSTTAPSCSLATTSSLWHHRLGHPGPSSLAKLRSXVKNGQGKKLQCSHYMPVVIPEGKALPCVIYCHGNSGCRADASEAAIILLPSNITVFTLDFSGSGLSEGEHVTLGWNEREDLKAVVNYLRTDGNVSCIGLWGRSMGAVTSLMYGAEDPSIAGMVLDSPFSNLVDLMMELVDTYKYPLPKFTVKLAIQHMRKIVKRKASFDIMDLDTIQVAKQCFVPALFGHATEDDFILPHHSDKIYESYIGDKNIIKFDGDHNSPRPQFYFDSITIFFHNVLNPPEVAEDHYFMTPHGSLGQGHWDTEQDIEYRFSQSPTGTANATTTEDAIAQLRSRRLMSRMEVPSGATTEDRTDRTEGFDSDLGPSSSSVSTATPPNGRNGRLLTPTSDDGEYVEYSFDSLSDMPHTVEDEDRMLMQAILESLKDYEQSNTKNVQSTASDPASDPASKANGTVKDCNGVAAAALEQDASSFDAPDKHTNVPNSGEKVSEGQSTDCNAGKSSASVSASGSSEPLAPTQMVNGQPASVDSQKVTQNANGEDGTRATLVVQKSRTGGLIEKWGSFFKNND

SEQ ID NO: 8225 - protein, 460 aa, Zea mays
  misc_feature (6)..(6): Xaa can be any naturally occurring amino acid
  misc_feature (43)..(43): Xaa can be any naturally occurring amino acid
MATVSXTPQAVFSTESGGALASATILRFPPNFVRQLSTKARRXAAAEVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVPAGGHIVTTTDCYRKTRIYMETELPKRGISMTVIRPADMDALQNALDNNNVSLFFTETPTNPFLRCIDIEHVSNMCHSKGALLCIDSTFASPINQKALTLGADLVIHSATKYIAGHNDVIGGCVSGRDELVSKVRIYHHVVGGVLNPNAAYLILRGMKTLHLRVQCQNNTALRMAQFLEEHLKIARVYYPGLPSHPEHHIAKSQMTGFGGVVSFEVAGDFDATRKFIDSVKIPYHAPSFGGCESIIDQPAIMSYWDSKEQRDIYGIKDNLIRFSIGVEDFEDLKNDLVQALEKI

SEQ ID NO: 8226 - protein, 243 aa, Zea mays
  misc_feature (43)..(43): Xaa can be any naturally occurring amino acid
  misc_feature (210)..(210): Xaa can be any naturally occurring amino acid
MATVSLTPQAVFSTESGGALASATILRFPPNFVRQLSTKARRXSAAAEVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVPAGGHIVTTTDCYRKTRIYMETELPKRGISMTVIRPADMDALXNALDNNNVSLFFTETPTNPFLRCIDIEHVSICA

SEQ ID NO: 8227 - protein, 422 aa, Zea mays
MARKKIREYDSKRLLREHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGNTISFSECGGIEIEENWDKVKTIFLPTEKQMTPDACAPLIATLPLEVRTKIGDFIRAVFSVFQDLDFSFLEMNPFTLVNGEPYPLDMRGELDDTAAFKNFNKWGNIVFPLPFGRVLSPSESFIHELDEKTSASLKFTVLNPKGRIWTMVAGGGASVIYADTVGDLGYASELGNYAEYSGAPKEEEVLQYARVLLDCATSDPDGRKRALLIGGGIANFTDVASTFSGIIRALREKESKLKAARMNIYVRRGGPNYQTGLAKMRTLGAELGVPIEVYGPEATMTGICKEAIDCIMAA

SEQ ID NO: 8228 - protein, 197 aa, Zea mays
  misc_feature (131)..(131): Xaa can be any naturally occurring amino acid
MAANAGNKIRNAKLVLLGDVGAGKSSLVLRFVKGQFVEFQESTIGAAFFSQTLAVNDETVKFEIWDTAGQERYHSLAPMYYRGAAAAIVVYDITNPASFTRAKKWVQELQAQGNQNTIVALAGNKADMLDXEAKAYAQENGLFFMETSAKTAINVNDIFYEIAKKLLQGQQAPSPQAGMVLNQRPNERTVSSSSCCS

SEQ ID NO: 8229 - protein, 331 aa, Zea mays
MATSTSQHALSSIKLLSTGCLHPDKRNCRVLSVSVGRRCPSARNLGLLCASNSQSSVIEPVQLPRSPKSGVTPKKSGESALILIRHGESLWNEKNLFTGCVDVPLTPKGVDEAIEAGKRICNIPVDVIYTSSLIRAQMTAMLAMMQHRRKKVPIILHNESEQAHMWSQIYSEETKKQSIPVITAWQLNERMYGELQGLNKQETADRFGKEQVHEWRRSYDIPPPNGESLEMCAERAVAYFKDQIIPKLVDGKHVMIAAHGNSLRSIIMHLDKLTSQEVISLELSTGIPMLYIFKEGKFIRRGSPAGPSEAGVYAYTKNLAQYRQKLDGIVQ

SEQ ID NO: 8230 - protein, 533 aa, Zea mays
TYELSGVSTPGNVPGSYREPAIGWMTGFLLAVSFVGLLTLLPLRKVLVIDYKLTYPSGTATAVLINGFHTPQGDKNAKIQVRGFLKYFGISFLWSFFQWFYTAGDHCGFAQFPTFGLQAFNQTFSFDFSLTYVGAGMICSHLVNLSLLFGAVVSWGVMWPLIGKQKGNWYPADASQNSMTGIYGYKAFLCIALLVGDGLYNFVKVIAITVKNIRERSRRKNLNRVADADTMALDDMQRDEVFNRDNIPTWLSYAGYAALSLIAVIAIPIMFREVRWYYVVVAYALAPALGFCNAYGTGLTDMNMGYNYGKIALFVLAAWAGKDSGVVAGLVGCGLVKQLVLVSADLMHDFKTGHLTLTSPRSMLVGQAVGTLMGCVLAPLTFMLFYRAFDVGEPDGYWKAPYALIYRNMAILGVEGFSALPRHCLQLCAGFFAFAVLANLARDLLPRRLARLVPLPMAMAVPFLVGASFAVDMCVGSLVVFAWHKLDGKKAALLVPAVASGLICGDGIWTFPSSLLALAKVKPPICMKFTPGS

SEQ ID NO: 8231 - protein, 247 aa, Zea mays
  misc_feature (16)..(16): Xaa can be any naturally occurring amino acid
  misc_feature (23)..(23): Xaa can be any naturally occurring amino acid
  misc_feature (37)..(37): Xaa can be any naturally occurring amino acid
  misc_feature (94)..(94): Xaa can be any naturally occurring amino acid
  misc_feature (204)..(204): Xaa can be any naturally occurring amino acid
  misc_feature (221)..(221): Xaa can be any naturally occurring amino acid
MAANLEDVPSLDLMHXLLRRMKXCSSKPDKRLILIFXPGSGKGTQSPIIKDDILLGPFYTTGDMLRAAVGGQYTSMYQQLNEAMNKGELVSDDXLVVGIIDEAMKKPSCQKGFILDGFPRTVTQAQKLDEMLAKQGANVDKVLNFAIDDAVLEERITGRWIHSASGRTYHSKFAPPKSPGVDDVTGEPLIQRRDDTAEVLKSRXLEAFHRQTEPVIDYYSXKKGLVVNLPAEKPPKEVTAEVQKALS

SEQ ID NO: 8232 - protein, 241 aa, Zea mays
MAANLEDVPSLDLMHELLRRMKCSSKPDKRLIVIGPPGSGKGTQSPIIKDEYCLCHLATGDMLRAAVAAKTPLGIKAKEAMDKGELVSDDMVVGIIDEAMKKPSCQKGFILDGFPRTVTQAQKLDEMLAKQGANVDKVLNFAIDDAILEERITGRWIHSASGRTYHSKFAPPKSPGVDDVTGEPLIQRRDDTAEVLKSRLEAFHKQTEPVIDYYSKKGLVVNLPAEKPPKEVTAEVLKALS

SEQ ID NO: 8233 - protein, 196 aa, Zea mays
MAAAEEEIAVKEPLDLIRLSLDERIYVKLRSDRELRGKLHAYDQHLNMILGDVEEVPQNAGACVVAKPQGQSECAFDSLVLQLGFRGFLGAEREAAAAMAAAEEEIAVKEPLDLIRLSLDERIYVKLRSDRELRGKLHAYDQHLNMILGDVEEVVTTVEIDDETYEEIVRTTKRTIPFLFVRGDGVILVSPPLRTA

SEQ ID NO: 8234 - protein, 98 aa, Zea mays
MAAAEEEIAVKEPLDLIRLSLDERIYVKLRSDRELRGKLHAYDQHLNMILGDVEEVVTTVEIDDETYEEIVRTTKRTIPFLFVRGDGVILVSPPLRTA

SEQ ID NO: 8235 - protein, 270 aa, Zea mays
MGLALSRLEEIRTQYRMAAEDGEADSPAPAPVPPTGAAAASGGGTEKKKQADDSSSSSKTTEWVPHKFSEIVGQRRPGEDMFRGIYLPRSDQQPKTKKYWVDGRNANCFMLFPKGFSITWGSDERYWSWRKLTQEEKRGIDDEEANMEVAYLKDVCWLEIRAKLEMSHLTPGFTYVVAFVAKLEPNGYGWSEPVDLQIKCPGDIDGKPRQQRKESLWKTVDGKKWTDLNVGEVKAEAGQKGEMEIAMLRLGGDWKRGLSLRYIKIAPQKP

SEQ ID NO: 8236 - protein, 353 aa, Zea mays
MASPSIPAALRHPHLPADGGLLFHSSGDPTARSSLSFRIGDMTMRRCQTGPGPVLAARSPGLGNVDNLHESSSLSRSWDLNRQIDDDRDVLIECRDVHKSFGEKQVLRGVSFKIRHGEAVGIIGPSGTGKSTILKVMAGLLAPDKGDVIICGKKRHGLVSDEDIEGLRIGLVFQSAALFDSLTGRENVGFLLYENSSLPEDRIGKLVTETLAAVGLKGVEDRMPSELSGGMKKRVALARSIIFDDTKDVVEPEVLLYDEPTAGLDPIASTVVEDIIRSVHMTGRDALGKPGKIASYVVVTHQHSTIRRAVDRLLFLHEGKVVWEGMTHEFTTSANPIVQQFASGSLDGPIKYF

SEQ ID NO: 8237 - protein, 264 aa, Zea mays
MADSMVASFWGPVTSTIELCEENYAHSSYIAEFYNTISNVPCVLLALIGLVNAFRQGFEKRFSVLHISNMILAIGSMIFHATLQLVLQQSDETPMVWEILLYMYVLYSPDWHYRSTMPTFLFLYGAAFAVVHFFARFQFVFKLHYIGLCFLCIPRMFKYYIQTKDVAAKRLAKLWVLPLTLGTLCWLVDRIFCKKLLHWYVNPQGHAWWHVLMGLNSYYANPFLMFCRAHQRGWEAKIPSLLGFLPYVKVQKPKKRELFVFVEP

SEQ ID NO: 8238 - protein, 294 aa, Zea mays
VEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTDCVMLSGETAAGAYPELAVQTMAKICLQAESCVDHAAIFKSIMASAPIPMSPLESLASSAVRTANSARAALILVLTRGGTTARLVAKYRPSMPILSVVVPELKTDSFDWACSDEGPARHSLIVRGVIPMLSAATAKAFDNEATDEAIGFAIENAKTMGLCNTDQSVVALHRIGISSVIKLLYCEVGVQG

SEQ ID NO: 8239 - protein, 323 aa, Zea mays
MAAGRELVVSFGEMLIDFVPTVAGVSLAEAPAFLKAAGGAPANVAIAVSRLGGGAAFVGKLGDDEFGRMLAAILRDNGVDGDGVVFDAGARTALAFVTLRADGEREFMFYRNPSADMLLTADELNVGLIRRAAVFHYGSISLIAEPCRTAHLRAMEIAKEAGALLSYDPNLREALWPSREEARTQILSIWDQADIVKVSEVELEFLTGINSVEDDVVMKLWRPTMKLLLVTLGDQGCKYYTRDFHGAVPSFKVQQVDTTGAGDAFVGALLRRIVKDPSSLQDEKKLVESIKFANACGAITATKKGAIPSLPTETEVLQLIEKA

SEQ ID NO: 8240 - protein, 660 aa, Zea mays
  misc_feature (74)..(74): Xaa can be any naturally occurring amino acid
  misc_feature (82)..(83): Xaa can be any naturally occurring amino acid
MLPPRAAAVPLLLLALAAGAAGGADDLASDAAALQAFLAPFGSATVSWNVTEIHLPGEGLRGALPVGALGGLNXARRASLRXXRGSGPLPRDLASCVELRVINLQSNLLSGELPVEVLALPALTQLNLAQNRLSGRISPAIAKNGRLQLLFLNGNRLTGELPNVSMPSLTALNVSFNNLSGEIPKSFGGMPSTSFLGMPLCGKPLPPCRAPGSEASPSQPPTPTLRPEAPAPTDNRGRGRHHLAGGAIAGIVVGCAFGFLLIAAVLVLVCGALRREPRPTYRSRDAVAAELALHSKEAMSPNGYTPRVSDARPPPPPSVPPPPAVSAAAVGRKKLFFFGRIPRPYDLEDLLRASAEVLGKGTHGTTYKAAIESGPVMAVKRLKETSLPEREFRDKVAAIGGIDHPNVVPLQAYYFSKDEKLMVYEFVAMGSLSSMLHGNRGSGRSPLSWESRRRIALASARGLEYIHATGSMVTHGNIKSSNILLSRTVDARVADHGLAHLVNPAGAATTTRVAGYRAPEVVADPRRASQKADAYSFGVLLLELLTGKAPAHAVLHDEGVDLPRWARSVVKEEWTSEVFDTELLRHPGAEDEMVEMLRLAMDCTEPAPDQRPAMPEIVARIEGLGGTASTSTATARSGRSASVDEADDRPLRTTGSIRQS

SEQ ID NO: 8241 - protein, 315 aa, Zea mays
PRVRFGIDPNNAFAFWDWVGGRYSVCSAVGVLPLSLQYGFPIVQKFLEGASSIDNHFYSSSFEKNIPVLLGLLSVWNVSFLGYPARAILPYSQALEKLAPHIQQLSMESNGKGVSIDGAQLSFETGEIDFGEPGTNGQHSFYQLIHQGRVIPCDFIGVVKSQQPVYLKGETVSNHDELMSNFFAQPDALAYGKTPEQLHSEKVPENLIPHKTFKGNRPSLSLLLPTLSAYEVGQLLSIYEHRIAVQGFIWGINSFDQWGVELGKSLASQVRKQLHGTRMEGKPVEGFNHSTSSLLARYLAVKPSTPYDTTVLPKV

SEQ ID NO: 8242 - protein, 185 aa, Zea mays
  misc_feature (118)..(118): Xaa can be any naturally occurring amino acid
  misc_feature (150)..(150): Xaa can be any naturally occurring amino acid
  misc_feature (155)..(155): Xaa can be any naturally occurring amino acid
MASAALICGTEQWKALQAHVGAIQKTHLRDLMADADRCKAMTAEYEGIFLDYSRQQATGETMEKLLKLADAAKLKEKIEKMFKGEKINSTENRSVLHVALRAPRDAVINSDGVKCGPXFGSVKDKIKQFSETFRSGSWGWSNWKTLTNVXVSVGXIGGSFLGPLFVHTALQTDPEAAECAKGRQL

SEQ ID NO: 8243 - protein, 261 aa, Zea mays
MKGVFATRVSGSADLYQVNNRKPYHSVNFVIAHDGFTLCDLVSYNSKHNDANGEGGRDGCNDNYSWNCGIEGETNDLNVLSLRSRQMKNFHVALMISQGTPMMLMGDEYGHTRYGNNNSYGHDTHINNFQWGQLEERKDGHFRFFSEMIKFRHNHPILRRDRFLNKNDVTWHENRWENQDSKFLAFTIHDHSSGGDIYLAFNAHEYFVDAVIPPPPHHKSWSRVVDTNLESPKDIVPEGVPFTGSGYRIAPYSSILLKAKP

SEQ ID NO: 8244 - protein, 243 aa, Zea mays
MAERMQTITQRASENKLSKITKQAEEYARLIMEELDPDKLGYIEVRNLERLLEDPSQSVSIGTGKDMSQMLRSQSLRPTPEPNPLRRTQYFLEDNWRRVWVVLLWLSICVGLFAWKFAQYRRRAAPRLKFNMALILLPVCRNTITWIRNHTAVGRVVPFDDNISFHMVVAAGIAVGAGLHVVSHLTCDFPRLLHATDAEYAPLGQYFGVPRPPNYWWFVRGTEGWTGLAMLVLMAVAFTLAMP

SEQ ID NO: 8245 - protein, 348 aa, Zea mays
  misc_feature (343)..(343): Xaa can be any naturally occurring amino acid
MAALAASSTAAFAAKPRLPRARLTVACSATGGDGNGSSSSVSLASSVKTFSAALSLPPVLLSSPSSPPGPGADPSHKLPLRRRPGRESSRTPCLIPPNKLPSSTPDAAAAAVEMAALAASSTAAFAAKPRLPRARLTVACSATGGDGNGSSSSVSLASSVKTFSAALALSSVLLSSAATSPPPAAADIAGLTPCKESKAFAKREKNSIKKLTASLKKYAPDSAPALAINATIEKTKRRFENYGKFGLLCGADGLPHLIVSGDQRHWGEFVTPGLLFLYIAGWIGWVGRSYLIAISGEKKPAMREIIIDVELATRLLPRGFIWPVAAYRELINPTRGDLVVVDXDIGYY

SEQ ID NO: 8246 - protein, 232 aa, Zea mays
MAALAASSTAAFAAKPRLPRARLTVACSATGGDGNGSSSSVSLASSVKTFSAALALSSVLLSSAATSPPPAAADIAGLTPCKESKAFAKREKNSIKKLTASLKKYAPDSAPALAINATIEKTKRRFENYGKFGLLCGADGLPHLIVSGDQRHWGEFVTPGLLFLYIAGWIGWVGRSYLIAISGEKKPAMREIIIDVELATRLLPRGFIWPVAAYRELINGDLVVDDKDIGYY

SEQ ID NO: 8247 - protein, 388 aa, Zea mays
MPQPAPQTAAYGAYPPTYSVQAYTGRKVAIVGSGPSGLAAADQLNKMGHFVTVFERADRIGGLMMYGVPNMKTDKIGVVQRRVNLMAEEGVTFVVNANVGSDPLYSIERLRSENDAVIGAGGAAFPRDLTIPGRELSGVHFAMEFLHANTKSLLDSNLEDGKYISARGKKVVVIGGGDTGTDCIGTSIRHGCTSLVNLELLSKPPSTRAADNPWPQWPRIFRVDYGHQEAATKFGKDPRTYGVLTKRFIGDGNGKVKALEVVRVKWEKVDGRFQLKEMEGSEEIIEADLVLLAMGFLGPEATIAEKLGLEKDNRSNFKAQFGDFATSVDGVFAAGDCRRGQSLVVWAITEGRQAAAAVDKYLSRYDQNAAATGDSTPSGTGLVQPVAA

SEQ ID NO: 8248 - protein, 238 aa, Zea mays
FGSSGSSWHLLCGGGRGRGQEGKACSHHGFRPLDLASHGRQAAVCAAARAAPARRPGIPSRSIGYDDIEPEDDVHSDFPCPYCYEDHDVASLCAHLEDEHPFESKIVKHQRVRRVTGNGNHNLSYAGRDLQLQETYLKVLLGNSSRSSSTNASSTVTDSLLPSLVLNLSSPEVEDASKFSAPAVVENNWFKRSLPSKTWKLRAVDSTLSHEERERRRRRAAVRSAFVQHLLVTTIFED

SEQ ID NO: 8249 - protein, 321 aa, Zea mays
MAPAVSAAASAAMRQALRDRQILDAVGTGAAALSLAGSSFIVICYLLFRELRKFSFKLVFYLAVSDMFCSLFTILGGPSNAFYCFAHDYSAHFFCVASFLWTTTISFTLHRTVVKHKTDVEEFGSIFHLYVWGTSLSTTVLRSIGSDYGRPGTWCWIQQGSMAKVLHLITFYLPLWGAILYNGFTYYEVNRMLNNATQMAAGISDRSNQSDIRADRKAFNRWGYYPLILIGSWAFATINRLYDFANPGHRIVWLSFLDVGFAGLMGLFNSIAYGLNSSVRRAISERIDTFLPERIKRSLPALSRLRSQQENELTSLIVEGN

SEQ ID NO: 8250 - protein, 246 aa, Zea mays
  misc_feature (226)..(226): Xaa can be any naturally occurring amino acid
MSSVSPARELPDPDGFLRRWSDSPPPPSQSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEASSTLLPINFDGLAKALTPGATIFVGQYLFTGSETTSVWLEVSEVKGDDVVCIIKNTATLAGSLFTLHCSQIHIDLPTLSDEDKDVIKKWGAPKXIDFLSLSYTRHAEDVRQARE

SEQ ID NO: 8251 - protein, 650 aa, Zea mays
MRSPSPPPWRLRRIRFAFPMLLVVASLAGADDLASDARALVAFRDAVGRRLAWNASDVAGACSWTGVTCEHGRVAVLRLPGATLSGTVPAGTLGNLTALHTLSLRLNGLSGALPADLSSAAALRNVFLNGNRLSGGFPQAILALPGLVRLSLGGNDLSGPIPTELGNLTHLRVLLLENNRFSGEISDVKLPPLQQFNVSFNQLNGSIPASLRSQPRSAFLGTGLCGGPLGPCPGESPTPVPSGSGGGGGTNGGSGVENGHKGKKLSGGAIAGIAIGSALGAALLLFLLVCLCRRSGGIRTRSLEMPPSSPAPAGGRKPPEMTSAAAVAPLTTIGHPNAPIVQSTSGKKLVFFGSAAAVASFKLEDLLRASAEVLGKGTFGTTYKAVLESGATLAVKRLKDVTLSEPEFRERISEIGELQHEFIVPLRAYYYSKDEKLLVYDFMPKGSLSAVLHGNITSGKTPLNWDLRSSIALAAARGVEYIHSTSSTASHGNIKSSNVLLGESYQAHVSDNGLTALVGPSSSPSRATGYRAPEVIDPRRVSQKADVYSFGVLLLELVTGKAPSQAALNDEGVNLPRWVQSVSRSEWGSEVFDIELMRHEAGEEPMAQLVLLALDCVAQVPEARPSMGHVVTRIEEIRKSSLTTNMEEEV

SEQ ID NO: 8252 - protein, 344 aa, Zea mays
PAGVSSSSPASERQRLHPISFSPPHLRRTPITLFPPPAVQLTPTAPPLPLKSRDIADPPALRSARLRTRPIGSRSVDGTLNCGYSSFRGRRASMEDFYDIKASKIDDKQINLFGIFDGHGGSRAAEYLKEHLFENLMKHPEFMTNTKLALSETYRKTDSEFLDAERNTHRDDGSTASTAVMVADHLYVANVGDSRAVISKAGKAIALSEDHKPNRSDARERIESAGGIIMWAGTWRVGGVLAMSRAFGNRLLKQFVIADPEIQEQEINDELEFLIIASDGLWDVVPNEDAVSLVKMEEDPEAAARKLTETAFSRGSGDNITCIVVKFEHDKPGGGGYSPPGDKS

SEQ ID NO: 8253 - protein, 231 aa, Zea mays
MAGETVLVTGASGFIGSTLVRLLIGRGYNVHAGVLNPDDGAETEHLLAMAAGAGEGRLRIFRGDLLDGAALIDAARGCSGVFHLASPCTVDPVSDPQKQLMVPAVEGTLNVVRAAKDAGGVRRVVVTSSISAVVPNPGWPAGEVVDERCWTDIDYCQKNGVWYPASKTLAEKAAWKFADENGLDVVVVNPGTVLGPMIPPAINASMAMFCRLLQGNAKCFSRLRSGTSRFR

SEQ ID NO: 8254 - protein, 193 aa, Zea mays
MSAVNITNVAVLDNPTAFLNPFQFEISYECLVPLDDDLEWKLIYVGSAEDENYDQQLESVLVGPVNVGTYRFVLQADPPDPSKIREEDIIGVTVLLLTCSYMGQEFMRVGYYVNNDYDDEQLREEPPAKVLIDRVQRNILADKPRVTKFPINFHPEPSTGPGQQQQQQEPQTTSPENHTGNGEANGSKPEADQ

SEQ ID NO: 8255 - protein, 463 aa, Zea mays
GEDPFVAAGILSSTQDTHPPQPPQPAPQPPPPPDLSPRSGSGGRKAGRRPKRVAVAATGMVADVIGKEYTRPAANSVVSMPNAWKGRDGESDGSGSGGRKDSVEEAEQFLCSMLGDNSELGMGVVRDVLGQYGYDVEKALDALLDISGVSSVENMETNHQSARRNDTCHLDMFSGNGLSVENLTAGNRRSLRQLTDEISNTGLQSELGHEFLWGEPQISYAEAVKEAPRSSTLPSRSTVMKAGPQQVLDSLFKIPETRTYEPSSMDWKKVVKKLQTINYTAASNNHERPKDGGGYRELRGVAARHYDKMKEYYQKAAFAYSKGDRSYASYLAEEGKHYRELGRIEDEKASRNIFEARNKHITNTVTIDLHGQHVQHAMNLLKIHMMICICIPSVLLRVITGCGSEGTWKGKIKRSVIELAEKEHIEWREENSGTVALRLGGPREYRFLEHESDSDLVGNFNID

SEQ ID NO: 8256 - protein, 357 aa, Zea mays
QNVFSARSSKLWSLYFRSLLQRRRDNESKKVSKPREQWRAVGKSVCVTGAGGFIASWLVKLLPCRGQYKVRGTVRDPGASKNAHLKVLEGAGERLQLVKADLLDYSSVASAIAGCEGVFHVASPVPSGRSSNPEVEVIGPAVTGTTNVLKACYEAKVGRVVVVSSCAAVYANPNYPKGKVFDEDCWSDEAYCRKNEDWYFVSKTLAEREAFVYAAKTGLDVVTICPSLVFGPLMQPTVNSSSKIILKYFTGDRETVENILRNMVDVRDVADALLLAYEKPEASGRYICSSHAIKVADMINILKTLYPSYPYPKNFVEDDVNSVYSSEKLQKLGWSFKPIEESLRDTVESYKAFGILN

SEQ ID NO: 8257 - protein, 560 aa, Zea mays
  misc_feature (98)..(98): Xaa can be any naturally occurring amino acid
MGSSGFSWTLPDHPKLPKGKPVAVVVLDGWGEANPDQYNCIHVAQTPVMDSLKNGAPEKWRLVKAHGTAVGLPSDDDMGNSEVGHNALGAGRIFAQGXAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVPGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPPEIDRTSGEFLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 8258 - protein, 151 aa, Zea mays
  misc_feature (5)..(5): Xaa can be any naturally occurring amino acid
  misc_feature (22)..(22): Xaa can be any naturally occurring amino acid
  misc_feature (106)..(106): Xaa can be any naturally occurring amino acid
  misc_feature (117)..(117): Xaa can be any naturally occurring amino acid
  misc_feature (134)..(134): Xaa can be any naturally occurring amino acid
  misc_feature (137)..(137): Xaa can be any naturally occurring amino acid
  misc_feature (141)..(141): Xaa can be any naturally occurring amino acid
MGSSXFSWTLPDHPKLPKGKPXAVVVLDGWGEANPDQYNCIHVAQTPVMDSLKNGAPEKWRLVKAHGTAVGLPSDDDMGNSEVGHNALGAGRIFAQGAKLVDQALXASGKIYDGDGXNYIKESFESGTLHLIGXSSXGGVXSRLDQLQILL

SEQ ID NO: 8259 - protein, 457 aa, Zea mays
MARPPGRRDDIRRHGEEADQPRRRGVGRKPVEMLRRLDQGAAVVPALRSGDSLLQVHAGTQERHEDTEAAARRAQEHGRAQDRGFLRYPSSFMRVFGDDNIISALGPLHRHIRNLVLRLFGPEALRLVMLRDVQRSARDELRSWLDHPDVEVRTATSRMIFAVTAKKLISHDDAASGGSLWKCFDAWTKGLLSFPLCVPGTAFYKCMQGRKNVMKILKQQLDERRNTAERRTVDFFDLVIDELNKPDPIMNENIALDLLFLLLFASHETTSMGLTAILKFLTDNPKALRELTEEHEKIVETKVDPDSDITWEEYKSMRFTSHVIHESLRLANIAPVVFRQANQDVYIKGYTIPEGSKIMICPSAAHLNSKVYEDPTAFNPWRWKDTPEPVGGSKDFMAFGGGLRLCVGADFAKLQMAMFIHCLVTKYSWKPISKGTMVFYPGLRFPEGFHIQLLAKA

SEQ ID NO: 8260 - protein, 211 aa, Zea mays
KCRRVFGRAHEFNIHSVSTNCDGETLVSADDVRINLWHAEVTRQCFNIVDMKPADMEDLVEVITTAEFHPSSCSMLAYGSSSGLVRLVDLRRSALCDHSVRMRDRENRPQPSTFFSEIISCITDLKFTGDGEHLLTRDYMNLKLWDLRVETSPVATYKVHEFLRPKVRTYVRSQFVVTETKNVSESPFGIKEKMVNFSEKKNVVALSDGAA

SEQ ID NO: 8261 - protein, 125 aa, Zea mays
RFRVLCWLGDDDEAEVITTAEFHPSSCSMLAYGSSSGLVRLVDLRRSALCDHSVRMFQDRENRPQPSTFFSEIISCITDLKFTGDGEHLLTRDYMNLKLWDLRVETSPVATYKVHEFLRPKLSEL

SEQ ID NO: 8262 - protein, 484 aa, Zea mays
MAAAAIEAAGRRKGSCFLEVGRREIGSSFPRVSSRRISGSEHIVSSMSQYGKLHGHEGCVNTVSFNPAGDLLVSGSDDTNIILWDWLSKTKKLVYPSGHQDNVFHARVMPFTDDSTIVTVAADGQVRVGRLKEGGEVTTKLVGEHDSRVHKMAIEPGNPYIFYSCGEDGLVQHFDLRSDSATKLFTCCSFLNDRRRVKLNSIVIDPQNPYYFSIGGSDEYARLYDMRKFQLDGSRNTNQPVDTFCPKHLIKGASARVHITSIAYSYAREILVSYNDELIYLFQHNMGLGPNPVSTEPEFFNMLDQPQAYRGHRNFRTVKGVSFFGQHDEYVVSGSDCGNVFIWRKKGGELIRMMNGDKSVVNCIEPHPHFPFMATSGIDNTVKLWTPAAKKLIMPLPKNAKQIIAANELERTVHISQATATLSSDVMMHVLRLLRRRDSEMYIENEPASADLASDDDEAFYFGFEDDAERNERENSDPRECNMT

SEQ ID NO: 8263 - protein, 276 aa, Zea mays
MEAVARSGDYLWRFVAETEWYNEVVLSAVAPGDWWRGLPHPVQSWMRNCVGGYLLYFISGFLWCFVIYYWKRHAYIPKDAIPTNEAMKKQIVVASKAMPFYCALPTLSEYMIESGWTRCYFNISEIGFSMYLCYMAMYLIFVEFGIYWMHRELHDIKPLYKYLHATHHIYNKENTLSPFAGLAFHPLDGILQAIPHVFALFLFPTHFRTHIALLFLEAVWTTNIHDCIHGKIWPVMGAGYHTIHHTTYRHNYGHYTIWMDWMFGTLNEPEDILKKA

SEQ ID NO: 8264 - protein, 317 aa, Zea mays
  misc_feature (310)..(310): Xaa can be any naturally occurring amino acid
PSLLLLLPRIQPPPARRRRESPISPTPRSPRKRGQGTRIPQLPAISGTAMEVAAAAAGKPLTPEEEALRRSTDCVYFLASPLTCKKGNECDFRHSEGARMNPRDCWYWLNGSCLNPKCAFRHPPIDGLFGAPTSGLPPVSAHYGAYNLGKQMVPCYYFQKGNCLKGDRCPFYHGPQTASNDLAEQAAKVSSFPLEPSQAQNNEEAVAPNNSTQQEARMTENRTSIHVSKSGVGATPADVASNALKPGTNFEQAPSNTLAAKKSSTTEDHPMHYQNQVPVEIDPVKDWNQNFEVSPTDYLPQDSREADDIXGESSPGF

SEQ ID NO: 8265 - protein, 81 aa, Zea mays
MGGEATNAGGGGIRARMEHYLYSGEKKHVVAGIAIFAAVFGVPWYFMTRGAKHQSHQDYMEKANKARSERLSSGQSSALKE

SEQ ID NO: 8266 - protein, 251 aa, Zea mays
  misc_feature (29)..(29): Xaa can be any naturally occurring amino acid
GAETLKFNMALILLPVCRNTITWIRNHTXRGRVVPFDDNISFHMVVAAGIAVGAGLHVVSHLTCDFPRLLRATDAAYAPLAQYFGVPRPRNYWWFVKGTEGWTGLAMLVLMAVAFTLAMPWFRRGELALTDLLKRLTGFNAFWYTHHCFVAVYALLLVHGHYLYLTHKWYKKSTWMYLAVPMVLYACERLTRALRSRVRAVRILKVAVYPGDVLSLHFSKPPGFSYKSGQYMFVNCADVSPFEWSPAKVLQ

SEQ ID NO: 8267 - protein, 236 aa, Zea mays
MVNIDPTYGCPLLFSQSQYHSASSHENIISFVAKNSTASSLRLQVFISIALILGDGLYNFIKVLIRTIAGFISMVQQNSKGMLPVSDNGSSMSATEALSFDDERRTEIFLRDQVPKSVAYGGYVVVAAISIGTLPQIFPQLKWYYILVAYVVAPVLAFCNAYGSGLTDWSLASTYGKLAIFVFGAWAGLSHGGVLVGLAACGVMMSIVSTASDLMQDFKTGYLTLASPRSMFVSQV

SEQ ID NO: 8268 - protein, 115 aa, Zea mays
LLSACPPAGVLQPSPRMRDVPKLSPLVAHRVHVDPLSGLEFTSESILTRRLRTKTSKLRMTSLTQTQKTRRTSKARQDLPCQIRGKGITRMMPMDTSKTVRGNSIFLNFGNVPVH

SEQ ID NO: 8269 - protein, 448 aa, Zea mays
MALLVRRARRAATKAAVSLAGRTGSVELAIPAHFRCPISLDLMRDPVTAPAGITYDRESIEAWLDTGRATCPVTHAPLRHEDLVPNHAIRRVIQDWCVANRSRGVERIPTPKIPVTPVQASELLFDLAGSARRRDAAARCAEVVTKIKVLARDSERNRRCFASIGTGRVLAAAFESLAAAAAADAAAPAGRVLEDILAALVCMMPLDEEAARTLALPTSLGSLVAIAENGSLAGRLNAVLAIKEVVSCDGAVTDLSGKADEIVDALAKIIKSPICPQATKAGMVATYHLALYDERVAARLAAAGLVPVLVEVLVDADKSMSEKALAVLDAVLASEEGRASARAHALAVPMLIKKMFRVSDLATQLAVSAMWRLGKAHSDGEDDGAVTRCLVEALGVGAFQKLLLLLQVGCRDATKEKATELLKLLNKYKSVGECVDAVDFRGLNKLSS

SEQ ID NO: 8270 - protein, 440 aa, Zea mays
  misc_feature (263)..(263): Xaa can be any naturally occurring amino acid
MSGWWGASRSSSTAAGRRSPQIEVDAVLLGLPGVAQAVSFKVGLAHSAASLNDAAGPVDLAGLPVHAPENGSHGGGAAGSLSPNDPSDVALFLHTSGTTSRPKGVPLKQRNLAASVRNIRSVYRLAETDATVVVLPLFHVHGLLCALLSSLASGASVALPAAGRFSASTFWADMRASGATWYTAVPTIHQIILDRHASRPEAYPALRFIRSCSASLAPAILERLEAAFSAPVLEAYAMTEASHLMTSNPLPEDGPRKPGSVGXPVGQELAVLDEEGRLVAAGSPGEVCVRGDNVTAGYKGNPEANEAAFRFGWFHTGDIGVVDDQGYVRLVGRIKELINRGGEKISPIEVDAVLLGLPGVAQAVSFGVPDDKYGEEINCALIPRDGSALREEEVLAHCRRNLASFKVPKKVFITDDLPKTATGKIQRRIVAQHFVQPTSA

SEQ ID NO: 8271 - protein, 498 aa, Zea mays
MMIARRLLRSNAPAQASSLLKHVTGTASLQGHADSPLDASVRHFSSAPSAQSDTTEENGFKGHGMLAPFTAGWQSNDLHPLIIERSEGSYVYDINGNKYLDSLAGLWCTALGGSEPRLVKAATEQLNKLPFYHSFWNRTTRPSLDLAQEILSMFTAREMGKVFFTNSGSEANDSQVKLVWYYDNALGRPDKKKFIARSKAYHGSTLISASLTGLPALHQKFDLPAPFVLHTDCPHYWRYHLPGETEEEFATRLATNLENLILKEGPETIAAFIAEPVMGAGGVIPPPKTYFDKVITAFGRLGTMFGCDYYNIKPDLVSLAKALSNAYVPIGATLVSPEISEVIHSQSNKLGSFAHGFTYSGHPVACAVAIEALKLYRERDIPGHVKQIAPKFQDGIRALADSPIIGEIRGLGMIMGTEFTNNKSPADLFPAEWGVGAIFGEECQKRGMLVRVAGDAIMMSPTLIMTPGEVDELVSIYGEALRATEERVSDLKMKSEKN

SEQ ID NO: 8272 - protein, 204 aa, Zea mays
HALASSARFYCTPPQVLLGDVGAGKSSLVLRFVKGQFVEFQESTIGAAFFSQTLAVNDETVKFEIWDTAGQERYHSLAPMYYRGAAAAIVVYDITNAASFTRAKKWVQELQAQGNSNTIVALAGNKADLLDTRQVSADEAKAYAQENGLFFMETSAKTATNVNDVFYEIAKKLLQGQQVQNPQGGMVLNQRPPERMVSSSSCCA

SEQ ID NO: 8273 - protein, 229 aa, Zea mays
MGKRWIPLEANPDVMNQFIWGLGVSERAVQFCDVYGLDDELIALVPHPVLAVLFLYPFTSLDEENKEESSVSATSTAGGKDLSKKVYFTKQTIGNACGTIGVIHAIGNATSQIKLVEGSYFGKLYKQTADMDPVQRAAFLEEDDEMEDAHSIAASAGDTNINLDVNVHFVCFSCVDGELYELDGLKSQPTPHGPSSPETLLQDAAEVIKARIAENPNSMNFNVMALSKK

SEQ ID NO: 8274 - protein, 73 aa, Zea mays
  misc_feature (71)..(71): Xaa can be any naturally occurring amino acid
MIEVVLNDRLGKKVRVKCNEDDTIGDLKKLVAAQTGTRPEKIRIQKWYNIYKDHITLKDYEVHDGMGLELXYN

SEQ ID NO: 8275 - protein, 218 aa, Zea mays
  misc_feature (202)..(202): Xaa can be any naturally occurring amino acid
MAARVLAALALALALALVAVPAPTRASNDEGDALYALRQRLSDPNGVLQSWDPTLVTPCTWFHISCDQVGRVVRLDLGNSNVSGSIGPELGRLVNLKYLELYRNNLDGEIPKELGNLKNLISLDLYANKLTGGIPKSLSKLDSLRFMRLNNNKLTGSIPREFAKLSNLKVIDLSNNDLCGTIPVDGPFSTFPLRSFENNSRXLNGPELQGLVPYDFGC

SEQ ID NO: 8276 - protein, 752 aa, Zea mays
MGCVSSKQFHGGDDHGDGKPRRRPSSNSLKRLVSYSSSKRHEELEEEDEVGAAVAATSSSGGRRAGNDASTARLIRKPPALVVEAVPALSEEAATLAVGVVDAERAVAAATGNRKRPPADVHINGAAEQGLSSVGVRTEGEAKPRIRDVPNGVQGEHVVAGWPRWLTEVAAEAVRGWQPRRAESFEKLDKIGQGTYSSVYKARDLENGKIVALKKVRFANMDPESVRFMAREIHILRRLDHPNVIKLEGLVTSRMSSSLYLVFEYMEHDLAGLAATPGLKFSEPQVKCYMQQLLSGLDHCHNRGVLHRDIKGANLLLDNNGILKIADFGLATFFNPNQKQHLTSRVVTLWYRPPELLLGSTNYGAAVDLWSAGCILAELLSGKPIMPGRTEVEQLHKIFKLCGSPSEDFWANLKLSRATIFKPQHPYRRCVNDVYKDFPTTALTLLDYLLAVEPGNRGTAASALDSEFFTTKPYACDPSSLPKYPPSKEYDAKLRDEEARRQRAAAKGQEAEAGRRKQPPAPDGNSGLQHRRVQVNSKNSTYKFTPKEDVSGFPIDPPARAAADNGYPQRVPLMQAGRSSSTLGRSSGMDPKAQRFHTSQIVTTEMSNQSTASGQRGNAPKMSNLGESARRQYLREHRSSSRYSQLTAADPSDRPEWNHQFQERPSSSHRKDDAAVNKEHTVVNGTKKNRIHYSGPLMPPGVNMDEILREHERQIQQAVRRARLDKGKGKHSGERDQSESLLCTTGNLRADR

SEQ ID NO: 8277 - protein, 148 aa, Zea mays
  misc_feature (11)..(11): Xaa can be any naturally occurring amino acid
  misc_feature (19)..(19): Xaa can be any naturally occurring amino acid
  misc_feature (26)..(26): Xaa can be any naturally occurring amino acid
  misc_feature (38)..(38): Xaa can be any naturally occurring amino acid
  misc_feature (41)..(42): Xaa can be any naturally occurring amino acid
LRLTTTSIKLXKDVMKVSXPCKKKCXRLYAKEGYPLVXIMXXEDEPGPKIGERLLCRHPFNESKRAYVVPQHVEELLKCYWPGNSSNSREELPSIHEIRTRCIHHLDRMRPDHMRRLNPTPYKVSVSAKLYDFIHFLWLNEAPVGELQ

SEQ ID NO: 8278 - protein, 244 aa, Zea mays
  misc_feature (216)..(216): Xaa can be any naturally occurring amino acid
  misc_feature (225)..(225): Xaa can be any naturally occurring amino acid
  misc_feature (229)..(230): Xaa can be any naturally occurring amino acid
  misc_feature (233)..(233): Xaa can be any naturally occurring amino acid
  misc_feature (236)..(236): Xaa can be any naturally occurring amino acid
DMGYKAVGIRLDSGDLAYLSVEARKFFHAVEKEFVVVGFGKTSITASNDLNEETIDALNKQGHEVDAFGIGTYLVTCYAQAALGCVFKLVEINKQPRIKLSEDVMKVSIPCKKKCYRLYGKEGYPLVDIMTGEDEPGPKIGERLLCRHPFNESKRAYVVPQHVEELLKCYWPGNSSNSREELPSIHEIRTRCIHHLDRMRPDHMRRLNPTPYKVSXVSAKLYDFXHFLXXNEXPVXRTAMMKMW

SEQ ID NO: 8279 - protein, 331 aa, Zea mays
MAALLAGGGEGEHKEVRGRLSAAYERHIAPAVKLDVCAREATPGGQQAASRRASKAASEWTTGWWTQFAVLVQRGLKERRHESFNKLRVFQVLSVAALAGLLWWRTPASHLQDRTALVFFFSVFWGFFPLYNAVFTFPLERPMLLKERASGMYRLSSYVASRAATDLPMELGLPTAFVLILYWMGGLDPRPGPFLLSLAVVLYSVLVAQSLGLAIGAVLMDVKQGTTLASVITMVFLIAGGYYVQHIPPFVAWLRWLNYSFYCYRLLLGIQFPDGGGYYDCGHGALCPVAEFPAIKAVGLNNHWVDACVMALMLVGYRVVAYIALDRLKPR

SEQ ID NO: 8280 - protein, 210 aa, Zea mays
  misc_feature (41)..(41): Xaa can be any naturally occurring amino acid
MNQEAKDSRPSRSPSEPNLFLQWGSRKRLRCVKARDDSQLXGSPSPSPSEGLRRAIPRATRPLLGADIAAFRRPSTFNRRKSDSLVNEYRHSMALSLEKDKYYTTRGSPFDGNGFDFGSIAEEKGTTTLPRFFVALSNKEKEEDFMAMKGCKLPQRPKKRPKLMQKCLLMVSPGAWLSDLSHERYEVREKKSSKKRARGLKALTMESDSE

SEQ ID NO: 8281 - protein, 422 aa, Zea mays
  misc_feature (378)..(378): Xaa can be any naturally occurring amino acid
  misc_feature (404)..(404): Xaa can be any naturally occurring amino acid
  misc_feature (413)..(413): Xaa can be any naturally occurring amino acid
MVIRVVNTNMRIIEFLSDLLSSCLGSFLILGRGGIWRAKGGAAAAGFSVGLDCFHRDGAMVGGGGHSSMDHPGAKDDGDGEESQYFSDAEDRSWPSHSRHDSTAYEDYVSLCVSARASSVDADADADGEAVRQHCRKSSCVSEGSLDDVDLEAGLSEIIKASPEKAEQNCRICHLGLESTAAESGAGITLGCSCKGGLILRPQAVRRHLVQDQRQQMPIGWSRHPVCGRRYHFIIRNEYKTCKHCDHCGLMAQSFGTRCSTCKYVISSDDPEDWDYRQLDNPRHLLHGIVHDNGFGHLVRINGREGGSSLLTGIQLMGFWDWLCRYLRVRKVSLMDVSKKYGTDYRILHAITTGHSWYGQWGFKLNKGSFGITSEEYXKAMDNPFLKLISHFFPHSRYPRNQLXDTISFYRSXFKQPLTTIR

SEQ ID NO: 8282 - protein, 513 aa, Zea mays
METASFLSVALALAALVPVSLLLVNRLLYGKLPPGPRRRPVVGNLFDVQPVRCRCYQEWARRYGPIMTVWLGTSPTVVVSTSELAKEVLKTHDQQLADRCRDRSTESFSRGGQDLIWADYGPHYIKVRKLCNLELFTQRRLEALRPIREDEVTAMVESVYKAVTAPGSAGKPLVVKNHLSMVAFNNITRLAFGKRFVDAAGELDEQGREFKGIVHNGIKIGASLSIAQHIPWLRWLAPVDEQAFKAHGERRDRLTVKIMEEHARALKQRGAQQHFVDALFTLRDKYDLSDDTVIGLLWDMITAGTDTTVISVEWAMAELLRNPRVQEKLQEELDRVVGRDRVLSETDFPNLPYLQAVVKESLRLHPPTPLMLPHRASASVKIAGYDIPKGANVVVNVWAVARDPEVWDSPLEFRPERFLGENIDIKGADFRVLPFGAGRRVCPGAQLGINLVASMIGHMLHHFTWTLPSGTCPEDVSMMESPGLVTFMATPLQAVATPRLDKEELYRRVPSDV

SEQ ID NO: 8283 - protein, 255 aa, Zea mays
  misc_feature (197)..(197): Xaa can be any naturally occurring amino acid
  misc_feature (204)..(204): Xaa can be any naturally occurring amino acid
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYIAVRFLIGFSLATFVSCQYWMSTMFSSKIIGTVNGLAAGWGNMGXRRHAAHXMPLVYDVIRKCGATPFTAWRLAYFVPGLMHVVMGVLVLTLGQDLPDGNLRS

SEQ ID NO: 8284 - protein, 516 aa, Zea mays
MVGFCSLRTEDSTRKRRRMTQACAEACPRSRSCREGRYLLGKGAKVIFSSHLGRPKGFTPKFSLAPLVARLSELLGIQVQKADDVIGPEVEKLVAALPNGVAVLRERVRFYKEEEKNEEHSAPELEGKRVFVRADLNVPLDENQNITDDTRIRAAIPTIQYILSKGAKVILSSHLGRPKGFTPKFSLAPLVGRLSELLGIQVQKADDVIGPEVEKLVAALPNGGVLLLENVRFYKEEEKNDPEFAQKLASLADLYVNDAFGTAHRAHASTEGVTKFLQPSVAGFLLQKELDYLVGAVSSPKRPFAAIVGGSKVSSKIGVIESLLEKCDILLLGGGMIFTFYKAQGLPVGASLVEEDKLELATSLLAKAKEKGVSLMLPTDVVIADKFAPDANSQIVPASAIPDGWMGLDIGPDSVASFNAALDTTKTVIWNGPMGVFEFDKFAVGTEAVAKKLAELSGKGVTTIIGGGDSVAAVEKVGVADVMSHISTGGGASLELLEGKELPGVVALNEAATVTV

SEQ ID NO: 8285 - protein, 115 aa, Zea mays
MPCLNVSTNVNLEGVDTSAILAEASKSVANIIGKPEAYVMVVLKGSVPMAFGGTQEPAAYGELVSIGGLNPDVNKKLSAGIASILESKLSVPKSRFYLKFYDSKRSDFGWNGSTF

SEQ ID NO: 8286 - protein, 302 aa, Zea mays
MEPGSTPPNGSAPATPGTPAPLFSSGGPRVDSLSYERKSMPRCKCLPLPAVEGWGVATHTCVVEIPAPDVSLTRKLGAEFVGTFILIFFATAAPIVNQKYGGAISPFGNAACAGLAVATVILSTGHISGAHLNPSLTIAFAALRHFPWLQVPAYVAVQALASVCAAFALKGVFHPFLSGGVTVPDATVSTAQAFFTEFIISFNLLFVVTAVATDTRAVGELAGIAVGAAVTLNILVAGPTTGGSMNPVRTLGPAVAAGNYRQLWIYLLAPTLGALAGASVYKAVKLRDENGETPRTQRSFRR

SEQ ID NO: 8287 - protein, 471 aa, Zea mays
  misc_feature (147)..(147): Xaa can be any naturally occurring amino acid
MEADSGKLFVGGISWETDEDRLRAYFGRFGEVTEAVIMRDRNTGRARGFGFVVFADSGIAERVTLDKHMIDGRMVEAKKAVPRDDQSIASKNNSSIGSPGPGRTRKIFVGGLASNVTEVEFRRYFEQFGVITDVVVMYDHNTQRPRXGFGFITYDSEDAVDKALHKNFHELNGKMVEVKRAVPKEQSPGPIARSPAGGQNYAMSRVHNFLNGFNQGYNPNPLGGYGMRVDGRYGLLTGARNGFSSFGPGYGMGMNAEGGMSAYFGASSGFANSSNGRQIGSYFNSSSNRLGSPIGYVGLNDDSGSILSSMSRNVWGNGNLNYTGNPTNTNSFAPPVGGGGIPGDEISWGNLTSVHGMGNISSLGPGNLGRGTGDNNFGLPSGTYVRSNSTGTIGEPFSASANPYESNNLGAYGSSSIYGDSTWRFNSSEVDIPPFGHDLGNVDPDIKSEISANYMGNYTVNNNQTSRGITS

SEQ ID NO: 8288 - protein, 433 aa, Zea mays
  misc_feature (391)..(391): Xaa can be any naturally occurring amino acid
MSYHCRVLVPVPFPYPPGAGAPAPSLGVGASAGPPFPSASRALRLPRPRASVEKREQVAAMEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFVGSCRSCDSCGKGDDNYCAGIVLTSNGVDHAHGGAPTRGGFSDVLVASEHYVVRVPDGLALDRTAPLLCAGVTVYSPMMRHGLNEPGKHLGVVGLGGLGHVAVKFGKAFGMKVTVISTSASKRQEAIENLGADEFLISRDENQMKAATGTMDGIIDTVSAWHPITPLLALLKPLGQMVIVGAPSKPLELPAYAIVPGGKGVAGNNVGSVRDCQAMLEFAGKHGIGAEVEVIKMDYXQHGHGAAREERRPLPLRHRRRRQPRLCRLGVAAKVSIRAQPQ

SEQ ID NO: 8289 - protein, 256 aa, Zea mays
  misc_feature (69)..(69): Xaa can be any naturally occurring amino acid
  misc_feature (196)..(196): Xaa can be any naturally occurring amino acid
  misc_feature (206)..(206): Xaa can be any naturally occurring amino acid
MATVSLTPQAVFSTESGGALASATILRFPPNFVRQLSTKARRNCSNIGVAQIVAAAWSDCPAASAAAAXAASAAAEVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVXPAGGHIVTTXDCYRKTRIYMETELPKRGISVILCYPLSSTCFWNGISAIPINRLPVTVLQ

SEQ ID NO: 8290 - protein, 485 aa, Zea mays
  misc_feature (65)..(65): Xaa can be any naturally occurring amino acid
  misc_feature (189)..(189): Xaa can be any naturally occurring amino acid
  misc_feature (215)..(215): Xaa can be any naturally occurring amino acid
  misc_feature (224)..(224): Xaa can be any naturally occurring amino acid
MATVSLTPQAVFSTESGGALASATILRFPPNFVRQLSTKARRNCSNIGVAQIVAAAWSDCPAARXASAAAEVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSAXLVPAGGHIVTTTDCYRKTRIKMEPEXPKGEFRMTXLACCDMDALQNALDNNNVSLFFTETPTNPFLRCIDIEHVSNMCHSKGALLCIDSTFASPINQKALTLGADLVIHSATKYIAGHNDVIGGCVSGRDELVSKVRIYHHVVGGVLNPNAAYLILRGMKTLHLRVQCQNNTALRMAQFLEKHLKIARVYYPGLPSHPEHHIAKSQMTGFGGVVSFEVAGDFDATRKFIDSVKIPYHAPSFGGCESIIDQPAIMSYWDSKEQRDIYGIKDNLIRFSIGVEDFEDLKNDLVQALEKI

SEQ ID NO: 8291 - protein, 194 aa, Zea mays
MARGLWLLSREVGRLRPLLVQGQARGISASAQEQLHVCVVGSGPAGFYTADRMLKGHDGAQVDIIDRLPTPFGLVRSGVAPDHPETKIVVNQFSRVATNGRCSFFGNVTLGRDISLSELRKTYHAVVLAYGAESDRSLGIPGEDLKGIHSAREFVWWYNGHPDMCDFCPDLKNTESAVVLGQVFFLFFDFPHMR

SEQ ID NO: 8292 - protein, 450 aa, Zea mays
MRGSMSNYYDDYDDIDEIEDDYDMDDPADDMVDEQRGVRDSDAEDNDYGQPNDKIPDTSSADARNGRDIQGIPWEQLNITRKKYRQSRLEQYKNYENVPNSGEEAMKDCKPTEKGGMYYEFRRNTRSIKSTILHFQLRNLVWATSKHDIYLVSHYSIRHWSALSGVDTELINVQGHVAPREKHAGSLSEGFYQTQVSTLAVKDNLLVAGGFQGELICKHLDQEGISFCCRTTYDDNAITNAVEIFNTSSGAVHFMASNNDSGVRYYDMERFQLFKHFQFEWPVNHASLSPDRKVVVIVGDDPDGLLIDANSGKTVHSIKGHRDYSFASAWSPDGRTFATGNQDKTCRIWDVRNLSKSVHVLRGNLGAIRSIRFTSDGQFMSMAEPADFVHIYDVKSDYNKRQELDFFGEISGTSFSPDTDTLFVGVWDRMYGSLLQFGRLYNYSYLDSLF

SEQ ID NO: 8293 - protein, 566 aa, Zea mays
MDQLVNFIIRPPRADYSPNDDLLEQEFMLKGRWFLRKDLEVKNGQGKKLQCSHYMPVVIPEGKALPCVIYCHGNSGCRADASEAAIILLPSNITVFTLDFSGSGLSEGEHVTLGWNEREDLKAVVNYLRTDGNVSCIGLWGRSMGAVTSLMYGAEDPSIAGMVLDSPFSNLVDLMMELVDTYKYPLPKFTVKLAIQHMRKIVKRKASFDIMDLDTIQVAKQCFVPALFGHATEDDFILPHHSDKIYESYIGDKNIIKFDGDHNSPRPQFYFDSITIFFHNVLNPPEVAEDHYFMTPHGSLGQGHWDTEQDIEYRFSQSPTGTANATTTEDAIAQLRSRRLMSRMEVPSGATTEDRTDRTEGFDSDLGPSSSSVSTATPPNGRNGRLLTPTSDDGEYVEYSFDSLSDMPHTVEDEDRMLMQAILESLKDYEQSNTKNVQSTASDPASKANGTVKDCNGVAAAALEQDASSFDAPDKHTNVPNSGEKVSEGQSTDCNAGKSSASVSASGSSEPLAPTQMVNGQPASVDSQKVTQNANGEDGTRATLVVQKSRTGGLIEKWGSFFKNND

SEQ ID NO: 8294 - protein, 328 aa, Zea mays
MDLASSDLAALGAAELVRVSASIPRAAPRTFALLTACLVFPLSFAVLAHSLFTHPILLRIQGATHSELAQWLRLFAYQFLYLIVLFTFSLLSTAAAVFTVASLYANKPASISSSLTALPPILPRLLRTFLWVSLLMLAYHLVFALTVLLLIVVFIPNASESESAPPSLAFVLFLVVVVFVFLGIHVYISALWHLASVISVLEPLCGLAAMAKSKDLLQGRTGTAATLVVSYFAVCGVTSVLFRAAVVKGRAEEGSFGLALPGRLLVGAVLLCVLVCVNLLGLLVQSVFYYACKAFHNQQIDRTALYEHLGGYLGEYVPLKSNIQMENL

SEQ ID NO: 8295 - protein, 292 aa, Zea mays
MGKDDVVQSGAGGGEFAAKDYTDPPPAPLVDAAELGSWSLYRAVIAEFIATLLFLYVTVATVIGYKHQTDASASGAGADAACGGVGVLGIAWAFGGMIFVLVYCTAGISGGHINPAVTFGLFLARKVSLVRALLYMVAQCLGAVCGVGLVKAFQSAYFDRYGGGANSLASGYSRGAGLGAEIVGTFVLVYTVFSATDPKRNARDSHVPVLAPLPIGFAVFMVHLATIPVTGTGINPARSLGAAVVYNKDKPWDDHWIFWVGPLLGAAIAAFYHQYILRAGAIKALGSFRSNA

SEQ ID NO: 8296 - protein, 216 aa, Zea mays
  misc_feature (39)..(41): Xaa can be any naturally occurring amino acid
  misc_feature (67)..(69): Xaa can be any naturally occurring amino acid
  misc_feature (80)..(87): Xaa can be any naturally occurring amino acid
AVLTQPPCSYEYGQFNDADAIPTNEAMKKQIAVASKAMXXXCALPTLSEYMIESGWTRCYFNISEMXXXAYLCYMAMYLXXXXXXXXWMHRELHDIKPLYKHLHATHHIYNKENTLSPFAGLAFHPLDGILQAIPHVLALFLLPTHFRTHIALVFLEGVWTTNIHDCIHGKVWPVMGAGYHTIHHTTYRHNYGHYTVWMDWMFGTLREPDDILKKA

SEQ ID NO: 8297 - protein, 94 aa, Zea mays
MVEAAGVRIERGRGGRTPRGGRGGGGRGGRGGGMKGGSKAVVVAHKHAGVFISKSKEDALCTKNMVPGESVYGEKRVSVQNEDGTKVEYRVWNP

SEQ ID NO: 8298 - protein, 329 aa, Zea mays
MMGGFLSRVLLLAFGYAYPAYECYKTVELNKPQIEQLIFWCQYWILVALLTVLERFGDFTISWLPFYSEAKVLFFVYLWYPKTKGTTYVYGTFFKPYISQHENEIDRNLLELRARATDMVVLYFHKAASVGQNTFFDVLKYVAAQSPSRKSRLHPHQEPQQQQPQVQVELQQPQPQKQAAPVMRRGASIAARQAAMAQQSLETIPVPSSPKIKRQTSGRPGSVASTKPAAAASTPKPGGSPKKGEVKPAVDPVQTPATSADSPKSEPSAPPLSETEEVDNMAIDEVSGDAAEGAEELDPALEETLMEETIRVTRAKLRRRTATEDSAGN

SEQ ID NO: 8299 - protein, 234 aa, Zea mays
ELRHEAETHGGDKRSQSSKPPPSSPVRFLMEPLPSAPAAGVGAPGPGPGYPESTESSPRSRGGDSWDEPFPSSAAAVAGGGGRLRLMCSFGGRIVPRPTDKSLCYLGGETRIVAVDRHASLADVHARLSRSLLGGRPFTLKYQLPNEGLDSLISVSTDEDLDNLVDEYDRIAATSSGSGSSRTSRIRLFLFPATPESSSSLGSLLDDSSKSENWFVDALHSAISGSLDGIPRGI

SEQ ID NO: 8300 - protein, 273 aa, Zea mays
CVDVIKMGGKVSCMITHGPWVLIGIPKFVEAWNTKTGMKLRFQGPSSLVCSMAITNEMLFAGTRDGRIMAWRFPAKDSNTEPVLILSGHQRPVISLSISARRLYSGSLDKTIKAWGLTTRQCVQTLSEHKATVTSVLCWDEKLLSCSLDKTIKLWTQSESGNLQVKYAHAEENGLCTLFGMHQVGKTPVLFCSLHNSNCVRLLDLPSNAGCQEANSCHWITGVGAHCMWQGNSNSTDDNLQNEDANDASRWPISLVLSLMVMEYPTEHLVYHT

SEQ ID NO: 8301 - protein, 221 aa, Zea mays
PEREGIFVVSHADGNLYVYDKFKDGNTDWTFPTVKDQSQVLISHAKSSKGNPIARWHICQGAINGISFSPDGAYLATVGRDGYLRVFDFTKEQLIFGGKSYYGALLCCSWSADGKYLLSGGEDDLVQVWSMDDRKIVAWGEGHNSWVILSLQLFLAFFYGHTKSPQKIINSFFFLSPLLRVTESKASFCSPALPHPPRLIPNPTTSSLASMALPLASPAGA

SEQ ID NO: 8302 - protein, 131 aa, Zea mays
MKNVAKCDTWCELQNPANHRVFERKLRPKPSGGGHVARGRPGHGSKTNYPRCPPSRRRRKSPSSPARQMAGGRVAHATLKGPSVVKEIFIGLTLGLIAGGMWKMHHWNEQRKTRSFYDMLDKGQISVVVEE

SEQ ID NO: 8303 - protein, 122 aa, Zea mays
PRVRGRVGVYAWAATAALSRVAETVFIHEAGHLRCSRSEIGRFVSMLRNPSPILRACADFDLLQFTIPGGRHAMHHAGLLQEAGACRLLRAVAAATTASIEAKIFARIVPRNLEHHQLGMST

SEQ ID NO: 8304 - protein, 182 aa, Zea mays
MEAGGEEFAIGVVISAKTTLGEEFEGQIVAFDRPSNLLVIQEGVGRAERGERRNVRVLKANYIREFSVVSKGDDPLDPASCMLDLNSIYAREDTALRQAEIEAEPAGVGATPEAQSIFDALSKTLPVQWDKTDIVVMKEVRVRSPYLPENVNGGTAAANERVKKVIDFERKRLHSRVPGQFS

SEQ ID NO: 8305 - protein, 411 aa, Zea mays
  misc_feature (89)..(89): Xaa can be any naturally occurring amino acid
  misc_feature (253)..(253): Xaa can be any naturally occurring amino acid
  misc_feature (277)..(277): Xaa can be any naturally occurring amino acid
  misc_feature (318)..(318): Xaa can be any naturally occurring amino acid
PPPPPPPATAAPAPPQPSATAAVDRSSPDPDALYEEGMWQQMAMDSGATMQPGSYPERPGEPDCTYYLRTGLCRFGMSCRFNHPPDRNXMKGEYPERAGQPECQYYLKTGTCKFGPTCKFHHPREKAGIAGRVQLNTSGYPLRPNEKECAYYLKTGHCKYANTCKFHHPELFNVVPSSRGSPIYTSVHSSASAGPQSYTGTMPSWAFPRASFIPSPRWQSPSNYAPMIVPQGLVQMQSWNSYTGQLQSPGAQXQTYGSSQQGEASTGNQGMLSPYRXSSFPVPQYALQRENVFPERPDEPECQYYMKTGDCKFGAVCXKFHHPRVRSLPPPDCVLSPMGLPLRPGEELCKFYSRYGICKFGANCKFDHPTVVAPMVYAYGFSASASPASASTNVPMARRPLGSPPGSGYTS

SEQ ID NO: 8306 - protein, 173 aa, Zea mays
MDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLTGVTIAHGGVLPNINPVLLPKKTAEKASSGGSKEAKSPKKAAKSPKKGIGFGGGSDVVMCRL

SEQ ID NO: 8307 - protein, 570 aa, Zea mays
  misc_feature (36)..(36): Xaa can be any naturally occurring amino acid
MAAAAEIGGFAAARVAVATLRPAAHPAPAAAVAPQXPRRAVAAQSLQTTATEALTADLAGTTNGAVHARMNSKATSEITSQAVTANSRRKTKIVCTIGPSTNTREMIWKLAETGMNVARLNMSHGDHQSHQKVIDLVKEYNAQNTDGNVIAIMLDTKGPEVRSGDVPEPIMLKEGQEFNFTIKRGVSTEDTVSVNYDDFINDVEAGDILLVDGGMMSLAVKSKTADTVKCKVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEDVPLLQAEIVQTCRSMEKPVIVATNMLESMIDHPTPTRAEVSDIAIAVREGADAIMLSGETAHGKYPLKAVKVMHTVALRTESSLYNPTTSPSLVASAQGLQNEDFSASQLSKMFGSHATMMANTLRTPIIVFTQTGSMAVLLSHYRPSSTLFAFTNEERVKQRLALYQGVIPIHMQFSDDAEETFSRAISSLLKAQYVKKGDYVTLVQSGVTSIWREESTHHIQVRKVQV

SEQ ID NO: 8308 - protein, 214 aa, Zea mays
  misc_feature (13)..(13): Xaa can be any naturally occurring amino acid
SPCSSSSSTTAAXAPRLPRRTARARPLRFLSCSTSAPPLFAAVASMDSPPQGYRTNVGICLADPSLTKIFSASRIDIPSAWQMPQGGIDAGEEPRAAAFRELREETGVTSAEIVAEAPVWLTYDFPPDVRTKLNARWGTDWKGQAQKWFLFRLTGNDDEINLNGDGSEKPEFGEWTWMTPKEVIEKAVDFKKPVYEEALKHFAPYLQSDPAASS

SEQ ID NO: 8309 - protein, 355 aa, Zea mays
MAAAAAQKAETKKSAVAPAGKAAQPAATTEVPTKPAPPSQTVRDARGGGSSARGGFGRGERGRGRGGRGYGQNRGFSGDNGNDFQGGYGGGGYGDGAVTGGSEGERERDTRPPYRGGGRRGGYRNVEFADDSERPPRRNYERHSGTGHGYEMKRDGAGRGNWGTATDELIAQDAEDSPKMEEAAPVAEKQGEQNDAPAADENKDNKDATANEEEEKEEDKEMTLEEFEKIREEKRKALLALKAEERKVEVDKDLRSLQPLSNKKENDEVFIKLGSDKDKKKENAERDERAKKSVSINEFLKPAEGERYYGGRGRGRGRGDRGGFRGGYGGGYSRGPAAAAPSIEDQAQFPSLGGK

SEQ ID NO: 8310 - protein, 326 aa, Zea mays
MATLNPFELLGADDNDDPTQLIAAAAAAAQKAEAKKSAVAPAGKAAQPAATTKFPTKPAPPSQTVRDARGGGSSARGGFGRGERGRGRGGRGYGQNRGFSGDNGNEFQGGYGGGGYGDGAVTGGSEGERERETRPPYRGGGRRGGYRNVEFADDSERPPRRNYERHSGTGHGYEMKRDGAGRGNWGTATDELIAQDAEDSPKMEEAAPVAEKQGEQNDAPAADENKDNKDATANEEEEKEEDKEMTLEEFEKIREEKRKALLALKAEERKVEVDKDLQSLQPLSNKKENDEVFIKLGSDKDKKKENAERDERAKKVCIVVANQSSF

SEQ ID NO: 8311 - protein, 266 aa, Zea mays
  misc_feature (24)..(24): Xaa can be any naturally occurring amino acid
  misc_feature (161)..(161): Xaa can be any naturally occurring amino acid
  misc_feature (165)..(165): Xaa can be any naturally occurring amino acid
  misc_feature (201)..(201): Xaa can be any naturally occurring amino acid
  misc_feature (213)..(213): Xaa can be any naturally occurring amino acid
  misc_feature (230)..(230): Xaa can be any naturally occurring amino acid
  misc_feature (243)..(243): Xaa can be any naturally occurring amino acid
MVTSSKGKVCVTGASGFVASWLIXRLLESGYHVVGTVRDPAHLWKLPGAKERLQIVRADLLEEGSFDSAVMACEGVFHTASPVLAKPDSTSKEETLVPAVNGTLNVLRSCKKNPFLKRVVLTSSSSAVRIRDDGGQSSSNISLDETTWSSVPLCEKMHLWXALAXVFAEKAAWEFAKENGIDLVTVLPSFVIGPSLSHELXVTASDVLGLFQXDTARFSSYGRMGYVHIXDDVASSHILVYEXFFFFFFNMAHVHMGLNNLKLEKV

SEQ ID NO: 8312 - protein, 1235 aa, Zea mays
MKASAQESIQPAKGFAASDLALNGLAAVTPGGLLALTNATFQAKAHAFRPAPVHFLNASSSAAAATARARARSFSTCFVFAIVSAYEGLSDHGLAFVVAPTTSFSAAKAGQYLGILGAINGTASDPVLAVELDTILNPELSDIDSNHVGVDVNSLVSEQAMPAGYYDDAAGGAIRELQLNSRKPMQVWIDYDGQAGRLDVTLAPVRVPKPSRPLVSTAVDLSTIVGRGGPMYVGFSSATGVVATHHYVLGWSFGLDGPAPPLDMSKLPVLPRVGPKPRSKVLDVLLPLATALVVAAALAAISFAMWRRRRFAEVREDWEDEFGPHRFSYKDLFHATNGFDAVNLLGVGGFGRVYKGVLPASPALEIAVKKVSHGSRQGVREFVAEVVSIGRIRHRNLVQLLGYCRRRGELILVYDYMANGSLDKYLYDQHVPALSWHERYRIIKGVAASLLYLHEDWEQVVIHRDVKASNVLLDHEMNGRLGDFGLARLYDHGTDPQTTHVVGTMGYLAPELVRTGKATPSTDVFSFGVFLLEAACGRRPIDRDRQVVLVDWVIEHHRDGSVLDVVDPRLVGKYEAEEATLVLKLGLMCAHPLPNVRPSMRRVVQYLDSDQAVPDLSPNYTSYSIMSLIQNDGFDSYITSSHPTDQELQCGAAQSRAVMATVLLPLLLLLGSAVTLLTCAGAGASFPVNVWPKPTSMSWAEPHAAVPVSPSFHIVASSGNPYLASAAERYAKLLFRETYRPIVRPAVNVTAGNALEKLTVAVSDLAAPLQHGVDESYTLEILPTGAATVTAATAWGAMRGLETFSQLSWRAGRGDLLLVAAGVRVEDRPLYPHRGLMLDTGRTYFPVADILRTIDAMAANKMNVFHWHITDSQSFPIVLPSEPSLAEKGAYGENMRYTVEDVERIVEFAMSRGVRVVPEIDSPASWAGAYPEAVTCAGKFWLPDGDWNHRLAAEPGAGQLNPLAAKTYEVITNVVNDLTSLFPDGFYHAGADEVTPGCWEADPTIQADLERGATLSQLLERYVSAVHPLVVSRNRTAVYWEDVLLDAAVNVSASAIPPATTVLQSWNNGPNNTKLIVQAGYRAIVSSASFYYLDCGHGDFVGNNSIYDDPNSDFDANGGSWCGPYKTWQRVYDYDIAYGLTPEEAQLVLGGEVAMWTEQVDTTVLDGRVWPRASAMAEALWSGNRDASGRKRYAEATDRLIDWRQRMVGRGPAPPSDPTPFTTPLLFEEIDIQQV

SEQ ID NO: 8313 - protein, 679 aa, Zea mays
AKLLSLVVLLLLIHVSVPSSSADVGHQFIYQGFAASDLALNGLAAVTPGGLLALTNATFQAKAHAFRPAPVHFLNASSSAAAATARARARSFSTCFVFAIVSAYEGLSDHGLAFVVAPTTSFSAAKAGQYLGILGAINGTASDPVLAVELDTILNPELSDIDSNHVGVDVNSLVSEQAMPAGYYDDAAGGAIRELQLNSRKPMQVWIDYDGQAGRLDVTLAPVRVPKPSRPLVSTAVDLSTIVGRGGPMYVGFSSATGVVATHHYVLGWSFGLDGPAPPLDMSKLPVLPRVGPKPRSKVLDVLLPLATALVVAAALAAISFAMWRRRRFAEVREDWEDEFGPHRFSYKDLFHATNGFDAVNLLGVGGFGRVYKGVLPASPALEIAVKKVSHGSRQGVREFVAEVVSIGRIRHRNLVQLLGYCRRRGELILVYDYMANGSLDKYLYDQHVPALSWHERYRIIKGVAASLLYLHEDWEQVVIHRDVKASNVLLDHEMNGRLGDFGLARLYDHGTDPQTTHVVGTMGYLAPELVRTGKATPSTDVFSFGVFLLEAACGRRPIDRDRQVVLVDWVIEHHRDGSVLDVVDPRLVGKYEAEEATLVLKLGLMCAHPLPNVRPSMRRVVQYLDSDQAVPDLSPNYTSYSIMSLIQNDGFDSYITSSHPYMTNSIVVSSASVLSQGR

SEQ ID NO: 8314 - protein, 293 aa, Zea mays
MMPYGTAAEAEAALGRSMTWAEALWFRYSAGMPDLCLTWHVSLVYLVLYALVPLPVMVIQKLAPGYALRHKLQPGVPEPSPVSTYVEYIRDSRGVTLAALGPFPLIYSIAFKLFGVRTGLPLPSVWETATHLAVYSLVEDYTSYWLHRFLHTRWGYEKIHRVHHEKTAPSGFAAAYATGTELSLYLTTLFLGPAIVPSHVTTHWLLFSIRIMEAFDTHSGYHFPFSLARFIPFYGGAEFHDYHHYAGEKTRSNFSSVFTYCDYIYGTNKGYMYHKRSLAELKTKEAEHSGKED

SEQ ID NO: 8315 - protein, 254 aa, Zea mays
RPPCRSPSSVLPLLLPLPPSVRVQIPPPQSICRPPAWRRGRGRGRREGGREPWRWRSCSRSRGANSEGDALSALRRSLRDPGGVLQSWDPTLVNPCTWFHVTCDRDNRVTRLDLGNLNLSGHLVPELGKLEHLQYLELYKNSIQGTVPSELGNLKNLISLDLYKNNISGTIPPALGKLKSLVFLRLNGNHLTGPIPRELAGISSLKVVDVSSNDLCGTIPTSGPFEHIPLSNFEKNPRLEGPELQGLAIYDTNC

SEQ ID NO: 8316 - protein, 268 aa, Zea mays
MASVEGKRETVLVTGASGFIGSTLVGLLLDRGYNVHASVLNPDDKAETEHLVALGAGAGEGRLRVFPGDLLDGAALMAAARGCSGVFHLATPCTVYPVSDPQGQMVVPAVEGTLNVLRAAKEARTVRRVVVTSSSSAIIPSPAWPAGEPRDERCWADVDYCKKNEVWYPVSKTLAEKAAWRFAEENGVDVVVVNPVTAMGPMIPPTINCSMIVLLRLLQGCPGFFRPNGEWVTCFCSWHWHGGSEVYFGKDRVAEERASCPFYTQESR

SEQ ID NO: 8317 - protein, 194 aa, Zea mays
MALVGQVATVAQLVGVDAFSLITMIAEAAQTARRNRAVCRQLARRVEMIGSLLRRLREQDDNDDMRLLRHAETRGPVEALEETLRRAYLLVRSCQRRGYAFRCLMGARHADELREMQGEIGFYLDLFPLISYVDWARRRGNGNGKAACGDTRSLQEAPMVRPCLVPFLFLSLLRWMQLFREYVMHLLCLSAYVY

SEQ ID NO: 8318 - protein, 200 aa, Zea mays
MALVGQVATVAQLVGVDAFSLITMIAEAAQTARRNRAVCRQLARRVEMIGSLLRRLREQDDNDDMRLLRHAETRGPVEALEETLRRAYLLVRSCQRRGYAFRCLMGARHADELREMQGEIGFYLDLFPLISYVDWARRRGNGNGKAACGDTRSLQEAPMVRLPCLVPFLFLSLLRWMQLFREYVMPLVCMHLLCLSPYVY

SEQ ID NO: 8319 - protein, 137 aa, Zea mays
AAAMANGLGGADEASPAPVSPEQLDVEAYAAQYSGRTRLARGVFVADRCGVEAIQLEALRMAYDEIKRGEDVQLDRDVAAKIGGRLGPRYGLDQAWVDTITRRADQRNEKLENELNGYRVRKPDPFILRRTTCCVMA

SEQ ID NO: 8320 - protein, 135 aa, Zea mays
AAAMANGLGGADEASPAPVSPEQLDVEAYAAQYSGRTRLARGVFVADRCGVEAIQLEALRMAYDEIKRGEDVQLDRDVAAKIGGRLGPRYGLDQAWVDTITRRADQRNEKLENELNGYRNNNIRRVHPANFSRTG

SEQ ID NO: 8321 - protein, 327 aa, Zea mays
MEGAAGIRTRPAVCVTGAGGFVASWLVERLLAGGRYMVHGTVRDPGDAKNAHLAAMDGAADRLRLFRAELLDYGSVAAAIAGCDGVFHVASPVPMTYPIGDPEVELLAPAVTGTKNVLKACSEAKVKRVVVVSSVAAVMVNPGWPQNEAMDEACWSDVEFCRTTQNWYCLSKTLAELEALDYAKRSGLDVVSVCPSLVIGPLLQSTVNASSSVIVDCLKGDREVKLKLRNFVDVRDVADALLLVYETPEASGRYICHANARQMSEVVALLKDWYPAYSHAATKFVQVSDEPLFSSKKLQALGWKFRTLEESLRDSVESFKAAGVLVD

SEQ ID NO: 8322 - protein, 401 aa, Zea mays
  misc_feature (188)..(188): Xaa can be any naturally occurring amino acid
MNGEPSNVDPARSEVVMQNGGIRMLLDLARCSRESAQSEAAKAIANLSVNTKVAKAVADEGGITILTDLAKSMNRLVAEEAAGGLWNLSVGEDHKASIAVSGGIKALVDLIFRWPAGTDGVLERAAGALANLAADDKCSLEVAKAGGVHALVTLARSCKLDGALEQAAISLANLAAHADNNDNNAAVXLARSEVEDVHETAAGALWNLAFYSRLALRIVYEWMVPVLVKICQSSAIYVGLQERAAGALWGLSVSEANSIAIGQGGGVAPLLTLARSEVEDVHETAAGALWNLAFYSGNALRIVEEGGVPVLVKICSSSGSKMARFMSALALAYMFDGRMDEVALVGASSASSSKSVNSCREQGQAFKHIETFVLTFSSIEAKIFARVVLRNLEHHQLGMST

SEQ ID NO: 8323 - protein, 594 aa, Zea mays
HASGVFHQCNWSHKDKIAGDITTWLEWILSQSLLRIAESNPQGMDGFWLQKGTTLLLRLLKSLQEDVQERAATALATFVVMDDETANVDPARSEAVMQNGGIRMLLDLARCSRESAQSEAAKAIANLSVNTKVAKAVADEGGITILTDLAKSMNRLVAEEAAGGLWNLSVGEDHKASIAVSGGIKALVDLIFRWPAGTDGVLERAAGALANLAADDKCSLEVAKAGGVHALVTLARSCKLDGALEQAVIKKISGLANLAAHGDNNDNNAAVGQEAGALEALVQLTGSQNEGVRQEAAGALWNLSFDDRNREAIAAVGGVEALVALVQQCLNASEGLQERAAGALWGLSVSEANSIAIGQGGGVAPLLTLARSEVEDVHETAAGALWNLAFYSGNALRIVEEGGVPVLVKICSSSGSKMARFMSALALAYMFDGRMDEVALVGASSASSSKSVNIEGARRIAFKHIETFVLTFSDPQMFSTAAASSAPAALSHVAEAVFIQEAGHLRCSRSEIGRFVVMLRNPSPILRACAAFALLQFTIPGGRHAVHHAGLLQEAGAGRVLRPAAAATTASIEAKIFARIVLRNLEHHQSGTST

SEQ ID NO: 8324 - protein, 244 aa, Zea mays
MENQGPKPIRCKAAVCRAAGEPLAIEEVVVDTPKAHEVRIRIICTSLCHSDVTFWRMKDLPDNIPRIFGHEAFGVVESVGEQVDEFAAGDAVVPTFLGQCSECVDCRSARSNMCSKYRFAVRPGMPRDGTTRFTDGQGRPLHHFFGVSSFAEYTVVDVNQVVKLNPAVPPALACLLSCGASTGVGAAWKQAKVEPGSSVAIFGLGAVGLAVAEGARICGASKIIGVDINPEKCELGKHICPCLD

SEQ ID NO: 8325 - protein, 215 aa, Zea mays
LLHPGLAFPGADRAGMDELEMDEEVRPEFPCPYCYEDHDVGSLCAHLEEEHPFEPQAAACPVCSEMVTKDMVNHITTQHGYLFKNRRRLRRFIIPGSQALSLLSRDLREAHLQVLLGGGGQRSSDNSSSSATNISADPLLSSFGLGFPTSDAEQASKSTVSIPDDATTVKEAPAQARKLSIDSSLTSEERELKRKQARVRATFVQDLLLSTLFGD

SEQ ID NO: 8326 - protein, 700 aa, Zea mays
  misc_feature (622)..(622): Xaa can be any naturally occurring amino acid
PGFIFCFPQNLIKIPTQKPTEETSVARAANHPPSSPVRFLMEPLPSATAAGVGGPGPGYPESTESSPRSRGGDSWDEPFPSSAAAAAAAAGGGGRLRLMCSFGGRIVPRPTDKSLCYLGGETRIVAVDRHASLADVHARLSRSLLGGRPFTLKYQLPNEDLDSLISVSTDEDLDNLVDEYDRIAATSSGGGTSRTSRIRLFLFPAKPESSSSLGSLLDDSSKSENWFVDALNSAISGSLDGIPRGISTDSASVNCLLGLEDDSSVHSRSGVTNSAPTEDQRASQPKAPRRAPPLLAAGAGRHPHDVQSVPDSPMLDKNSSFGSTSSAPSLSNLPPIRVRPEDRPSDARIMQPTAVEDHFAQMGISEQQLPMYIQAQQQVPIPAMTGMSPSEASSRMFSDDDKSDHGGGGGRKPQPPKQDVPPVVDPTNRAVYYNDRSPPAELKRDMPVGTEAASYRLPVSAPDAAAAAAATAATQAPPGYVLAQMHAPPPPQQPPPQQQPQQPAPQQIVAAGNQHFIHNPATGTFIPIQSYYHHPVHQQAPQTMQRQQQAPTFDPNTGMYYVPMQQNAHQAYGVPPGAQVTLPPPTLVDTTPKPTVPIPQMAVRPELQQPGVYRTTAAATPXPAPNAAPGYAGMAYHHVIQSHHHHHPAPQPVANMAGNYGYEFADPTRPQVYYSQAAAPPTLPQYPPIVSPDAGQAEKH

SEQ ID NO: 8327 - protein, 274 aa, Zea mays
MAVHGGDYLRRFVAETEWYNEVVLNAVAPGDWWRGLPHPVQSWMRNCVGGYLLYFISGFLWCFVIYYWKRHAYIPKDAIPTNEAMKKQIAVASKAMPFYCALPTLSEYMIESGWTRCYFNISEMGFSAYLCYMAMYLIFVEFGIYWMHRELHDIKPLYKHLHATHHIYNKENTLSPFAGLAFHPLDGILQAIPHVLALFLLPTHFRTHIALVFLEGVWTTNIHDCIHGKVWPVMGAGYHTIHHTTYRHNYGHYTVWMDWMFGTLREPDDILKKA

SEQ ID NO: 8328 - protein, 107 aa, Zea mays
MAVHGGDYLRRFVAETEWYNEVVLSAVAPGDWWRGLPHPVQSWMRNCVGGYLLYFISGFLWCFVIYYWKRHAYIPKGNVGCAHGTSVLSKGGTIRAKVGVPLEPVGG

SEQ ID NO: 8329 - protein, 409 aa, Zea mays
  misc_feature (331)..(331): Xaa can be any naturally occurring amino acid
MNRVLACASSLLTCREVLQEQVSSTRSRLGMFVIEDKGGAIALMLASLLFLGTWPAVLTLLERRGRLPQHTYLDYSITNLLAAVLIALTFGQLGDSRRGMPNFFTQLGQDNWPSVLFAMAGGVVLSVGNLSTQYAWAYVGLSVTEVISSSMVVVIGTTLNYFLDNRINRAEILFPGVACFLVAVILGSAVHSPHAADNEQKLEERTNLISDAPKDLEESGASGIRQPDKAEAGTAEYLIELEERRSIKVFGSNTFIGLGIVFFAGVCFSLFSPAFNLATNDQWHTLRDGVPHLVVYTAFFYFSISCFVVGVGLNVLFLYRPMAGVPRSSLXAYLRDWDGRQWALLAGLLCGFGNGFQFMGGQAAGYAAADAVQALPLVSTFWGVLLFGEYRKSSRKTYVLLGFMLFMFV

SEQ ID NO: 8330 - protein, 377 aa, Zea mays
MFVIEDKGGAIALMLASLLFLGTWPAVLTLLERRGRLPQHTYLDYSITNLLAAVLIALTFGQLGDSRRGMPNFFTQLGQDNWPSVLFAMAGGVVLSVGNLSTQYAWAYVGLSVTEVISSSMVVVIGTTLNYFLDNRINRAEILFPGVACFLVAVILGSAVHSSNAADNEQKLAYGIRHPDKDEAGNSECLIELVERRSIKVFGSNTFIGLGIVFFAGVCFSLFSPAFNLATNDQWHTLRDGVPHLVVYTAFFYFSISCFVVGVGLNVLFLYRPMAGVPRSSLGAYLRDWDGRQWALLAGLLCGFGNGFQFMGGQAAGYAAADAVQALPLVSTFWGVLLFGEYRKSSRKTYVLLGFMLFMFVAAVAVLMASSGHRSTE

SEQ ID NO: 8331 - protein, 274 aa, Zea mays
MADSMVASFWGPVTSTIELCEENYAHSSYIAEFYNTISNVPCVLLALIGLVNAFRQGFEKRFSVLHISNMILAIGSMIFHATLQLVLQQSDETPMVWEILLYMYVLYSPDWHYRSTMPTFLFLYGAAFAVVHFFARFQFVFKLHYIGLCFLCIPRMYKYYIQTKDVAAKRLAKLWVLTLTLGTLCWLVDRIFCKKLSHWYVNPQGHAWWHVLMGLNSYYANTFLMFCRAQQRGWEARITYLLGFLPYVKVQKPEKKGMICLCLTLMLLSPPPVS

SEQ ID NO: 8332 - protein, 524 aa, Zea mays
  misc_feature (42)..(42): Xaa can be any naturally occurring amino acid
  misc_feature (92)..(92): Xaa can be any naturally occurring amino acid
  misc_feature (413)..(413): Xaa can be any naturally occurring amino acid
  misc_feature (434)..(434): Xaa can be any naturally occurring amino acid
MEADAAAASGGLALLPAVLLLVALSTLVFSTWSNRNSRLPPXPMALPLIGHLHLIRPPPHRAFDRILARYGPLVYLRLGPSTHCVVAGTADXARDLLKHEASIPERPLTAVTRHLAYDDAGFAFAPYGPHWRFMKRLCMSELLGPRTVDQLRPVREAELAAVLEAARQAAAAREPIDVSRHLISMSNNAIMRMVASALPGHMTEAARDCAKHVAELVGAFNVEDYVGLCRGWDLQGLTRRTREVRDKFDALLEIMITGKEESRRRRHATTDTGGGTKDLLDILMDAAEDANAEVRLTRENIKAFVLDIFTAGSDTTATSVEWMLALLINHPACMDKLRAELDAVVGASRLVGEQDVPRLPYLQAVFKETLRLQPPAVFAQRETIEPVHVRGYVIPPKTSVFFNIFSIGRDPGXWEDPLQFRPERFMPGGAGAGXVDPKGQHMQLMPFGSGRRACPGMGLAMQAVPAFLAALVQCFHWEVPIPPGQSTAPPLYMEEAAGLVTARKNHLLLIPTPRLNPLPARAAT

SEQ ID NO: 8333 - protein, 513 aa, Zea mays
  misc_feature (204)..(204): Xaa can be any naturally occurring amino acid
MAASARTTSSLPYLVAVSSPAAHRHGASHPIRASVGEATMDVVSEAELREKGFLGMRKTKLVCTVGPACVEALPALARGGMGVARINLCHGGREWHRAAMRSVRRLNEEGGFCVTLMVDTEGSQLLVADHGGATSVKAEDGSEWIFTNKKADEAHQFTMHVNFDKFSEGILVGDELVIDGGMATFEVTEKIGNDLRCKCTDPGXWADIEFGIAEGVDCIALSFVNDANDIKQLKAYLSRRSLEHIKVFAKIESLESLKNLKDIIEASDGVMVARGDLGVQIPLEQIPAIQESIVKLCRHLNKPVIVASQLLESMVEYPTPTRAEVADVSEAVRQYADAVMLSAESAIGAYPQKALSVLRAASERMESWSREENMQKLLPRHQLAIALPDRISEQICSCAVEMANNLAVDAIFVYTKHGHMASLLSRNRPNPPIFAFTDNANSRKSMNLYWGVIPLHLPLSNSMEDNFNKTISLMRSKGSVKPGDTVLVVSDSDLNQPCAATSVFQSIQVRLVE

SEQ ID NO: 8334 - protein, 501 aa, Zea mays
MASSSTDLADDGFAAPRLFSQGVSYTYDDVIFLPGYIGFPADAVDLSTRLSRRIPLSIPCVASPMDTVSEAAMAAAMASLGAAAVVHCNTDPHAQAAIVRAAKSRRLPFVSSVPFFSPSSAPTLNDFAGTEYALVTERGDSLSRLVGVAVAADAASREVPVSVSEYMRPTPRSASAAFDFEEAATFLADEGLDYAPLVSDDGEVVDLITAKDVERIRSYPKLGKPSLGASGKFVVAASIGTREDDKGRLEQLVKAGANAIVIDSSQGNSIYQLDMIKFAKKMYPEVDLIGGNVVTIAQAQNLIQAGVDGLRVGMGSGSICTTQEVCAVGRGQATAVYKVSSYAKDHNVPVIADGGISNSGHIVKALSLGASTVMMGSFLAGSHEAPGTYEYKDGRRVKKYRGMGSLEAMTKGSDARYLGDTLKLKVAQGVVGAVADKGSVLRFIPYTMQAVKQGLQDLGADSLQSAHDLLRSETLRLEVRTGAAQAEGGIHGLVSYEKKAF

SEQ ID NO: 8335 - protein, 497 aa, Zea mays
  misc_feature (58)..(58): Xaa can be any naturally occurring amino acid
  misc_feature (454)..(454): Xaa can be any naturally occurring amino acid
SADLAAVGFAGPRLFSLGVSYTYDDVIFLPGYIGFPADAVDLSTRLSRRVPLSTPCPXVASPMDTVSEAAMAAAMASLGAAAVVHRNTEPHAQAAIVRAAKSRRLPFVSSVPFFSPSSAPTLNGFAGSDYALVTERGDSLSRLVGVAVAADAVSRDVPVAVSEYMRMRQTPRSASASFDFEEAAAFLDEGLDYAPLVSDDGEVVDLITVKDVERIRSYPKLGKPSLGVDGKFVVAASIGTREDGKGRLERLVKAGANAIVIDSSQGNSIYQLDMIKFAKKMYPEVDFIGGNAVTIAQAQNLIQAGADGLRVGMGSGSICTTQEVCAVGRGQATSVYKVSSYANDHNVPVIADGGISNSGHIVKALSLGASTVMMGSFLAGSYEAPGTYEYKDGRRVKKYRDMGSLEAMTKGSDVKYLGDTFKLKVAHGVVGAVADKGSVLRFIPYTMQAVGQGXGADSLRSAHDLLRSETLRLEVRTGAAQVEGGIHGLVSYEKKAF

SEQ ID NO: 8336 - protein, 371 aa, Zea mays
  misc_feature (359)..(359): Xaa can be any naturally occurring amino acid
MDTVSEAAMAAAMASLGAAAVVHRNTEPHAQAAIVRAAKSRRLPFVSSVPFFSPSSAPTLNGFAGSDYALVTERGDSLSRLVGVAVAADAVSRDGLDYAPLVSDDGEVVDLITVKDVERIRSYPKLGKPSLGVDGKFVVAASIGTREDGKGRLERLVKAGANAIVIDSSQGNSIYQLDMIKFAKKMYPEVDFIGGNAVTIAQAQNLIQAGADGLRVGMGSGSICTTQEVCAVGRGQATSVYKVSSYANDHNVPVIADGGISNSGHIVKALSLGASTVMMGSFLAGSYEAPGTYEYKDGRRVKKYRDMGSLEAMTKGSDVKYLGDTFKLKVAHGVVGAVADKGSVLRFIPYTMQAVGQGXGADSLRSAHDLL

SEQ ID NO: 8337 - protein, 304 aa, Zea mays
MAAAPSSLVSSHLSRLADLRRAAAPATPTVPQQLRVGCSRRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 8338 - protein, 172 aa, Zea mays
  misc_feature (16)..(16): Xaa can be any naturally occurring amino acid
  misc_feature (48)..(56): Xaa can be any naturally occurring amino acid
  misc_feature (144)..(151): Xaa can be any naturally occurring amino acid
MTCDENVVYDSFSVRXHIIGENDEFIGKKAAYALSQNVKVIACIGELXXXXXXXXXFDVCFRQMKAFADSISNWADVGIAYEPVWAIGTGKVATPEQAQEVHAAVRNWLTTNISPDVASSTRIIYGGSVNAANCAELAKKEDIXXXXXXXXSLKAPDFATIINSVTAKKVAA

SEQ ID NO: 8339 - protein, 126 aa, Zea mays
  misc_feature (9)..(9): Xaa can be any naturally occurring amino acid
  misc_feature (39)..(39): Xaa can be any naturally occurring amino acid
  misc_feature (98)..(98): Xaa can be any naturally occurring amino acid
VSAQNVWIXKGGASLGEISAEQLVDIGCQWVILGHSERXHIIGENDEFIGKKAAYALSQNVKVIACIGELLEEREAGKTFDVCFRQKKAFAGETSSSXEVHAAVRNWLKTNISHDVASSTRIIYGG

SEQ ID NO: 8340 - protein, 176 aa, Zea mays
  misc_feature (37)..(37): Xaa can be any naturally occurring amino acid
  misc_feature (65)..(65): Xaa can be any naturally occurring amino acid
RPADFVVAPPFIYIDQVKNSLTGRIEVSAQNVWIGKXGAYTGEISAEQLVDIGCQWVILGHSERXHIIGENDEFIGKKAAYALSQNVKVIACIGELLEEREACKTFDVCFRQKKAFADSISNWADVVIAYEPVWAIGTRKVATPEQAQEVHAPVRNWLKTNISHDVASSTRIIYGG

SEQ ID NO: 8341 - protein, 610 aa, Zea mays
MDLAPQGLITQQQKANERRPVGSSQIWTRYGVLLPSQQTRKLKEWILTDEQQQLVNASGLGHLALTTGFTIDRSLLTSFCERWNNETNTAHFMGFEIAPSLRDVSYILGIPVTGHVVTAEPIGDEAVKRMCLHYLGESPGNGEQLCGLIRLTWLYRNFHQLPEHPTINKIAYSTRAYLLYLVGSTLFPDTMRGFVSPRYLPLLADFGKIREYAWGAAALAHLYRGLSVAVTPNATTQFLGSATLLMAWIYEYLPITQPQQKNQSTLLPRACRWNFGGATRGQRKKVMDWRKVFEQLQFSEVNWNPYKDMNPAIVPEYCIAADNICYSRTWLISFNIKEAYVPDRFARQFGREQGRLHGVPMWTRRTWSKWKDWRTEYAREIEEFHQLVGCHFTPPAETNINSFPLHESSAGQNDAGCSLNISHNFSAMVEDLKNDLPVIGRYLEGNLLPSDVASFLERVSTMIKSYTPPQGSRRKDRVSHGPADPVRSKNPRKRGRHSLFQDSFPHRYLGTPVNIVFDGTIPLLNGGEALKEQVAMDPWRVSQSHLTMTTSSSSLDSSSPESMKRRREGGDEIPITRDTDCLQSGRLCVQLKMFKHRDGVNAEAANPIFR

SEQ ID NO: 8342 - protein, 199 aa, Zea mays
  misc_feature (107)..(107): Xaa can be any naturally occurring amino acid
MEAGGEEFAIGVVLSAKTTLGEEFEGQIVAFDRPSNLLVIQEGVGRAESGERRNVRVLKANYIREFSVLSKGDDPLDPAGCMLDLNSIYAREDAALRIFSGFLGSHXKNDIWNMQAEIEAERIGVGVTPEAQNIFDALSKTLPVQWDKTDIVVMKEVRVRSPYLPENVSGGTAAANERVKKVIDFERKRLHSRAPGQFS

SEQ ID NO: 8343 - protein, 170 aa, Zea mays
  misc_feature (152)..(152): Xaa can be any naturally occurring amino acid
MSGNGAKKVVDAAVKAGRTIIDWDGMAKLLVTDEARKEFAALRRAFDDVNHQLQTKFSQEPQPIDWEYYRKGIGSKVVDMYKEAFESIEIPKYVDTVTPQYKPKFDAVIAELKEAEKEHQKESERIEKELAEMEEMRKKISTMTADDYFEKXPELRKKFDDEIRNDNWGY

SEQ ID NO: 8344 - protein, 686 aa, Zea mays
MPANDHHPNGLLQESAPGLQHDDMENQQQQVCWERFLLKDTLNVLLVESDASTRQVVSALLRCCMYQVISAKNGQQAWSYLEDKGNNIDLVLTEVFMPGVSGISLLNRIMRHSVFKNIPVIMMSSSDDMSTVFKCLSKGAVDFLVKPIRKNELKNLWQHVWRQRCHSSSGSGSESGIQTQKCAKSKGVNESGNNSGSNDDEAGMGLNARDDSDNGSGTQAQNLWTKLAVEIDSPQATSLDQLADPPNSTCAQVIHSKSEICSNRWLPDKSNRNCKKPKNTNDDFKGKDLEIGGPENLYMGHQSSPNGRSIKAADHENNSKESMMENLEEPTVRAADLIGSMAKNMDTQQAARAAEDTPNFSSKVPEGKGKNNQNDKYVLPSLELSLKRSRSCGDGANNKNTVKDDEQRNCVLRRSNLSAFTRYHTSAASNQGGTGLVGSCSPHDNSSEAVKTDSTYNMKSNSDAAPIKQGSNGSSNDNDMGSTTKDVVTKPMLPSAIKANGYTSAFHPVQQWMVPANATAGKTKADENTARNHYVHFENGGSGALQCGSSNVFDPPLEGQATNNYGGVKAGSNSGSNKGQNNGSTAAANAGLAETEIQAMDKSGVGGGNGNGSGSGSGNDTYVRRLAANMTPRQAQLKKYREKKKDRNFGKKVRYQSRKRLADQRPRVRGQFVKQAVQNQDGARER

SEQ ID NO: 8345 - protein, 161 aa, Zea mays
LRPGSRGQQEEGKGKKGAAGRKVGGPRKKSVSRSVKAGLQFPVGRIGRYLKKGRYAQRVGTGAPVYLAAVLEYLAAEVLELAGNAARDNKKTRIIPRHVLLAIRNDEELGKLLGGVTIAHGGVLPNINPVLLPKKTAEKASSVGSKEAKSPKKAAKSPKKA

SEQ ID NO: 8346 - protein, 362 aa, Zea mays
SRPAGASWIQSQSNPISSPLRSSLTLSPNPSPPRRHSRARLPDRDPGDMPRYDDRHGNTRLYVGRLAPRTRSRDLEYLFSKYGRIREVELKRDYAFIEFSDPRDADDAQYNLDGREVDGSRIIVEFAKGVPRGSGGSREYMGRGPPPGTGRCFNCGMDGHWARDCKAGDWKNKCYRCGESGHIERNCQNSPRNLRRDKSYSRSPSPRGGRGRSRSYSRSRSYSRSRSPSGSPRGGRRERDERRSRSLSYSRSASPRRSVSPAKEKERSRTPNGSRSPRSPSPRAEVSPPLKDNGARNGSDHEGSPGGGENSKRSRSPSDGYRSPVANGRSPSPRDDRSPSPKGNNEDDERRGSPRGSQSPLN

SEQ ID NO: 8347 - protein, 360 aa, Zea mays
SEQPYLFPTSLLAHPLTKSFSSAPPQPGAPLDRDPGDMPRYDDRHGNTRLYVGRLAPRTRSRDLEYLFSKYGRIREVELKRDYAFIEFSDPRDADDAQYNLDGREVDGSRIIVEFAKGVPRGSGGSREYMGRGPPPGTGRCFNCGMDGHWARDCKAGDWKNKCYRCGESGHIERNCQNSPRNLRREKSYSRSPSPRGGRGRSRSYSRSRSYSRSRSPSGSPRGGRRERDERRSRSLSYSRSASPRRSVSPAKEKERSRTPNGSRSPRSPSPRALVSPPLKDNGARNGSDHEGSPGGGENSKRSRSPSDGYRSPVANGRSLSLRDDRSPSPKGNDRSPSPKGTNEDDERRGSPRGSQSPLN

SEQ ID NO: 8348 - protein, 244 aa, Zea mays
  misc_feature (102)..(102): Xaa can be any naturally occurring amino acid
MPRYDDRHGNTRLYVGRLAPRTRSRDLEYLFSKYGRIREVELKRDYAFIQEFSDPRDADDAQYNLDGREVDGSRIIVEFAKGVPRGSGGSREYMGRGPPPGXGRCFNCGMDGHWARDCEAGDWKNKCYRCGESGHIERNCQNSPRNLRRDKSYSRSPSPRGWTWPAAGSYSRSRSYSRSRSPSGSAQGVGRRERDERRSRSLSYSRSASPQAFCLTCKGKRSAVAHPMAVGAQGAQEPQPKGLW

SEQ ID NO: 8349 - protein, 170 aa, Zea mays
MAPTVMMASSATAVAPFQGLKSTASLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 8350 - protein, 232 aa, Zea mays
  misc_feature (198)..(198): Xaa can be any naturally occurring amino acid
MASTLSPPGSLCALLGACPRLPRLPPCIPLQIRSAPPPPMSEDPAGSRRWRCDLGGDERWLSGAAGDDQFDRLPDALLLVIFNRIGDVKALGRCSLVSRRFHELVSLVDSVLVRVDCVIPDEPPSSSSTPSSPTASVRARGVFSQIARIVLGGIVKPIQALGQILSPANSASGFPASSASSLSSSSSSSSPLAAGDVXDHSPSEVLRSFKELPHLCIELPAGELGMDDGVML

SEQ ID NO: 8351 - protein, 525 aa, Zea mays
  misc_feature (197)..(197): Xaa can be any naturally occurring amino acid
  misc_feature (204)..(204): Xaa can be any naturally occurring amino acid
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYIAVRFLIGFSLATFVSCQYWMSTMFSSKIIGTVNGLAAGWGNMGXRRHAAHXMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCGQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 8352 - protein, 504 aa, Zea mays
MDWWVLQGCTRARLMRRRARVTVSGLMDPDTVIRKLHKAGKPAQLWGATAKPAVATQLEKLQLKDAGGKGQGQPPKNAGGKGQPPKNAAGKGQGQGQKQQQPKGGAGGAGAGAKVVALPHSQPTPQQLMQMQQQMQMNGMKFAHPELMAMGAGRMPMPMPFPAAAQAQAQAAAAKDPKTVKFDLPGGEEFGDDGSDLDDEFDELDDVDFEDDGLDDDDDGDLYDGPGMVMKPMGMPPAAAAGGGNGNGGGKKGGGGNEVPVQINGNASNGGGAKQNGGGKSGAKNGKGGGGGGGVVAPGGGNQAGQGKPKGGFPGGAGLGGPMMGGAPPPHAGMMMRPPNMMGGAGGFPGMGQMGGHPHMGGGGMPQAGGGAAHGMPAGGSISMAAGGMPGAGFFPRGVGGGMPAGAEMLGMSQLPPQQQQHMAAVMQQQQQHMAAIMQQQQQQMMMMNGHGHGHGHHGHGGYGYGRPAMPQYPPPPAYYYPMPQRHPHDSMFSDENPNGCSVM

SEQ ID NO: 8353 - protein, 371 aa, Zea mays
MGSGGANTAPLLTPYKMGKFDVTHRVVLAPLTRQRSYGNVPQPHAILYYQQRATKGGLLIAEATGVSDTAQGYKDTPGIWTHEQVEAWKPIVDGVHQKGGIFFCQIWHVGRVSNSTFQPNGQAPISSTDKPLKPQVRANGIDVATFAVPRRLETDEIPLVVNDFRVAARNAIEAGFDGVEIHGAHGYLIDQFLKDGVNDRTDKYGGSLENRCRFALEVTQAVVDEIGADKVGIRLSPFASYSEAPDSDPEALGLYMANALNEFGILYCHIVEPRMVKLGEKFETPYSLRPIRDAFRGTFIVAGGYGREDGNRAISTGYADLVAFGRLFLANPDLPRRFEVDAPLNKYNRDTFYIPDPVVGYTDYPFLSSDV

SEQ ID NO: 8354 - protein, 202 aa, Zea mays
MAQTVFTPSLEAMKHVKAENGVILTKPFLDVCKQILPVLDKFGAAMAIVKSDIGGNITRLENKYTSEPSKYEHLYSMIQEEVQNKTAKGSSSCTNGLLWLTRAMDFLVELFRNLLEHPDWTMGQSCTDSYTKTLKKFHGWLASSSFTVAMKLAPNREKFMEVISGTGDINADIEKFCTTFSPFLKENHNFLASVGLDDLKAS

SEQ ID NO: 8355 - protein, 335 aa, Zea mays
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVSGFKVDTVDTTGAGDAFVGSLLVNVAKDDSIFHNEEKLREALKFSNACGAICTTKKGAIPALPTVATAQDLIAKAN

SEQ ID NO: 8356 - protein, 335 aa, Zea mays
  misc_feature (171)..(171): Xaa can be any naturally occurring amino acid
MAPLGDGGAAAAAASNNLVVSFGEMLIDFVPDVAGLSLAESGGFVKAPGGAPANVACAIAKLGGSSAFVGKFGDDEFGHMLVNILKQNNVNAEGCLFDKHARTALAFVTLKHDGEREFMFYRNPSADMLLTEAELDLGLVRRARVFHYGSISLISEPCRSAHMAAMRAAKXAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 8357 - protein, 335 aa, Zea mays
MAPLGDGGAVAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRDRVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 8358 - protein, 191 aa, Zea mays
SKLSDKKKKKKKKKKKKKKKKNPRPQHNRLAFPSPPARLSLLSDSLSRSRVHLAAASKRDQRAPLGDGGAAAAAASNNLGGSFGEMLIDFVPDVAGLSLAESGGFVKAPGGAPANVACAIAKLGGSSAFVGKFGDDEFGHMLGNILKQNNVNAEGCLFDKHARTALAFVTLKHDGEREFMFYRNPSADMLL

SEQ ID NO: 8359 - protein, 330 aa, Zea mays
MASRLVYPVCHNICPEKSYCSCTGVVRPSCDLPKKKKKKKKKKKKKPQPQHNRLAFPSPPAPVSLSLLSDSLSRSRVHLAAASKRDQMAPLGDGGAAAAAASNNLVVSFGEMLIDFVPDVAGLSLAESGGFVKAPGGAPANVACAIAKLGGSSAFVGKFGDDEFGHMLVNILKQNNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 8360 - protein, 361 aa, Zea mays
MEVTPNHTLTVTGWAAMNESAGKVEPFVFKRRENGPDDVTIKVQYCGMCHTDLHFINNDWGITTYPLVPGHEITGVVTKAGRNVTGFRVGDRVGVGCIAASCLDCDHCRRSEENYCDRVALTYNGVFWDGSVTYGGYSRALVADKRFVVRVPDALPLDAAAPLLCAGVTVYSPMKHHGMLGHPGASLGVVGLGGLGHVAVKLAKAFGLRVTVVSTSPAKEAEARARLGADRFVVSTDDAQMRDAARSLDYVIDTVSAKHSLGPILDLLKVSGKLVLVAAPDQPVELPSFPLIFGKRTVSGSMTGGIRETQEMLDLCARHNITCDIELVSTDGINAALARLARNDVRYRFVIDIAGDSTSKL

SEQ ID NO: 8361 - protein, 531 aa, Zea mays
  misc_feature (123)..(123): Xaa can be any naturally occurring amino acid
  misc_feature (146)..(146): Xaa can be any naturally occurring amino acid
  misc_feature (315)..(315): Xaa can be any naturally occurring amino acid
  misc_feature (494)..(494): Xaa can be any naturally occurring amino acid
MAAGGGGGGIADEKAPAAEAFGGHLEAAEMTEAEEEHSGVKSRLSGLLWHGGSAYDAWFSCASNQVAQVLLTLPYSFAQLGMLSGVLFQLFYGLLGSWTAYLISILYLEYRTRREREKAADFXRNHVIQWFEVLDGLLGRHWRNAXGLAFNCTFLLFGSVIQLIGCASNIYYVNDRLDKRTWTYVFGACCATTVFIPSFHNYRVWSFLGLVMTTYTAWYMAVASLVHGQVEGVQHSGPTRIVLYFTGATNILYTFGGHAVTVEIMHAMWRPQKFKAIYLLATLYVLTLTLPSAAASYWAFGDELLTHSNALALLXPRTPFRDAAVVLMLIHQFITFGFACTPLYFVWEKLIGLHDCRSLCKRAAARLPVVVPIWFLAIIFPFFGPINSAVGSLLVSFTVYIIPALAHMVTFRSPQSRENAVERPPRFAGGWTGAYVINSFVVAWVLVVGFGFGGWASITNFVQQVNTFGLFAKCYQCPPHLTAAPPAAFMPPPXHQWPRRPPCHRRRRRSMPPASSSLRCQPRFRLRLRRR

SEQ ID NO: 8362 - protein, 340 aa, Zea mays
  misc_feature (124)..(124): Xaa can be any naturally occurring amino acid
MAGGGATVCVTGAGGFIASWVVKLLLSRGYTVHGTVRHLSDEKTGHLKRLENAAGNLRIFKADLLDYDAMAAAVVGCQGVFHVATPVPSEDLTDPELQMLGPAVTGTTNVLKAASSANVQRVVXWVSSMVAVEISPKDWPEGKVRDERCWSDREFCRSIESWYPVAKIISEEAALAYGQQTGLDVVTINPGLVFGPMLQPTVNTTIQFLIYFLKGGPDPVKNKLWHIVDVRDVADAMLLLYEVPEATGRHICAPHVISARDLLDLLKSMYPDYPCIANESILDRDHPAPMTSDKLKKIGWSCRPLEETIVDTVECCLRAGFLDHVGGETSCRFPPLLNQI

SEQ ID NO: 8363 - protein, 229 aa, Zea mays
MAVLLRRAAALLVVTAVCADGASTFYSSDPNLGSARVVFQTNFGDIEFGFFPHVAPKTVEHIFKLVRLGCYITNHFFRVDKGFVAQVADVMSGRTAPMNEEQKKEAEKTIVGEFSSVKHVRGILSMGRHSDPDSAGSSFSILLGNSPHLDGQYAVFGRVTKGDDTLTKLERLPTRREGIFVMPIERINILSTYYYDIDLESCEAEKSILRRRLSESASEVERWRRKCFA

SEQ ID NO: 8364 - protein, 435 aa, Zea mays
MEMKLTIRRVPTVVSNYQEDADKPRAGCGRNCLGDCCLPASKLPLYAFKLSPAKGSQEDAASTKLLVDILLSEWEDRMTRGLFRYDVTACETKVIPGNLGFVAQLNEGRHLKKRPTEFRVDRVLQPFDPAKFNFTKVGQEEVLFQFENSGGDDSYFLNNAPIIAVDRAPNVIAINVSPIEYGHVLLIPRVLDRLPQRIDPESFLLALQMAAEGGSPYFRLGYNSLGAFATINHLHFQAYYLSVPFPVEKAATHKIPLSEDTKKNGVTVSKLINYPVRGLVFEGGNTLDDLATVVSNACIWLQDNNVPYNVLISDCGKRVFLFPQCYAEKQALGEVSQELLDTQVNPAVWEISGHMVLKRRMDYEEASETSAWKLLAEVSLSEERFEEVKAYIFSAAGLVQYDEEEEEASDGEGPTAYVPVKVTPLPVAEGCLVLP

SEQ ID NO: 8365 - protein, 179 aa, Zea mays
MFFLQWFLQVSPIEYGHVLLIPRVLDRLPQRIDPESFLLALQMAAEGGSPYFRLGYNSLGAFATINHLHFQAYYLSVPFPVEKAATHKIPLSEDTKKNGVTVSKLINYPVRGLVFEGGNTLDDLATVVSNACIWLQDNNVPYNVLISDCAKRVFLFPQVNPLNVVATLDCDGRGAVHSR

SEQ ID NO: 8366 - protein, 311 aa, Zea mays
  misc_feature (129)..(129): Xaa can be any naturally occurring amino acid
  misc_feature (183)..(183): Xaa can be any naturally occurring amino acid
  misc_feature (195)..(195): Xaa can be any naturally occurring amino acid
  misc_feature (215)..(215): Xaa can be any naturally occurring amino acid
  misc_feature (233)..(233): Xaa can be any naturally occurring amino acid
  misc_feature (265)..(265): Xaa can be any naturally occurring amino acid
LLANGRHRKTLIFRLEDGERIIRSDSDRESRVELDCLPCLQALVFFLERKSRRQYKDVQDGGGEGRRQWADSEEPGRRTRLQQQQLAAGEAAAARVRPVETLLRAAPLGLCVAAMTVMLRNQQSNEYGXVAYSDLGGFKYLVYANGLCAAYSLVSAFYTAVPRPATVSRSWLVFLLDQVFTYXLILAAGAAAAEXLLYLAYNGDKEVTWSEACGXVFGSFCRQARTSVAITFXTVLCFILLSLISSYRLFSGLRGRPPSSALGSXGAVEIAAYPRLKPPGGRPRCKSLLCVVDHVIMAYRIYTSLIVCCHI

SEQ ID NO: 8367 - protein, 73 aa, Zea mays
MIQVVLNDRLGKKVRVKCNEDDPIGDLKKLVAAQTGTRPEKIRIQKWFNIYKGPITLKDYEVHDGMGLELYYN

SEQ ID NO: 8368 - protein, 179 aa, Zea mays
MEYGQQGQRGHGATGHVDQYGNPVGGVEHGTGGMRHGTGTTGGMGQLGEHGGAGMGGGQFQPAREEHKTGGILHRSGSSSSSSVITTLDTSFFCSEDDGMGGRRKKGIKEKIKEKLPGGHKDDQHATATTGGAYGQQGHTGSAYGQQGHTGGAYATGTEGTGEKKGIMDKIKEKLPGQH

SEQ ID NO: 8369 - protein, 89 aa, Zea mays
  misc_feature (42)..(42): Xaa can be any naturally occurring amino acid
PHFHHRDVRIQVRGFLKYFGISFLWSFFQWFYTAGDHFLGPXTVRFSFDFSLTYVGAGMICSHLVNLSLLFGAVVSWGVMWPLIGKQKG

SEQ ID NO: 8370 - protein, 93 aa, Zea mays
RDVRIQVRGFLKYFGISFLWSFFQWFYTAGDHCGFAQFPTFGLQAFNQTFSFDFSLTYVGAGMICSHLVNLSLLFGAVVSWGVMWPLIGKQKG

SEQ ID NO: 8371 - protein, 173 aa, Zea mays
MQRGDPLVVGRIIGDVVDPFVRRVPLRVAYAAREVSNGCELRPSAIADQPRVEVGGPDMRTFYTLVMVDPDAPSPSDPNLREYLHWLVTDIPATTGVSFGTEVVCYESPRPVLGIHRVVFLLFQQLGRQTVYAPGWRQNFSTRDFAELYNLGLPVAAVYFNCQRESGTGGRRM

SEQ ID NO: 8372 - protein, 363 aa, Zea mays
MWWRAVRRRWVATARPASSAAAGAEKSCRAVVVPRFGGPEVLEVRQGMPVPDLKPQEVLVRARAVSINPLDLRMRCGYGRSIFEPLLPLIIGRDISGEVAATGTLASSFSIGQEVFGSLHPTALRGTYADYAILSLDELTLKPSTLSHVEASAIPFAALTAWRALHGTARISEGQRVLVIGGGGAVGLAAVQLAVAAGCVVSATCGTQSIERVMGVGAEQAIDYTAEDTEAAIKGKFDAVLDTIGVPETERIGINVLRRGGHYMTLQGEAAALADRYGLAVGLPAATAVLLKKQMQYRYSHGIEYWWTYMRADAEGLHEIQRLSGAGKLQIPVEKTFPISHVREAHAAKEKKLAPGKVVLEFD

SEQ ID NO: 8373 - protein, 527 aa, Zea mays
MAMATTEATTLTVLLKEAAAAFPTRRAVAVPGRLELTHAALDALVDAAAARLAADAGVLPGHVVALSFPNTVELVIMFLAVIRARGVAAPLNPAYTQEEFEFYLSDSEARLLVTNAEGNAAAQAAAAKLGLAHATASLHDAAGPVHLAGLPVHAPENGSHGGGAAGSLSPNDPSDVALFLHTSGTTSRPKGVPLKQRNLAASVRNIRSVYRLAETDATVVVLPLFHVHGLLCALLSSLASGASVALPAAGRFSASTFWADMRASGATWYTAVPTIHQIILDRHASRPEAYPALRFIRSCSASLAPAILERLEAAFSAPVLEAYAMTEASHLMTSNPLPEDGPRKPGSVGRAVGQELAVLDEEGRLVAAGSPGEVCVRGDNVTAGYKGNPEANEAAFRFGWFHTGDIGVVDDQGYVRLVGRIKELINRGGEKISPIEVDAVLLGLPGVAQAVSFGVPDDKYGEEINCAVIPRDGSALREEEVLAHCRRNLASFKVPKKVFITDDLPKTATGKIQRRIVAQHFVQPTSA

SEQ ID NO: 8374 - protein, 197 aa, Zea mays
CSASLAPAILERLEAAFSAPVLEAYAMTEASHLMTSNPLPEDGPRKPGSVGRAVGQELAVLDEEGRLVAAGSPGEVCVRGDNVTAGYKGNPEANEAAFRFGWFHTGDIGVVDDQGYVRLVGRIKELINRGGEKISPIEVDAVLLGLPGVAQAVSFGVPDDKYGEEINCAVIPRDGSALREEEVLAHCRRNLAYFIVP

SEQ ID NO: 8375 - protein, 168 aa, Zea mays
  misc_feature (39)..(39): Xaa can be any naturally occurring amino acid
MLVYQDLLSGDELLSDSFTYKELENGVLWEVEGKWVTQXGPVDVDIGANPSAEGGEDESVDDTAVKVVDIVDTFRLQEQPPFDKKSFVSYIKKYIKNLTAVLEPEKADEFKKGVEGATKFLLSKLKDLQFFVGESMKDEASVVFAYYKDGATNPTFLYFSHGLKEIKC

SEQ ID NO: 8376 - protein, 167 aa, Zea mays
MLVYQDLLSGDELLSDSFTYKELENGVLWEVEGKWVTQGPVDVDIGANPSAEGGEDESVDDTAVKVVDIVDTFRLQEQPPFDKKSFVSYIKKYIKNLTAVLEPEKADEFKKGVEGATKFLLSKLKDLQFFVGESMKDDASVVFAYYKDGATNPTFLYFSHGLKEIKC

SEQ ID NO: 8377 - protein, 166 aa, Zea mays
LVYQDLLSGDELLSDSFTYKELENGVLWEVEGKWVTQGPVDVDIGANPSAEGGEDESVDDTPVKVVDIVDTFRLQEQPPFDKKSFVSYIKKYIKNLPAVLEPEKADEFKKGVEGATKFLLSKLKDLQFFVGESMKDEASVVFAYYKDGAPNPTFLYFSHGLKEIKC

SEQ ID NO: 8378 - protein, 167 aa, Zea mays
MLVYQDLLSGDELLSDSFTYKELENGVLWEVEGKWVTQGPVDVDIGANPSAEGGEDESVDDTAVKVVDIVDTFRLQEQPPFDKKSFVSYIKKYIKNLTAVLEPEKADEFKKGVEGATKFLLSKLKDLQFFVGESMKDEASVVFAYYKDGATNPTFLYFSHGLKEIKC

SEQ ID NO: 8379 - protein, 201 aa, Zea mays
  misc_feature (48)..(48): Xaa can be any naturally occurring amino acid
  misc_feature (62)..(62): Xaa can be any naturally occurring amino acid
  misc_feature (122)..(122): Xaa can be any naturally occurring amino acid
LGTSRPAGTLLCSAASDIVSLSPRATDNPPALRCSDYQDLLSGDELLXDSFTYKELENGVLXEVDGKWVTQGPVDVDIGANPSCEGGEDESVDDTRAKAVDIADTFRLQEQPPFDQKSFRLXYIKKYIKNLTAVLEPEKADEFKKGVQGATKILLSKLNDLPFFVDESMKDELSEAFCYYEDGATNPTFLYFSHGLNDIKC

SEQ ID NO: 8380 - protein, 167 aa, Zea mays
  misc_feature (15)..(15): Xaa can be any naturally occurring amino acid
  misc_feature (110)..(110): Xaa can be any naturally occurring amino acid
MLVYQDLLSGDEVLXDSFTYKELENGVLREVEGKWITQGPVDVDIDANPSAEDDEDESVDDTVVKEVDIDDTFHLQEQPPFDEKSFVSYIKKYIKNLTAVLEPEKAHDLXKGVETATKFLLSKLKDLQVFGGESMKDEASVVFANYKDGATNATFLYFSHGLKEIKC

SEQ ID NO: 8381 - protein, 196 aa, Zea mays
  misc_feature (169)..(169): Xaa can be any naturally occurring amino acid
NPSYAPPSPISFSFVPTEQPYISDQAHVDVCAYSRPAVSARLRSCPYSFTYKELENGVLCHDEGKWVTQGPVDVDIGANPSAEGGEDESVDDTAEKVADIVDTFRLQEQPPFDKKSFVSYITKYIKNLTAVLETEKADEFKKGVEGATKFLLSKLKDLQFFVGESMKDXRTCVFSYYKDGATNPTFLYFSHGLKEI

SEQ ID NO: 8382 - protein, 161 aa, Zea mays
  misc_feature (47)..(47): Xaa can be any naturally occurring amino acid
  misc_feature (63)..(63): Xaa can be any naturally occurring amino acid
  misc_feature (98)..(98): Xaa can be any naturally occurring amino acid
  misc_feature (119)..(119): Xaa can be any naturally occurring amino acid
  misc_feature (139)..(139): Xaa can be any naturally occurring amino acid
NYHDLLCVDKFLSYYFSYYELENGVLWDIKGKCTTLGTDDEHIAVYXSNEDGDDESVDRRQMXNVVDIVDTFRLQEQPPFDNKSFVSYIEKYIRNLTXAMKPEKAYEFQKGAQGATKFXLSKLKDLQLFVGESMKDDAXVVFAYYKDGATNPTFLYFSHGL

SEQ ID NO: 8383 - protein, 192 aa, Zea mays
  misc_feature (155)..(155): Xaa can be any naturally occurring amino acid
LLAAASTTTLSLRAHEQPIIRRTLRCWIITDLLSADELLSHSFTYKELENGVLWEVQGNGPTQGPVDVEIAANPSDEGDEDQRVDDTAVKVADIDDTFRLQEEPPFDKKSFASYIKKYIKNLTAALNSEKADEFRKGVKAATKFLLTKLKDLRFXVGESMKDDAFAVYAYYKDGVTNPTFLYFSHGLKEIKC

SEQ ID NO: 8384 - protein, 168 aa, Zea mays
  misc_feature (10)..(10): Xaa can be any naturally occurring amino acid
  misc_feature (82)..(82): Xaa can be any naturally occurring amino acid
  misc_feature (105)..(105): Xaa can be any naturally occurring amino acid
  misc_feature (138)..(138): Xaa can be any naturally occurring amino acid
MLVYQDLLCXDELLSDSFTYKELENGVLWELEGKWLTQGPVDVNIGVNPSAEGGEDESVDDTAVNVVDIADTFRLQEQPPFXDKKSFVSYIEKYIKNLTAVLEPXKADEFKKGVEGATKCLLSKLKDLQFFVVESMKXDASVVSTYYKDGATNPTFLYFSHGLNEIKC

SEQ ID NO: 8385 - protein, 167 aa, Zea mays
  misc_feature (10)..(10): Xaa can be any naturally occurring amino acid
  misc_feature (102)..(102): Xaa can be any naturally occurring amino acid
VYQDLLSGDXSCRDSFTYNELENGVLWEVKGKWFTQGPVDVNIDANPSAEGGEDEMVDDTAAKGVDIADTFRLHEQPPFDKKSFVSYIKKYIKNLTAVLKSXKADDFKKGVEVATKFLLTKLNDLQFFGADIMNDQASVVFAYYKDGGTNPTFLYFSHGLKEIKCLD

SEQ ID NO: 8386 - protein, 167 aa, Zea mays
MLIYQDLLSGDELLLDSFTYKELENGVLWDVEGKCVTQGPVDVDIGANPSVEAVEDHRVDDTAVNVADIVDTFRLHEQPPFDKKSFVSYIKKHIKNLTAVLEPQKADDFKKGGQCATKFLLSKLKDLQFFVGESMKDDASVEFAYYKDGATNPTFLYFSHGLKDIQC

SEQ ID NO: 8387 - protein, 146 aa, Zea mays
  misc_feature (6)..(6): Xaa can be any naturally occurring amino acid
ELENGXPWEVEGKWVTQGPVDVDIGANPSAEGGEDESVDDTAVKVVDIVDTFRLQEHPPFDKKSFVSSIKKSIKNLPAVLEPEKADEFKKGVEGATKFLLSKLKAPQFFVGESMKDDASVVFAYYKDGAPNPPPLYFSHGLKEIKC

SEQ ID NO: 8388 - protein, 140 aa, Zea mays
  misc_feature (17)..(17): Xaa can be any naturally occurring amino acid
  misc_feature (65)..(65): Xaa can be any naturally occurring amino acid
RAGSRGKCFTQGSVDVXIAANPSTEGGEDESVDDSVVKVVDIDDTFRLQEQPPFDKKSFVSYIKXYIKNLTAVLEPEKAAEFKKGVEGATKFLLSKLKDLQFFVGESMNDETYVVFTYYKDGATNPTFLYCSHGLKEIKC

SEQ ID NO: 8389 - protein, 192 aa, Zea mays
  misc_feature (37)..(37): Xaa can be any naturally occurring amino acid
  misc_feature (115)..(115): Xaa can be any naturally occurring amino acid
PASAHASADIVPSSPRATDNPTALRWWIIMDLLSGDXLLPDSFTYKELENGVLWEVEGKWVTQGPVDVDIGANPSAEGGEDESVDDTAAKVVDIVDTFRLQEQPPFDKKSLVSYXKKYIKNLTAELEPEKADEFKKGVEGATKFLLSKLKDLQFFVGESMKDDASVVFAYYKDGATNPTFLYFSHGLKEIKC

SEQ ID NO: 8390 - protein, 104 aa, Zea mays
VKVVDIVDTFRLQEQPPFDKKSFVSSIKKYIKNLPAVLEPKKADEFKKGVEGATKFFLSKLKDLQFFVGESIKDKGSVVFAYYKDGATNPTFLYFSQGLKEIKC

SEQ ID NO: 8391 - protein, 133 aa, Zea mays
DLLSGDELLINQHLNAGVLEGVLWDVEAKLLTRGAVDVDIGANSYVEGGEDESVDDTAANVVDIVDTFRVQEQPPFDKKSFASYIKKYMKNLTAVLQPEKADEFIKGVEGATKFLLSKLHDLQIFDGESMKDD

SEQ ID NO: 8392 - protein, 167 aa, Zea mays
  misc_feature (100)..(100): Xaa can be any naturally occurring amino acid
MMDYQDLLSGDELLSDSFTYQEVENGVLWDDQGKWVTQGPVDVHIGAQPFVEGGEDESADDTPVKGGDIVDTFRLQEQPPFDKKSFVSYIQKYIKNLSAXVEPKKADEFKKGVEGATKLLLSKLKALQFFVGESMKDDASVVFAYYKDGAPNPTFLYFSHGLKEIKC

SEQ ID NO: 8393 - protein, 716 aa, Zea mays
  misc_feature (587)..(587): Xaa can be any naturally occurring amino acid
AVLAVTCEGNAIRELKIIGDRITKPPKFSGFSVPNVTLSEAFVLDSFVTTLARLTTLRVVILVSLGLWGPLPDKIHRLSSLEVLDLSSNFLYGSIPPKLSVMSKLHTVTLDGNYFNGSVPDWLDSFSNLIVLRLQSNQLKGSIPASIGKAAMLTELALAGNSISGDVPNGVNLNKLEMLDLRDNKLDGELPEMPTSVVTILLSKNSLKGEIPEQFGQLNRLQHLDVSFNFLVGSPPAELFALPNISYLNLAANMLSGSLLSSLTCSSTLGFVDLSTNRLTGDLPSCLNGNLNNKVVKFDGNCFRVDPAHQHEDKYCQQSHNGRGSKKDVGLVVTVVGILFVILVLSLLLMASNKRSCQKVLAEQAWADAWAQDNLLSGMSSELLVNARCISQAVKLGTQIQPSYHIFSLEELKEATKSFERSAFLGEGAIGKLYKGRLENATLIAIRCLPLHQRYSIRNLKLRLDLLAKLRHPNLVCLLGHCIDSAVDESTVKRVFLVYEYVPGGTLSSYLSACSPDKTLKWCDRLQVLIAIAKAVHFLHTGIIPGSLSNRLKSSSILVDEHHTAKLSDYGLSIITEEIYRHEVLTXVIGQKEKYLQNDATEMENLEDDVCSFGYILLEVLMGPKLNEKGGPFILKDLVVSMSTLEERDQVVDPVIIGTCSQDSLSIVVSIMIKCLSIECSARPSMEEVLWNLQYAAQVQTMADSDQRSEVSSQAC

SEQ ID NO: 8394 - protein, 178 aa, Zea mays
PPTDLQLQRVSLPTWAEFELGRAPVYWKTSSGLPPSPGEGLTLFYNPAATKMAPNEVFGVAFNGGFNQPIMCGGEPRQMTLQERGKADPPIYTIRIRVPQHAVSLIFSFTNGAEWDGPYTLKFRVPKPWQNKPLSFFNEGLADELNREGACDLAIYPDENIAITSCAMDGYLESDSEE

SEQ ID NO: 8395 - protein, 122 aa, Zea mays
MNSRRDFRSHRAALFDGIEEGGVRAPAYSSREIHEHENDQALDSLHDRVSVLKRLTGDIHEEVENHNRMLDRMGNDMDASRGFLSGTVDKFKMVFETSSGNSAASAGASFIAVFLLIYYLTK

SEQ ID NO: 8396 - protein, 538 aa, Zea mays
IGYLEAGRGHPYCAHRDTDPRSRRQLPSPSPGLHCTSELHIAHAAPVLCNRLHPALLLLIGAGACLLGYGTAWLLVSGVAPALPYWLIWFALCLATNGGAWLATAVLVTNMRNFPLSRGAVAGILKGYSGLSAAVYTEIYTGVLRDSPINLLLSLALGIPAVCLLGMYFVQPCEPSLVETNAEQVHFMFAQVASVLLGVYLVGATILDHVVAVNDIMNYSLLVVMVLLIFAPLAIPLKMTLFPKKKTPSDSHSPTVDNDHTQPLLPSSSESNLGNLEEDDSTDIDVLLAEGEGAIKPKRRRPRRGEDFRFREAILKADFWLLFAICFVGFGSGITVLNNLAQIGIAAGAVDTTISLSVFSFCNFFGRLGGGVVSEYLVRSRTLPRSVLIIGTQAVMIITYLLFALGRLATLYVSVALLGVCFGISLSVIISTSSELFGLKHFGKIFNFIALANPVGAFLFNTLAGYVYDLEVEKQHATASGSDVACHGPNCFRLTFFVLSGVACLGTLLSTVLTVRVRPVYQMLYAGGSFSQPRNPAH

SEQ ID NO: 8397 - protein, 216 aa, Zea mays
MAYRADDDYDYLFKVVLIGDSGVGKSNLLSRFTRNEFSLESKSTIGVEFATRSIHVDDKVVKAQIWDTAGQERYRAITSAYYRGAVGALVVYDVTRHVTFENVERWMRELRDHTDANIVIMLVGNKADLRHLRAVPTEDAKAFAERENAFFMETSALEAMNVEGAFTEVLTQIYHVVSKKALDIGDDPAAPPRGQTISVGGKDDVSAVKKSACCSS

SEQ ID NO: 8398 - protein, 225 aa, Zea mays
  misc_feature (188)..(188): Xaa can be any naturally occurring amino acid
MSAGELRLELDELQRLESLAKHPRVQILLANEIRNVEAKLAKATEPSPEPLAAASAPAPAPVARPVLSYVTLGSFSWEQDNEKIRIYASLEGVEQEKVETTFKPTSVDVKFHDVKGKNYRCAIPKLNKEIVPEKCKVVVKPTRVVVTLFKASKGNWLDLHFKEDKFKPNMDKEKDPMSEIMDLMKNMXKRQVRQMMGDEDMKRTIAKAWSDARSGKTTDSMSGLR

SEQ ID NO: 8399 - protein, 278 aa, Zea mays
MSAGELRLELDELRRLESLAKHPRVQILLANEIRNVEAKRLRWQLAKATEPSPEPLAAASAPAPAPAARPVLSYVTLGSFSWEQDNEKIRSSSFNNHVREELETIAETMGSPWPQLSSAPYYDDFIWSLKIPQQQQTFSPKKVRIYVSLEGVEQEKVETTFKPTSVDIKFHDVKGKNYRCAIPKLNKEIVPEKCKVVVKPTRVVVTLFKGSKGNWLDLHFKEDKFKPNMDKEKDPMSGIMDLLKYMYEEGDEDMKRTIAKAWSDARSGKTTDSMSGLR

SEQ ID NO: 8400 - protein, 219 aa, Zea mays
MSAGELRLELDELRRLESLAKHPRVQILLANEIRNVEAKLAKATEPSPEPLAAASAPAPAPAARPVLSYVTLGSFSWEQDNEKIRIYVSLEGVEQEKVETTFKPTSVDIKFHDVKGKNYRCAIPKLNKEIVPEKCKVVVKPTRVVVTLFKGSKGNWLDLHFKEDKFKPNMDKEKDPMSGIMDLMKYMYEEGDEDMKRTIAKAWSDARSGKTTDSMSGLR

SEQ ID NO: 8401 - protein, 257 aa, Zea mays
  misc_feature (180)..(180): Xaa can be any naturally occurring amino acid
MATPSSSLCSSFASLRTASIGHPRGIASSTPRKAFQVRASARVDKFSKSDIIVSPSILSANFAKLGDQVKAVEVAGCDWIHVDVMDGRFVPNITIGPFVVDALRPVTDLPLDVHLMIVEPEQRVPDFIKAGADIVSVHCEQTSTIHLHRTVNQIKSLGAKAGVVLNPATPLTAIDYVLDXFIESQVKKIAELRRLCAEKGVNPWIEVDGGVGPKNAYKVIEAGANAIVAGSAVFGAPDYAEAIKGIKTSQRPLAVAA

SEQ ID NO: 8402 - protein, 559 aa, Zea mays
ANAVLQCLMCTKPLMIYLLLRLHSKDCNTIISNSCPHPLLEILMCTLYFFLFDLSYYFIGCSKNWCLMCELEQYASTLRESGGPLSPSRILSNLRNIGCRLGGGTQEDAHEFLRHLVMSMQAACLDGLGGEKHVEPSLQETTLIQQMFGGRLKSKVKCLRCYHESERYENIMDLTLEIHGWVESLQDALTQFTAPEDLDGDNMYKCGRCSAYVKARKQLSVHEVPNILTVVLKRFQSGKYGKINKCVTFPDMLDMVPFVTGSGDNPPLYFLYAVVVHVDTENASFSGHYISYVKDMQGTWLRIDDSEVQVVSVNQVMSEGAYMLFYLRSFPRPPRIYIEKGLPVTSAKRHTSKSSKGSKHDRKQTELLFPANDQAYGVYDFRPDGEGYAQDQHAELRSRAFHHADDAFADSVSADFSEATSSEWSLFTSSDESSFTTESTRDSFSVVDYGDNAGLDPISSIFGPSYAPEHGAPGSFVSRTRFSPSSPQTRYFSESTGFVSDSSMPAHPHGIVHRGRYPDSRACASSAEPLASAAHQRSGYGRYPLSRDGFVQTSGFCQM

SEQ ID NO: 8403 - protein, 553 aa, Zea mays
MGNACGGALRSKYQHSFKHAASSQRHASSEYSASAVADDSPRKPPPPPATTDAHAPPPPPATAMRRGGAGAPPDLGSVLGHPTPNLRDLYALGRKLGQGQFGTTFLCTELATGVDYACKSISKRKLITREDVDDVRREIQIMHHLSGHTNVVAIKGAYEDQLYVHIVMELCAGGELFDRIIQRGHYSERKAAELTRIIVGVVEACHSLGVMHRDLKPENFLLVNKDDDLSLKAIDFGLSVFFKPGQVFTDVVGSPYYVAPEVLLKNYGPAADVWTAGVILYILLSGVPPFWAETQQGIFDAVLKGVIDFDSDPWPVISDSAKDLIRRMLNPRSAERLTAHEVLCHPWIRDHGVASDRPLDPAVLSRIKQFSAMNKLKKMALRVIAESLSEEEIAGLKEMFQTMDTDNSGAITYDELKEGLRKYGSTLKDTEIRDLMDAADIDNNGTIDYIEFIAATLHLNKLEREEHLVAAFSYFDKDGSGYITVDELQQACKEHNMPDAFLDDVINEADQDNDGRIDYGEFVAMMTKGNMGVGRRTMRNSLNISMRDAPGAF

SEQ ID NO: 8404 - protein, 113 aa, Zea mays
  misc_feature (36)..(36): Xaa can be any naturally occurring amino acid
GAFCFKFIHCDGTRQGGGESAVESVENPGWCIGKGXTINISLCLGVFLALIYFRNLTWDFSSEVLIILLVCVVMALFTSFRTTFPLWTCLVAYMLYPLSLIIVYILDYVFGWS

SEQ ID NO: 8405 - protein, 478 aa, Zea mays
MAEETVRELRASFAAGQTRPAEWRAAQLKGLIRMIDEKEAEISAALHEDLAKPHMESFLHEISLTKSSCKFALKGLKNWMKPEKVPAAITTFPSSAQIVPEPLGVVLIISAWNYPFILSIDPVIGAIAAGNAVVLKPSEIAPATSSLLAKLLPEYVDNSCIKVVEGSVPETTALLEQRWDKIFYTGNGTVGRIVMAAAAKHLTPVALELGGKSPVIVDSNVDLHVAAKRIVVGKWGCNNGQACIAPDYIITTKSFAPELVASFKRVLERFYGEDPLESADLSRIVNSKQFKRLTNLIEEKRVADKIVYGGKADEKQLKISPTLLLDVPEDSEIMTGEIFGPLLPIVTVEKIEESFDLINAKPKPLAAYLFTKNRKLQEEFVASVPAGGMLVNDTALHLTNPYMPFGGVGDSGMGCYHGKFGFDCFSHKKGVLIRGFGGEANARYPPYTTEKQKILRGLINGSFIALILALLGFPREKR

SEQ ID NO: 8406 - protein, 481 aa, Zea mays
MAGMAEETVRELRASFAAGRTRPAEWRAAQLKGLIRMIDEKEAEISAALHEDLAKPHMESFLHEISLTKSSCKFALKGLKNWMKPEKVPAAITTFPSSAQIVPEPLGVVLIISAWNYPFILSIDPVIGAIAAGNAVVLKPSEIAPATSSLLAKLLPEYVDNSCIKVVEGSVPETTALLEQRWDKIFYTGNGTVGRIVMAAAAKHLTPVALELGGKSPVIVDSNVDLHVAAKRIVVGKWGCNNGQACIAPDYIITTKSFAPELVASFKRVLERFYGEDPLQSADLSRIVNSKQFKRLTNLIEEKRVADKIVYGGKADEKQLKISPTLLLDVPEDSEIMTGEIFGPLLPIVTVEKIEESFDLINAKPKPLAAYLFTKNRKLQEEFVASVPAGGMLVNDTALHLTNPYMPFGGVGDSGMGCYHGKFGFDCFSHKKGVLIRGFGGEANARYPPYTTEKQKILRGLINGSFIALILALLGFPREKR

SEQ ID NO: 8407 - protein, 503 aa, Zea mays
MMLAILARRRAAEAVLRRPQAAAGAAVSAWRAYAAAGEESDVVVVGGGPGGYVAAIKAAQLGLKTTCIEKRGTLGGTCLNVGCIPSKALLHSSHMYHEAKSSFAHHGVKFSNLEVDLPAMMAQKDKAVAGLTKGIEGLFKKNKVTYVKGFGKLSSPSEVSVDLIDGGSTIVKGKNIIIATGSDVKSLPGITIDEKKVVSSTGALCLSEIPKKLVVIGAGYIGLEMGSVWNRLGSEVTVVEFAPDIVPSMDGEVRKQFQRMLEKQKFKFMLKTKVVGCDTSGDGVKLTLEPAAGGEQTILEADVVLVSAGRSPFTSGIGLETLGVETDKAGRILVDKRFMTNVKGVYAIGDAIPGPMLAHKAEEDGVACVEFIAGKEGHVDYDTVPGVVYTHPEVASVGKTEEQVTALGIPYRVGKFPLLANSRAKAIDDAEGVVKVIAEKETDKILGVHIMAPNAGEIIHEAVIALQYGASSEDVARTCHAHPTVSEALKEACLQTFDKAIHI

SEQ ID NO: 8408 - protein, 441 aa, Zea mays
MAHRVVFFAADLDLASREGPRRGGEILGCVPRDDCAKALGFALSTGRKRGKTLGAMRYMWMHAIGSESGKAIIIDCDPGVRSPANNTKPATERAFEGMDTEFIPIVRSGGWADIGSRHTMEDVFICFDNFMQDFGIESFEEGPSAFYGIFDGHGGKHAADFVCSNLPRFIVEDEDFPREIVKAMSSAFLQADASFADACSLNCSLSSGTTALAALVVGRWEPFLFVFWPLKFAHAFHLNPQMLSYFCVWMLNRSLLVANAGDCRAVLCRRGKAIEMSRDHKPSCNREKIRIEALGGYVDDGYLNGQLNVARAIGDWHMEGMKACGGLGPLTAEPEVMTMDLTDEDEFLIMGCDGIWDVFLSQNAVDFARRKLQEHNDPAACCKELVDEAIKRKSGDNLSVVVVCFNSRPPPVLTTPRPRVQRSISAEGLRELQSFLDSLAD

SEQ ID NO: 8409 - protein, 63 aa, Zea mays
  misc_feature (30)..(30): Xaa can be any naturally occurring amino acid
MAGGRVAHATLKGPSVVKEIFIGLTLGLIXGGMWKMHHWNEQRKTRSFYDMLDKGQISVVVEE

SEQ ID NO: 8410 - protein, 482 aa, Zea mays
MALTRIGLAGLAVMGQNLALNIAEKGFPISVYNRTTSKVDETVQRAKAEGNLPVYGFHDPASFVNSIQKPRVVIMLVKAGAPVDQTIATLAAHLEQGDCIIDGGNEWYENTERREKAMEERGLLYLGMGVSGGEEGARNGPSLMPGGSFDAYKYVEDIVLKVAAQVPDSGPCVTYIGKGGSGNFVKMVHNGIEYGDMQLISEAYDVLKSVGKLTNSELHQVFSEWNKGELLSFLIEITADIFGIKDEHGDGYLVDKVLDKTGMKGTGKWTVQQAAELSVAAPTIEASLDSRFLSGLKDERVEASKIFQGDYYSTGSPVDKAQLVEDVRQALYASKICSYAQGMNIIKAKSAEKGWGLNLGELARIWKGGCIIRAIFLDRIKKAYDRNPGLASLLVDPEFAQEIMDRQAAWRRVVCLAINNGVSTPGMSASLAYFDSYRRDRLPANLVQAQRDYFGAHTYERVDMPGSFHTEWFKIARNISNN

SEQ ID NO: 8411 - protein, 154 aa, Zea mays
MALTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMGVSVFSSLLINAPCSKGDVHNSDKSR

SEQ ID NO: 8412 - protein, 105 aa, Zea mays
  misc_feature (85)..(85): Xaa can be any naturally occurring amino acid
MVCAKCEKKLGKVIVPDKWKEGASNTNESGGRKINENKLLSKKNRWTPYGNTKCIICKQQVHQDAKYCHTCAYSKGKKHTTKGTXVCAMCGKQVLDTKLYKQSNV

SEQ ID NO: 8413 - protein, 440 aa, Zea mays
MLSTASVPSTSFAAAFLSSRARRRRRAPWLRSVAAAAASGVGDGEVERFATSSSITDYLRYRRPELGCAGGAGGGGLPGGELQTAVVRFKKRFPWSLLHPFLHVDLVSTVHIADKEYFDRLQRELEDYDCVLYEMVTTRENLSNPKGPMAAKKMKSSRRGFSIIGFIQKQMARVLSLDYQLDCLDYGNEKWQHADLDYETFKQLQSERGESILTFAIDMTLKSTKALVQPSNMPDGLNFWRSKLLWASRVLPMPLVGLLVITGLCLPVEKQDGFPELEALSRLDFGAALKIFLAKQLTSEFTAVPTPVEEKSVIIGERNRVAAEKIREAINGGYKRIAVLYGGGHMPDLGRRLREELDMVPADVQWVTAWSIRSREIDSESLPLLKTLAEASGWPLNRYETLALLIFSSVLAVDLWFWELFFGTAVNCASLAGSWIGQLA

SEQ ID NO: 8414 - protein, 334 aa, Zea mays
MLPGLLAMGWNIVYQFRKAQREIDNYLRLVPLITLVDNARIRDRLEYIERDQCEYSFDEEDKKVQDALLNPDPCSNPTIVLKKTLSCSYPNLPFNEALRKESEKLQVELQRSQSNMDLGSCEVIQHLLGVTKTVESTIPEKETNVKAPEKKGSNYSESKGETAKSFDDDDDYPKKQNDEYPKKQKDTCSTQRCSSQVPYGHDLVSSRGSYSDEWHADLLGCCSEPALCLKTLFFPCGTFSRIASIAKDRPMSSGEACNDIMAYSLILSCCCYTCCVRRKLRQKLDIAGGCCDDFLSHLLCCCCALVQEWREVEIRGAYSEKTKVTPPACQYMEH

SEQ ID NO: 8415 - protein, 178 aa, Zea mays
  misc_feature (48)..(48): Xaa can be any naturally occurring amino acid
  misc_feature (55)..(55): Xaa can be any naturally occurring amino acid
RTRGETRGRTRGIIFGFNVRAPGTVKNTAKKTGVEIRMYKVIYDLIDXDLRKAMXGLLEPAEEEVPIGSAKVRAVFSSGSGKVAGCMITTGKVVQDCNVRVLRKGKEVYVGSLDSLRRVKETVKEVGAGLECGIGVDDFDEWEEGDIIEAFNTVNKARTLEEASATVTAALKDAGVQL

SEQ ID NO: 8416 - protein, 216 aa, Zea mays
  misc_feature (38)..(38): Xaa can be any naturally occurring amino acid
  misc_feature (55)..(55): Xaa can be any naturally occurring amino acid
  misc_feature (63)..(63): Xaa can be any naturally occurring amino acid
MGFLEDFQASVEALPSMLHRNYSLMRELDKSLHGSAAXIMAHDASALLLNCECAXILIMLIYXVDAHIQQLDQFMRKLEEIRQEKEAAAAVTAGTAVAITATPTVNAGATTADATLKSGRSGERGRGGRKKAKVPTEQPVPVPVPLPPIDLELPVDPNEPTYCLCNQVSYGEMVACDNPNCKIEWYHYGCVGVKEQPKGKWYCPNCIGFQKKRKGK

SEQ ID NO: 8417 - protein, 181 aa, Zea mays
ASLASLTRETGPKVVKGDPAAKGEAAAQGAPSTPRAHQQHRHPAAPAIAVSDSSLKFTHVLNNLSPAELYEQAIKYEKGSFITSTGALATLSGAKTGRSPRDKRVVKDEVTAQDLWWGKGSPNIEMDEKTFLINRERAVDYLNSLEKVFVNDQYLNWDPENRIKVRIISARAYHSLFMHNM

SEQ ID NO: 8418 - protein, 324 aa, Zea mays
IVCSKLKHLQLRNLLWPTSKHDVYLVQSYSVTHWSALLRRGREVLNVAGRLAPTQNVKGAGPLSRVQISAMAVKDNLMVAGGFQGELICKYVDRPGVAFCTSLTGGSSSITNAVDIHQAPSGATRVMAANNDCVVRTFDAERYSLLTQLTFPWSVNSTSVSPDGKLLAVLGDSTECVFADPQSGKALATLRGHLDYSFASAWHPDSRVLATGNQDATCRLWDARSLSEPFAVLGARIGAVRGLRFSPDGRFLAAAEAADFVHVYDAAAGYAGAAQEVDVFGEVAGAAFSPDGEALFVSVADRTYGGLLEFRRRRADRYLDACFF

SEQ ID NO: 8419 - protein, 183 aa, Zea mays
AEIYGKPTCRCSSEEADRDPATTAAACPVCSEMVTKDMVNHITTQHGYLFKNRRRLRRFIIPGSQALSLLSRDLREAHLQVLLGGGGQRSSDNSSSSSATNISADPLLSSFGLGFPTSDAEQASKSTVSIPDDATTVKEAPAQARKLSIDSSLTSEERELKRKQARVRATFVQDLLLSTLFGD

SEQ ID NO: 8420 - protein, 470 aa, Zea mays
MEADSGKLFVGGISWETDEDRLREYFGRFGDVTEAVIMRDRNTGRARGFGFVVFADSGIAERVTMEKHMIDGRMVEAKKAVPRDDQSIASKNNSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPIARSPAGGQNYAMSRVHNFLNGFNQGYNPNPLGGYGMRVDARYGLLAGARNGFSSFGPGYGMGMSVEGGMRGYFGASSGFVNSSNGRQIGSYFNGSSNRLGSPIGYVGLNDDSGSILSSMSRNVWGNGNLNYIGNHTNMNSFPQPGSGGGISGDEISWGSLTSAHGMSNISSLGSGNLGRGTGDNNFGLPSGNYVRSNSTGTIGEPFSASANAYESNNPGAYGSSSIYGDSTWRFNSSEVDMPPFGHDLGNDDPDIKSEISASYMGNYTVNNNQTSRGITS

SEQ ID NO: 8421 - protein, 97 aa, Zea mays
MTPRPTIHSFTGQRQPARRPAPTRVAKCQHSSLQVEAPRVQPKLSEPFLGFTQTAEIWNSRACMIGLIGTFIVELVLNKGILQMIGVEVGKGLDLPL

SEQ ID NO: 8422 - protein, 356 aa, Zea mays
MERGAGASEKGTVLVTGASGFVGSWLVMKLLQAGYTVRATVRDPANVGKTKPLMDLPGATERLSIWKADLAEEGSFHDAIRGCTGVFHVATPMDFLSKDPENEVIKPTVEGMISIMRACKEAGTVRRIVFTSSAGTVNLEERQRPVYDEESWTDVDFCRRVKMTGWMYFVSKTLAEKAALARSREHPENEVIKPTLVVGPFISASMPPSLITALALITGNAPHYSILKQVQLIHLDDLCDAEIFLFENPAAAGRYVCSSHDVTIHGLAAMLRDRYPEYDVPQRFPGIQDDLQPVRFSSKKLQDLGFTFRYKTLEDMFDAAIRTCQEKGLIPLATAAGGDGFASVRAPGETEATIGA

SEQ ID NO: 8423 - protein, 427 aa, Zea mays
MDIEADGRFGNKRVHNRLGPGSGGAPPSTNGKVCNYWRAGRCNRFPCPFLHSELPEAAPPKRPTGPGGNVWRNPNTGGRGGGHHNRWGKGPGGGSGIASHKPPERPCKYFLAGTECSYGERCRYPHSYCISDSIAMLTLLKGHEQGVTGIALPAGSDKLYSGSKDGTVRMWDCQTGQCAGVITMGREVGCMIIEGPWLFVGIPDAVKVWNMQTAAEMSLTGPTGQVYALAVASELLFAATQAGRILAWRFSAATNCFEPAASLDGHKLAVVSLIVGGMRLYSASMDKTIRVWDLATLQCIQTLSDHTDVVMSVLCWDQFLLSCSLDQTIKVWAATESGNLEVTYTHKEDQGALALSGMPDAQSKPVLLCSLNDNTVRLYDLPSFSDRGRLFSKKEIRAIQMGPGGLFFTGDGTGELKVWQWVDLAQT

SEQ ID NO: 8424 - protein, 224 aa, Zea mays
SYLRSEASFIRTSPGRICHRLASLPSSRESFGTGSDHIREKDGIWAVLAWLSIIAFKNKDNLGGDKLVTVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKTGRDSQEALAPLVDVALKLSKMQEYTGRSAPTVIT

SEQ ID NO: 8425 - protein, 272 aa, Zea mays
MMGGWGVSDGYEGSKRTRMMMESNPYFAVNAGSPLDVSKRSRIVEPGPPYFGAMGSNTGGASGGFYQPFNSSNLAGAGASTGIQNFPGVRLRGLPFDCNDIDICKFFVGLDIVDCLLVNKNGRFTGEAFVVFPTAMQTEFALHRNRQNMGRRYVEVFRCKKQEYYSAIANEVTQGGYFEPESRRSPPPPRPPRNPAEVKASMESTQVLKLRGLPSSATIKTISKFFLEPYLSTVIPCISPSASMVSPPPHPSFSYHHLYSFFSFLSKIKLTI

SEQ ID NO: 8426 - protein, 463 aa, Zea mays
  misc_feature (101)..(101): Xaa can be any naturally occurring amino acid
  misc_feature (128)..(128): Xaa can be any naturally occurring amino acid
  misc_feature (160)..(160): Xaa can be any naturally occurring amino acid
  misc_feature (222)..(222): Xaa can be any naturally occurring amino acid
  misc_feature (381)..(381): Xaa can be any naturally occurring amino acid
MAGAAAVETAAAAAAAAAAANGKACCHAAKGPGYATPLEAMEKGPREKLVYVTCVYNGTGINKPDYLATVDLDPSSPTYSQVIHRLPVTHIGDELHHSGKXWNSCSSCHGDPSAKRRFLILPSLLSGXRVYVVDTATNPRGAILGIRGVESEDIAENTGXLGFPHTSHCLASGDIMISCLGDKEGNAAGNGFLLLDSEFNVKGRWEKPGHSPLFGYDFWYQXPRHKTMISSSWGAPAAFRTGFDLQHVQDGLYGRHLHVYDWPGGELKQTLDLGDTGLLPLEVRFLHDPSKDTGYVGCALTSNMVRFFKAADGSWSHEVAISVKPLKVRNWILPEMPGLITDFVISLDDRYLYFVNWLHGDIRQYNIEDPAKPFLAGQVWXGGLLQKGSDVVYVTDDGQEQQYNVPQVKGHRLRGGPQMIQLSLDGKRIYVTNSLFSRWDEQFFGDDLVKKGSHMLQIDVDTE

SEQ ID NO: 8427 - protein, 126 aa, Zea mays
CFMLFPKGFSITWGSDAREIDPEEAKMEMEVAYLKDVCWLEIRAKLEMSHLTPGFTYVVDFVAKLEQNGYGWSEPVDLQINCPGDVDRKPRKESLWKTVDGKKWSYVNVGEVEAAGQNGEMEIAML

SEQ ID NO: 8428 - protein, 322 aa, Zea mays
RMKGEYPERVGQPECQYYLKTGTCKFGPTCKFHHPREKAGIAGRVQLNTLGYPLRPNEKECAYYLKTGQCKYANTCKFHHPELFNAVPSSRGSPIYTSVHSSASAGPQSYTGTMSSWTFPRASFIPSPRWQSPSNYAPMIVPHGLVQVPSWNSYPGQLQSPGAQQTYGSSQQGEASAGNQGMLSPYRSSSFPVPQYALQRDNVFPERPDEPECQYYMKTGDCKFGAVCKFHHPRVRSQPPPDCVLSPMGLPIRPGEELCKFYSRYGICKFGANCKFDHPTMAAPMGVYAYGFSGSASVAPASTNAPMTRRLLGSPSGSGYMS

SEQ ID NO: 8429 - protein, 427 aa, Zea mays
  misc_feature (265)..(265): Xaa can be any naturally occurring amino acid
  misc_feature (270)..(270): Xaa can be any naturally occurring amino acid
RCRCCAQQERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKMVSLELGGKSPLIIFDDADVDMAVNLSRLAVFFNKGEVCVAGSRVYVQEGIYDEFVKKAVEAARSWKVGDPERIIXSVGRXVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 8430 - protein, 346 aa, Zea mays
MRQPRSGPGKRRGRGPRIPAATLQKQKTALANVDQITGAKIPKSFVFSRGKLPSTLRHLQQDLRKVMLPYTALNLKEKKRNNLKDFVNVAGPMGVTHFLILSNPQSLPHLRFAKSPQGPTFTFQIEEYSLAADIANSQKRPRCPPGIFKNSPLVVLGGLTGLGNPFRSLVEYFQHMFPSVDPTTVKLATCQRILLLKHDKEKDVIEFRHYSIKLQPVGVSRRIRKLMQNNQVPDLGEFEDVSEFVKKAGYGSESEADDEAAMVSLPSDIDKLNRASRKSAVRLQEIGPRMTMRLVKVEAGLCSGDVLYPWPVEKEVVGKKGTETGEVEGQEDDSEATDESEDEMEV

SEQ ID NO: 8431 - protein, 345 aa, Zea mays
MRQPRSGPGKRRGRGPRIPAATLQKQKTALANVDQITGAKIPKSFVFSRGKLPSTLRHLQQDLRKVMLPYTALNLKEKKRNNLKDFVNVAGPMGVTHFLILSNPQSLPHLRFAKSPQGPTFTFQIEEYSLAADIANSQKRPRCPPGIFKNSPLVVLGGLTGLGNPFRSLVEYFQHMFPSVDPTTVKLATCQRILLLKHDKEKDVIEFRHYSIKLQPVGVSRRIRKLMQNNQVPDLGEFEDVSEFVKKAGYGSESEADDEAAMVSLPSDIDKLNRASRKSAVRLQEIGPRMTMRLVKVEAGLCSGDVLYPWPVEKEVVGKKGTETGEVEGQEDDSEATDESEDEMV

SEQ ID NO: 8432 - protein, 293 aa, Zea mays
IQEETKYYDLKDFVNNVAGPMGVTISFPLNPQSLPHLRFAKSPQGPTFTFQIEEYSLAADIANSQKRPRCPPGIFKNSPLVVLGGLTGLGNPFRSLVEYFQHMFPSVDPTTVKLATCQRILLLKHDKEKDVIEFRHYSIKLQPVGVSRRIRKLMQNNQVPDLGEFEDVSEFVKKAGYGSESEADDEAAMVSLPSDIDKLNRASRKSAVRLQEIGPRMTMRLVKVEAGLCSGDVLYPWPVENEVVGKKGTETAEVEGQEDDSEATDESEDEMVYDFRCFGQADAGVLTALDVPC

SEQ ID NO: 8433 - protein, 369 aa, Zea mays
  misc_feature (187)..(191): Xaa can be any naturally occurring amino acid
MDMGSGSSPVITDPISISPPLLGGLTSNLMPFSVMSGGCSSSPSMSASSRRKIEEVLVNGLLDAMKSSSPRKKHNLAFGQDNSPDEDPAYTAWLSKCPSALASFKQIVANAQGRRIAVFLDYDGTLSPIVDDPDKAFMSPVMRAAVRNVAKYFPTAIVSGRSRKKVFEFVKLTELYYAGSHGMDIVXXXXXHATEKCKEANLFQPACEFLPMINEVSKCLVEVTSSIEGARVENNKFCVSVHYRNVAEKDWKVVAGLVKQVLEAFPRLKVTNGRMVLEVRPVIDWDKGKAVEFLLRSLGLSDSEDVVPIYIGDDRTDEDAFKVLRERSCGYGILVSQVPKDTEAFYSLRDPSEVMGFLNSLVRWKKHPL

SEQ ID NO: 8434 - protein, 204 aa, Zea mays
  misc_feature (83)..(83): Xaa can be any naturally occurring amino acid
APQLHAGRSSSVSLASSVKTFSAALALSSVLLSSAATSPPPAAADIAGLTPCKESKAFAKREKNSIKKLTASLKKYAPDSAPXALAINAPIEKTKRRFENYGKFGLLCGADGLPHLIVSGDQRHWGEFVTPGLLFLYIAGWIGWVGRSYLIAVSGEKKPAMREIIIDVELATRLLPRGFIWPVAAYRELINGDLVVDDKDIGYY

SEQ ID NO: 8435 - protein, 342 aa, Zea mays
  misc_feature (329)..(329): Xaa can be any naturally occurring amino acid
KGHFVTVFERADRIGGLMMYGVPNMKTDKIGIVQRRVNLLFEEGVTFVVNASVGSDPLYSIERLRSENDAVILACGATKPRDLTIPGRELSGVHFAMEFLHANTKSLLDSNLEDGKYISARGKKVVVIGGGDTGTDCIGTSIRHGCTNLVNLELLSKPPTRGAADNPWPQWPRVFRVDYGHQEAATKFGKDPRTYEVLTRRFIGDGNGKVKALEVVRVKWEKVDGRFQLKEMEGSEEIIEADLVLLAMGFLGPEATIAEKLGLEKDNRSNFKAQFGDFATSVDGVFAAGDCRRGQSLVVWAITEGRQAAAAVDKYLSRYDQNAAATGDXTPSGTGLVQPVAA

SEQ ID NO: 8436 - protein, 448 aa, Zea mays
MSKEDVLKVQTLMLRVNIHCDGCEKKVKKTLHKIDGVYQSSIDAEQGKVTVSGLLDPDTIIRKLNKAGKPAQLWGSKPGITQNAYHGGGHKGPGGGGGGGGGVGNPKMVMPQPTPQQLQQLQQQLQMKGLKLPPHLLGGNMPAFPAAAPMKDPKSVKFALPEDNFDDYGSEFDDDFDDGFDDDEDDYDDDGLDDDVYGDPKMMMKPMAVPPPAGGGDKKGGGGKKGGGGGNEIPVQIKGNNHGGAGGQPHNAKGGAPGGGAHLGQGKKGGGSAAAVGVGGPMGGMLPQQGMMRPPNILGGAGAGFPSTAQMGGGPMGMPVGHPHMGIMQQGGGGGGGGMPGLGFHPGLGGGGMHSGADMLQAAAASGNPVAQQQYMALMQQQQQQMMMMQQQQQQHGNGGLGYPAAMGYGYGRPPMHYPMGYPVLPPHSHAEPYNIFSDENANSCSLM

SEQ ID NO: 8437 - protein, 388 aa, Zea mays
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILAEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 8438 - protein, 437 aa, Zea mays
  misc_feature (86)..(86): Xaa can be any naturally occurring amino acid
  misc_feature (388)..(388): Xaa can be any naturally occurring amino acid
  misc_feature (410)..(410): Xaa can be any naturally occurring amino acid
HASAHASAHASAHASAHASAHASAHASGIDNAMRALFLLALFCVVHGEKAKSKDNDAKASGPGGSFDITKLGASGNGKTDSTKAVXEAWASACGGTGKQTILIPKGDFLVGPLNFTGPCKGDVTIQVNGNLLATTDLSQYKDHGNWIEILRVDNLVITGKGKLDGQGPAVWSKNSCVKKYDCKILPNSLVMDFVNNGEVSGITLLNSKFFHMNMYKCKDMLIKDVNVTAPGDSPNTDGIHMGDSSGVTITNTVIGVGDDCISIGPGTSKVNITGVTCGPGHGISIGSLGRYKDEKDVTDINVKDCTLKKTANGVRIKAYEDAASVLTASKIHYENIKMEDSGYPIIIDMKYCPNKLCTANGASKVTVKDVTFKNITGTSSTPEAVNLXLCSAKIPCTGVTMDDVNINYSXGTNNKTMAVCKNAKGSAKGCLKALACF

SEQ ID NO: 8439 - protein, 410 aa, Zea mays
MACIDNAMRALFLLALFCTVHGEKAKSKDNDSKASGPGGSFDITKLGASGNGKTDSTKAVQEAWASACGGTGKQTILIPKGDFLVGPLNFTGPCKGDVTIQVNGNLLATTDLSQYKDHGNWIEILRVDNLVITGKGKLDGQGPAVWSKNSCVKKYDCKILPNSLVMDFVNNGEVSGITLLNSKFFHMNMYKCKDMLIKDVNVTAPGDSPNTDGIHMGDSSGVTITNTVIGVGDDCISIGPGTSKVNITGVTCGPGHGISIGSLGRYKDEKDVTDINVKDCTLKKTANGVRIKAYEDAASVLTASKIHYENIKMEDSGYPIIIDMKYCPNKLCTANGASKVTVKDVTFKNITGTSSTPEAVNLLCSAKIPCTGVTMDDVNINYSGTNNKTMAVCKNAKGSAKGCLKALACF

SEQ ID NO: 8440 - protein, 118 aa, Zea mays
MGTLFAVEGSYFEKFYKQTADMDPAQRAAFLEEDDEMEDAHSVALSAMMANVDVNEHFVCFSCVDGELYELDGRKSQPTSHGPSSPETLLQDAAKVIKARIAENPNSMNFNVMALSKK

SEQ ID NO: 8441 - protein, 113 aa, Zea mays
SAREFLLSCSLDQTIKVWAATESGNLEVTYTHKEDQGALALSGMPDAQSKPVLLCSLNDNTDDLYDQPSFTDRGTLSSTKEIRARHMVPGALIITGGGSGELKARRGVEGAEA

SEQ ID NO: 8442 - protein, 140 aa, Zea mays
QPGSRNPRTLIWSYICFCQLHCCRRQHVSKCLWTKGYLGGKKILGSSLTARASSTSKTTASARPTGVIALHLGESRKKRDEKPIAYLRQPSFRALLDKSQEDLAISHASGGSTIPCPEDIFINLTSRLRGIRSIQNFASS

SEQ ID NO: 8443 - protein, 167 aa, Zea mays
MLVYQDLLSGDELLSDSFQYKEIFDGVLWEVEGKWVVKGAVDVDIGANPSAEGGEDEGVDDQTERVVDIVDTFRLQEQPTFDKKTFVTNIKRYIKNLTGKLEPEKADEFKKGIEGATKFLLSKLKDLQFFVGESMHDDGSLVFAYYKEGATDPTFLYFAHGLKEIKC

SEQ ID NO: 8444 - protein, 402 aa, Zea mays
  misc_feature (183)..(184): Xaa can be any naturally occurring amino acid
MATKRSVGTLGEADLKGKKVFVRADLNVPLDDAQKITDDTRIRASVPTIKFLLEKGAKVILASHLGRPTGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYXXGAVANPKKPFAAIVGGSKVSSKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFNEALDTTKTVIWNGPMGVFEFEKFAAGTEAIAKKLAELTTTKGVTTIIGGGDSVAAVEKAGLADKMSHISTGGGASLELLEGKTLPGVLALDDA

SEQ ID NO: 8445 - protein, 170 aa, Zea mays
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCTDATQVYKELQEAIAAYPDAFHRVIGFDNVRQTQCVSFIAYKPPGSD

SEQ ID NO: 8446 - protein, 315 aa, Zea mays
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNMVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 8447 - protein, 154 aa, Zea mays
HEGNPNLYKDVFITSLAEFPGLVISAIIVDWLGRKATMWILLFGCCGFLGPLAVHQKESVTTALLFGARACGMGSSTVLCLYAPEVYPTSARSTGVGIATAIGKIGGIVCPLIAVGMLRSCHQMQAVLVFELVLGLAGVACILFPVETKGREMK

SEQ ID NO: 8448 - protein, 181 aa, Zea mays
METYTTDDALTAMGFGKFQALVLASAGTGWLPASMALLLLSFVGPLVRQQWNVSAQHESLLSSVVFTGMLLGACSWGYISDKYGRRTALLFSVTLTAGAGLTSALSPNYISLLALRFLVGVGVGGTHVFSSWFLEFVPTKNRGAWMLVFSAFWTIGTIFEASLAWVGLSRLSWRGLLAFTS

SEQ ID NO: 8449 - protein, 356 aa, Zea mays
  misc_feature (31)..(31): Xaa can be any naturally occurring amino acid
  misc_feature (138)..(138): Xaa can be any naturally occurring amino acid
  misc_feature (177)..(177): Xaa can be any naturally occurring amino acid
  misc_feature (201)..(201): Xaa can be any naturally occurring amino acid
VAAAAAQKAVTKKSAVAPAGKAAQPAATTEXPTKPAPPSQTVRDARGGGSSARGGFGRGERGRGRGGRGYGQNRGFSGDNGNDFQGGYGGGGYGDGAVTGGSEGERERDTRPPYRGGGRRGGYRDGWVCSMTLRGHHXRNYERHSGTGHGYEMKRDGAGRGNWGTATDELIAQDAEXLSEEEEAAPVAEKQGEQMMPQQQXENKGNKDATANEEEEKEEDKEMTLEEFEKIREEKRKALLALKAEERKVEVDKDLQSLQPLSNKKENDEVFIKLGSDKDKKKENAERDERAKKSVSINEFLKPAEGERYYGGRGRGRGRGERGGFRGGYGGGYSRGPAAAAPSIEDQAQFPSLGGK

SEQ ID NO: 8450 - protein, 420 aa, Zea mays
NWVPRGRQGDPSQLLPPLQSHLLHHPHTAADLIPPPLEESAEPTEGDHMGAEAAHPQQQPPSSVRPGREAAAPAVLGLQLSALIDHVARVDWSLLDRVPGDRGGSQQVSIVELNHILNEVNTHILPSHNDLTPVTTIAGGSVANTIRGLSAGFGISTGIIGACGDDNQGLLFVNNMSFSGVDLTRLRAKKGHTAQCVCLVDASGNRTMRPCLSSAVKIQANEFRKEDFKGSKWLIVRYAQQNMEQIVEAIRIAKQEGLSVSLDLASFEMVRDSRSKLVNLLETGNIDLCFANEDEAREVIGGSLESDPEEALAFLGKYCKWAVVTLASKGCMAKHGKQVVRVPAIGESNAVDTTGAGDLFASGFLYGLVKGLPLEECCKVGACSGGSVTRALGGEVRPENWQWMYKQMHARGLLLPELKN

SEQ ID NO: 8451 - protein, 193 aa, Zea mays
  misc_feature (109)..(109): Xaa can be any naturally occurring amino acid
  misc_feature (176)..(176): Xaa can be any naturally occurring amino acid
ARCGLGGLGVVAEVTLQCVERHQLVEHTFVSNADEVKKNHKKWLSENKHIKYLWIPYTDTVVVVQCNPPSKWITPKLASKYGKDEALQHVRDLYRESLKKYRCFSELKXESKDPEIDTLSFTELRDKLLALDPLDKDHVVKINKAEAEYWKKSEGYRMGWSDEILGFDCGGQQWVXSENCFPHWNPLKKKKRE

SEQ ID NO: 8452 - protein, 205 aa, Zea mays
  misc_feature (16)..(16): Xaa can be any naturally occurring amino acid
PAEIQASATRALAKGXTFEDVISMVKGVIPDLSCPVALFTYYNPILKRGVPNFMSIVREAGVHGLVVPDVPLEETDVLRSEAAKNNLELVLLTTPTTPNERVEKIAQASEGFIYLVSTVGVTGTRANVSGKVQSLLQDIKKVTEKPVAVGFGVSTPEHVRQIAGWGADGVIIGSAVMKTLEEAASPEEGLKKLEEFAKNLKAALP

SEQ ID NO: 8453 - protein, 280 aa, Zea mays; identical to SEQ ID NO: 700

SEQ ID NO: 8454 - protein, 346 aa, Zea mays
RPGSLFTCLAWAGAPAASSDLSPHFSHAHSLLPSPITTLPLQFTPTAPPLPLKSRAIADPPPPRSGRLPSRPIGSCSVDGTLNCGYSSFRGKRASMEDFYDIKSSKIDDKQIHLFGIFDGHGGSRAAEYLKEHLFENLMKHPGFMTNTKLAINETYRKTDSEFLDAERNSHRDDGSTASTAVLVGDHLYVANVGDSRAVISKAGKAIALSEDHKPNRSDERKRIESAGGIIMWAGTWRVGGVLAMSRAFGNRLLKQFVIADPEIQEQEINDELEFLIIASDGLWDVVPNEDAVSLVKMEEDPEAAARKLTETAFSRGSGDNITCIVVKFEHDKPGGGGYSPPGDKS

SEQ ID NO: 8455 - protein, 218 aa, Zea mays
MEASLLVAPKPSMPRTIFSARRAGRSWRCLVVAATIKQQLGTRSESVDVDAPVEHLAPPSKATTGARGGLLAAVATTTSSCTAVLPCHALSGAGAVESGPWWWTSPLDTLYRAAAVLGDLDPATARAVAGVAGPVLSAFGFLFILRIVMSWYPRLPVTEFPYVVAYAPTEPFLAVTRRVIPPLGGVDVTPVVWFGLVSFASEILVGPQGLLVLLSQQR

SEQ ID NO: 8456 - protein, 270 aa, Zea mays
GECAGGGAEGGRRSSLQDFSNVTGPMGVTHLLILSNPQSLPHLRFAKSPQGPTFTFQIEEYSLAADIANSQKRPRCPPGIFKNSPLVVLGGLTGLGNPFRSLVEYFQHMFPSVDPTTVKLATCQRILLLKHDKEKDVIEFRHYSIKLQPVGVSRRIRKLMQNNQVPDLGEFEDASEFVKQAGYAITPRDPTTEHAMQTCPAATGPLIRPTPSTAFVITSPPADPTPGAMPPLSHTKTRLTHLHPHTRNPSSPSLHPRTRYHRLAPHPTAV

SEQ ID NO: 8457 - protein, 331 aa, Zea mays
MASVEGKRETVLVTGASGFIGSTLVGLLLDRGYNVHASVLNPDDKAETEHLVALGAGAGEGRLRVFPGDLLDGAALMAAARGCSGVFHLATPCTVYPVSDPQGQMVVPAVEGTLNVLRAAKEARTVRRVVVTSSSSAIIPSPAWPAGEPRDERCWADVDYCKKNEVWYPVSKTLAEKAAWRFAEENGVDVVVVNPVTAMGPMIPPTINCSMIVLLRLLQGCTEEYRDIWMGAVHVHDAAMAHILVFESPAASGRHICAQSISHWSDFAAKVAELYPEYKVPKFPKDTQPGLVRQGAEEGSKKLVALGLHFSPLEKIIRDAVEALKSRGYIS

SEQ ID NO: 8458 - protein, 591 aa, Zea mays
  misc_feature (393)..(393): Xaa can be any naturally occurring amino acid
MPTMHALRLCPLLSTIRSTPPRATAAARQGALFVARCSSAGTPSAAQALKISSIPTKPVEGQKTGTSGLRKKVKVFQQENYLANWIQALFNSLPPEDYVGATLVLGGDGRYFNKEAAQIIIKIAAGNGVQKIIVGRNGLLSTPAVSAVIRKRKANGGFIMSASHNPGGPDNDWGIKFNYSSGQPAPETITDQIYGNTLSISEIKTADIPDTDLSSVGVVSYGDFAIEVIDPVSDYLELMENVFDFQLIKDLLSRPDFRFIFDAMHAITGAYAGPIFVEKLGADPDCILNGVPLEDFGNGHPDPNLTYAKELVFTMFGTHAPDFGAASDGDGDRNMILGKRFFITPSDSVAIIAANAQAAIPYFQFGTKGLARSMPTSGALDRVAEKLNVPFFXGKLSICGEESFGTGSDHIREKDGIWAVLAWLSILAHRNKDKKVGERLVSVEDIAMEHWKTYGRNFFSRYDYEACESHSANQMMDHLRDVMANSKPGEKYGNYTLQFADDFSYTDPVDGSTVSKQGLRFVFTDGSRIIFRLSGTGSAGATIRLYIEQFESDISKHSLDAQTALKPLIDLALSVSKLKDFTGREKPTVIT

SEQ ID NO: 8459 - protein, 176 aa, Zea mays
STQRPDPLVVGNVVGDIVDPFITTASLRVFYNNKEMTNGSDLKPSQVMNEPRVHVGGRDMRTLYTLVMVDPDAPSPSNPTKRENLHWLVTDIPETTDASFGNEIVPYESPRPIAGIHRFAFVLFRQSVRQTTYAPGWRSNFNTRDFAAIYGLGSPVAAVYFNCQRENGCGGRRYIR

SEQ ID NO: 8460 - protein, 258 aa, Zea mays
  misc_feature (194)..(194): Xaa can be any naturally occurring amino acid
MADSMVASFWGPVTSTTELCEENYAHSSYIAEFYNTISNVPCVLLALIGLVNAFCQGFEKRFSVLHISNMILAIGSMIFHATLQLLLQQSDETPMVWEILLYMYVLYSPDWHYRSTMPTFLFLYGAAFAVVHFFARFQFVFKLHYIGLCFLCIPRMYKYYIQTKDVAAKRLAKLWVLTLTLGTLCWLVDRILLXKKLSHWYVNPQGHAWWHVLMGLNSYYANTFLMFCRAQQRGWEARITYLLGFLPYVKVQKPEKRE

SEQ ID NO: 8461 - protein, 289 aa, Zea mays
MEIFVLLRFRLQDNIGGGKVLFQGKSDYQNVMVFQSSTYGKVLVLEGVIQVTERDECAYQEMITHLPLCSIKDPKKVLVIGGGDGGVLREVSRHTSVEQIDICEIDKMVVDVSKQFFPHLAVGFEDPRVSLHIGDGVAFLKNAPEGTYDAVIVDSSDPIGPAQELFEKPFFQSVARALRPGGVVCTQAESIWLHMHIIEDIFVNCRQVFKGSVNYAWTTVPTYPSGVIGFMLCSTEGPAVDFQHPVFNIEEDEHSTKSKGPLKFYNSEIHTASFCLPSFAKRVIESKAS

SEQ ID NO: 8462 - protein, 300 aa, Zea mays
  misc_feature (141)..(141): Xaa can be any naturally occurring amino acid
  misc_feature (172)..(172): Xaa can be any naturally occurring amino acid
  misc_feature (257)..(257): Xaa can be any naturally occurring amino acid
  misc_feature (287)..(287): Xaa can be any naturally occurring amino acid
MSGGTPAASSSLRAALSYCVRQVRAYDYHHYLCLLHLAPAVRKAAFTFRAFNIQTARAMDVVSDPRTGLMRLLWWKEAVDKVFGNKLVEHLVAQALSSVIADHKVSKHWLKRSVEARINDTNREEGTIPGTSAELERYAEXTQSTIAFTSLQAGGIQSTVAGRLCRHIGKAXLLKALPHHVNKQGTVHYIPASVAEECGLLITREGGRSEVRAGVRLPDVVFKVTSVAEAHLHKARELASSVPKEAIPVLLPALPAXVLLDTLRRCEFNVFDPRLSRGVHEVSPLWXQLKLNWNAWRSRY

SEQ ID NO: 8463 - protein, 218 aa, Zea mays
PPTDLQLQRVSLPTWAEFELGRAPVYWKTSSGLPPSPGEGLTLFYNPAATKMAPNEVFGVAFNGGFNQPIMCGGEPRQMTLQERGKADPPIYTIRIRVPQHAVSLIFSFTNGAEWDGRYTPKRTRCSGSPPPWQNKPLSFFNEGLADELNREGACDLAIYPDENIAITSCAMDGYLEEGGDRCKLDIVSGCTDPSSDMFDPLATVDDGSCPLESDSEE

SEQ ID NO: 8464 - protein, 517 aa, Zea mays
MGCWRSSLRSGPHAAEKPPRHRHRPPPPPTNGPTSSLNAQQAAPPARASGEVPALAEFSLAELRAATAGFAPGNIVSESGEKAPNLVYRGQLRGPGGAPPRAVAVKKFAKLAWPDPKQFAEEAKGVGGLRHRSMANLIGYCCDGDDRLLVAEFMPNDTLAKHLFHWENQTIEWAMRLRVAYYISQALEYCSTKGWPLYHDLNAYRVLFDENGDPRLSCFGLMKNSRDGKSYSTNLAYTPPEYLRNGRVTPESVIFSFGTVLLDLLSGKRIPPSHALDIMRGRNIQAVMDSHLEGNYSIEVATTLVNLASQCLQYEPRDRPGIKKLVSILEPLQKKIEVPSYVMLGFAKPVEEPQAPPTPQRPLSPMGEACSRMDLTAIYQILFTTHYRDDEGSNELSFQEWTQQMRDMLDARKRGDSAFKDKDFKAAIDCYTQFVDVGIMVSPTVFARRSLCYLMCDQPDAALRDAMQAQIVYPDWPTAFYMQAVALSKLNMQSDAVDMLNEASQLEEKRQKSTRVP

SEQ ID NO: 8465 - protein, 583 aa, Zea mays
  misc_feature (184)..(184): Xaa can be any naturally occurring amino acid
  misc_feature (195)..(195): Xaa can be any naturally occurring amino acid
  misc_feature (224)..(224): Xaa can be any naturally occurring amino acid
MLSRLAAARRQLLLSPAVAYRSSSAAATASAVHERAAPASASVLPDTLERGSDAYQRNTAAVGGLLSDLRARVSQVLRGGGAEAVRRNAARGKLLPRDRIDRLLDPGASFLELSQLAGSDVYDEALPSAGIITGIGPVHGRLCMFVANDPTTKGGTYYPLTVKKHLRAQEIASECKLPCIYLVXGANLPARQADXFPERDNFGIFYNLSSGSTTCKGCYRRGDXLLMRLVEHQYLGGAYIPAMADESVIVKGNGTIFLAGPPLVKAATGEEISAEDLGGASVHCKVSGVSDHFAQDEIHGLELGRNIVKNLHLAAKGTNIQSSACGYQEPLYDVEELRSIAPADVKQSFDIRSIIARIVDGSEFDEFKKLYGTTLVTGFARICGQPVGIIGNNGILFTESALKGSHFIELCAQRHIPLIFLQNITGFMVGSKSEASGIAKAGAKMVMAVSCAKVPKITIIVGGSFGAGNYGMCGRAYSPNFLFLWPTARISVMGGIQAAGVLAQIEKNNKRRQGVEWSKDEEEAFKAKVVEAYDREGSPYYSTARLWDDGVIDPADTRRVLSLCLSASAKPVPEDTRYGVFRM

SEQ ID NO: 8466 - protein, 172 aa, Zea mays
  misc_feature (45)..(45): Xaa can be any naturally occurring amino acid
  misc_feature (164)..(164): Xaa can be any naturally occurring amino acid
MPRSRINGNFIDKTFSIVANILLQIIPTTSGEKRAFTYYRDGAIXNYAEALQNYYEAMRLEIDPYDRSYILYNIGLIHTSNGEHTKALEYYFRALERNPFLPQAFNNMAVICHYGFLYSNRGEQAILQGDSEIAEAWFDQAAEYWKQAIALTPGNYIEAQNWLXITKRFEFE

SEQ ID NO: 8467 - protein, 417 aa, Zea mays
MTDGDDEYKREESVALLVIVFLAALSLLSVIAAFAYYCYITRKVSRRLQAFHIPKRSSSHHTLPPRALPPQQQGTDNPSSNSTRDGVGAAAMSVVAAGERGVQVFSYRQLHAATGGFDRAHMVGQGSFGTVYRGVLPDGRKVAVKLMDRPGKQGEDEFEMEVELLSRLRSPYLLGLIGHCSEGEHCLLVYEFMANGGLQEHLYPNRGSCGGISKLDWDTRMRIALEAAKGLEYLHEHVNPPVIHRDFKSSNILLDKDFHARISDFGLAKLGSDRAGGHVSTRVLGTQGYVAPEYALAGHLTTKSDVYSYGVVLLELLTGRVPVDMKRSPGEGVLVNWALPMLTDRDKVVRILDPASEGQYSLKDAVQVAAIAAMCVQPEADYRPLMADVVQSLVPLVKNRSNQKACNPNVQSSKPLD

SEQ ID NO: 8468 - protein, 702 aa, Zea mays
  misc_feature (50)..(50): Xaa can be any naturally occurring amino acid
  misc_feature (229)..(229): Xaa can be any naturally occurring amino acid
  misc_feature (287)..(287): Xaa can be any naturally occurring amino acid
  misc_feature (311)..(311): Xaa can be any naturally occurring amino acid
  misc_feature (325)..(325): Xaa can be any naturally occurring amino acid
  misc_feature (342)..(342): Xaa can be any naturally occurring amino acid
  misc_feature (464)..(464): Xaa can be any naturally occurring amino acid
LEFRCCRRCCRSFDSRLHIFFDMVDKNADGHITEAEVKEIIMLSASTRPXANKLSRLKEQAEEYAALIMEELDPEGLGYIELWQLETLLLQKDTYMNYSQALSYTSQALSQNLAGLRKGSPIRKISTTLNYYLEDNWKRVWVLAVWIGIMAGLFIWKFIQYRNRYVFDVMGYCVTTAKGAAETLKLNMALILLPVCRNTITWLRNTKAARALPFDDNINFHKTIAAANXLVLFFHAGNHLVCDFPRLISSSNVKYAPLGQYFGETKPTYFTLVRGVVGVTGVIMVIXIKLALVMNTMAICPRQFEFHKPLXTYSKVNAAYRNKRXEDVMYVSHLCFNMLLSXDEFESRKTTWMYLAVPVCLYVGERVLRFFRSGSYSVRLLKVAIYPGNVLTLQMSKPPAFRYKSGQYMFVQCPAVSPFEWHPFSITSAPGDDYLSIHVRQLGDWTRELKRVFAAACEPPVGGXKSGLLRADETTKKALPKLLIDGPYGSPAQDYSKYDVLLLVGLGIGATPFISILKDLLNNIIRMEEEEEASTDLYPPVGPNKPHIDLSTLMTVTSKPKRVLRTTNAYFYWVTREQGSFDWFKGVMNEIAELDQRNIIEMHNYLTSVYEEGDARSALITMLQALNHAKNGVDIVSGTKVRTHFARPNWKKVLSKIASKHPFAKIGVFYCGAPVLAQELNKLCHEFNGKSTTKFEFHKEHF

SEQ ID NO: 8469 - protein, 325 aa, Zea mays
MASNGDKGLIVSFGEMLIDFVPTESGVSLAEAPGFLKAPSGAPANVAIAVSRLGGRSAFVGKLGDDEFGHMLAGILRKNGVDDQGINFDTGARTALAFVTLRADGDREFMFYRNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGAGDSFIGALLNQIVDDRSVLEDEERLRKVLRFANACGAITTTKKGAIPALPSDAEVRSFLEKK

SEQ ID NO: 8470 - protein, 297 aa, Zea mays
MECEPEELHVAISHALFTHIDSDDTALDASSPGTDTQRRLLSRLASDWLALLLFKSAYLLALLLLSLLSVAASVFSVASVYSAKRDALTFPRVLSVVPRVWRRLAATFLAAFALLFAYHAVAVLVFVGLLVAADNGSGLAGLLAFLVAVAYLLGLVYLGVVWHLASVVSVLEDHKGFAAMRKSKDLIRGKLVTAGAIFFTLNVVFAAVELGFRAWVVRGSGAASSRLLLGLIMLAALCCVVMLALVTQTVVYLVCKSYHHESLDKANISDHLEVYLGDYVPLKASDVQMEQFQPGNL

SEQ ID NO: 8471 - protein, 497 aa, Zea mays
  misc_feature (217)..(217): Xaa can be any naturally occurring amino acid
MATCATTLAPLLGPAANATEYLCNQFADTTSAVDSTYLLFSAYLVFAMQLGFAMLCAGSVRAKNTMNIMLTNVLDAAAGALFYYLFGFAFAYGTPSNGFIGKHFFGLKRLPQVGFDYDFFLFQWAFAIAAAGITSGSIAERTQFVAYLIYSAFLTGFVYPVVSHWVWSADGWASPTRTSGKLLFGSGIIDFAGSSVVHMVGRHRGAAGRAHRGPPHXRFDHAGRSVALKGHSASLVVLGTFLLWFGWYGFNPGSFTTILKSYGPAGTVHGQWSAVGRTAVTTTLAGSVAALTTLFGKRLQTGHWNVVDVCNGLLGGFAAITAGCSVVEPWAAVICGFVSAWVLIGANALAARFRFDDPLEAAQLHGGCGAWGVLFTGLFARRKYVEEIYGAGRPYGLFMGGGGKLLAAQIIQILVIAGWVSCTMGPLFYALKKLGLLRISADDEMSGMDLTRHGGFAYVYHDEDPGDKAGVGGFMLKSAQNRVEPAAAVAAATSSQV

SEQ ID NO: 8472 - protein, 247 aa, Zea mays
SRSREKRISHGGEPTTNSPIRLLACGLIRLKVPREHSPNPASNPMAASAGSKIRNAKLVLLGDVGAGKSSLVLRFVKGQFVEFQESTIGAAFFSQTLAVNDETVKFEIWDTAGQERYHSLAPMYYRGAAAAIVVYDISNQASFTRAKKWVQELQAQGNQNTVVALAGNKADLLEARHVPVEEAKTYAQENGLFFMETSAKTAINVNDIFYEIAKRLLQGQEAPSPQAGIVLNQRPDERMVSTSSCCS

SEQ ID NO: 8473 - protein, 239 aa, Zea mays
MPRYDDRHGNTRLYVGRLAPRTRSRDLEYLFSKYGRIREVELKRDYAFIQEFSDPRDADDAQYNLDGREVDGSRIIVEFAKGVPRGSGGSREYMGRGPPPGTGRCFNCGMDGHWARDCKAGDWKNKCYRCGESGHIERNCQNSPRNLRRDKSYSRSPSPRGGRGRSRSYSRSRSYSRSRSPSGSPRGGRRERDERRSRSLSYSRSASPRRSVSPAKEKERSRTPNGSRRAQGAPAQGLR

SEQ ID NO: 8474 - protein, 241 aa, Zea mays
MAANLEDVPSLDLMHELLRRMKCSSKPDKRLIVIGPPGSGKGTQSPIIKDEYCLCHLATGDMLRAAVAAKTPLGIKAKEAMDKGELVSDDMVVGIIDEAMKKPSCQKGFILDGFPRTVTQAQKLDEMLAKQGANVDKVLNFAIDDAILEERITGRWIHSASGRTYHSKFAPPKSPGVDDVTGEPLIQRRDDTAEILKSRLEAFHRQTEPVIDYYSKKGLVVNLPAEKPPKEVTAEVLKALS

SEQ ID NO: 8475 - protein, 158 aa, Zea mays
  misc_feature (23)..(23): Xaa can be any naturally occurring amino acid
MAAVAIHQFAECITCHAWSPDQXHDQMVSGIDWSKSSNKIVTVSHDRNSYVWTQEGSDWVPTLVILKLNRAALCVQWSPKENKFAVGSGAKSVCICYYEQENNWWISKVIRKKHESSVTSLAWHPNNIYLATSSTDGKCPWEAVPNLCVFVTMNKKIT

SEQ ID NO: 8476 - protein, 253 aa, Zea mays
MGRELFEVILIERAGRTWLSSLSASTSSSSWREKAEDNTKMSKMAEEKAAAVGGLGGAGAADAAQQQQLAAGEAAAARVRPVETLLRAAPLGLCVAAMTVMLRNQQSNEYGAVAYSDLGGFKYLVYANGLCAAYSLVSAFYTAVPRPATVSRSWLVFLLDQVFTYLILAAGAAAAELLYLAYNGDKEVTWSEACGVFGSFCRQARTSVAITFGTVLCFILLSLISSYRLFSAYEAPPSSALGSKGVEIAAYPR

SEQ ID NO: 8477 - protein, 170 aa, Zea mays
MAMSAGRGLLVLFFSAAVVAELASAANGPFLSDSVFQSSAGSTGRSLLQAKNSCPVNFEFQNYTIITSKCKGPKFPASQCCAALKEFACPFNNYLNDESNECASTMFSYINLYGKYPPGLFSSECKEGKMGLSCADVPRKDSSTANSGYRAQSSLLALINVLSVIAALFY

SEQ ID NO: 8478 - protein, 385 aa, Zea mays
MARLLLLLGASVLLLASAVTAQDCLSATFSGGRTFGKCNSLPSLSASLHWTYHAENGTADVAFRAPSDPSGWVAWGINPDSGGSMEGSSVFVASQDGSGAVSILMTNLESTSPSLTNTTALKFKVPAGPAAEYSDRAYTIYATVELPRNSTQQFTVWQAGPATSNGGISPHPTAPANLASTQRLDFLSGSSTAASNSKLHRRNIHGMLNAIAWGVLIPTGAIIARYLRVFESADPAWFYLHIACQCSGYVLGVAGWGLGLKLGSESAGVTYQPHRSIGIAIFCLATLQVLALLLRPDKKNKYRLYWNIYHHSVGYAVIVLSAVNIFKGLHILEPASGYKTAYIVILATLAGIALCLEAITWPIAIRKRRRNADKASGGNGWQQGA

SEQ ID NO: 8479 - protein, 385 aa, Zea mays
  misc_feature (230)..(230): Xaa can be any naturally occurring amino acid
MILADGLFNFLSIVACTLHTMRKRRSRQQPIIIQGGGCGGGSEAGPGDTPPTRPHCLNAAAEQPKKSFDDRRRAQVFLRDHISNSVNIVCYVLLSMVSVAAIPYLYPQMRRAHVALIYLAAPVVAFCDAYAFGVTDMNLSSTYGKLAMVLVGSSVGRNDGGVVAGLVACGIVMGTMSNANNLMQDLKTGYLTLTSPHTVFISQAIGTALGCVVNPVMFWAFYRVVQNGGXDVFDAPYARVYRSIAMLSAGQDGIPMHSLWLCKLFFALALALSVFREVAMWKRWRVAHYIPSIICVAIAFVVPARIPIDMFVGSLVLYLWRRADPSKAPTFSMAVASGMICGDGLGMLLSSTMALMHARAPICIKFMSRTDNVKLDAFLATLPVT

SEQ ID NO: 8480 - protein, 591 aa, Zea mays
ALAEEAKSRYDKASFKVVDLDDYAAEDEEYEKLKKEKLALFFVATYGDGEPTDNAARFYKWFTEGNERGVWLNDFEYAVFGLGNRQYEHFNKVAKVVDEILTEQGGKRLVPVGLGDDDQCIEDDFNAWKEALWPELDRLLRDENDASPGPTYTAAIPEYRVEFIKPEEAAHLERNFSLANGHAVHDAQHPCQANVVVRQELHTPASDRSCTHLEFDIAATGLTYETGDHVGVYTENCPEVVEEAERLLGYSPDTFFTIHADKEDGTSLSGSSLAPPFPSPITVRNALARYADLLNSPKKASLVALASYASNPAEADRLRFLASAAGKDEYAQWVVASQRSLLEVMAEFPSAKPPLGVFFAAVAPRLQPRYYSISSSPSMAPTRIHVTCALVRETTPAGRVHKGVCSTWIKNAVPSEESKECSWAPIFVRQSNFKLPADPSVPIIMIGPGTGLAPFRGFLQERLAQKESGAELGRSVFFFGCRNSKMDFIYEGELNNFLEQGALSELVLAFSRQGLAKEYVQHKMAQKASEIWDMISQGAYIYVCGDAKGMARDVHRVLHTIVQEQGSLDSSKAESFVKNLQMEGRYLRDVW

SEQ ID NO: 8481 - protein, 269 aa, Zea mays
VRIDVPPTSPGRAALKVWEELVNVLRKDGADPAAAFVHRKKVQHAEKSIRDAFLALYRGLDLLNKFSSLNVKAFTKILKKFVKVSEQQRKTDLFSEKVKRSPFSSSDKVLQLADEVECIFSRHFAGNDRKVAMKYLKPQQPRNTHMITFLVGLFTGTFVSLFIIYSVLALVAGIFSSTGNTAYMEIVYHVFSMFALISLHVFLYGCNLLAWKSSRISHNFIFDFSPSTALTHRDAFLVSASIMCTVVAALVVNLFLSTPGRPTPTRCPA

SEQ ID NO: 8482 - protein, 181 aa, Zea mays
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTDA

SEQ ID NO: 8483 - protein, 401 aa, Zea mays
MSCPRLLLAALAATVARPYAAARAAGAGAGACRAERLSSNRVFQTCADLPRLGASLHWSYDAAASSLSVAFLAAPPSAGGWVAWGLNPKGQSMDGTQALVAVPSGGGGGGGAYEVQTYSISGTSLGSPGAPLAYPTSDLAAELGGDGRVRIFGTLKLPNGTGGAEVNQVWQVGPYSGGIQIHERKGDNMNAKGTLNLLTGATAAASGGGSILRKKNTHGILNAVSWGLLLPMGAIFARYLKTFRSADPAWFYLHVACQLLGYGVGVSGWATGIHLGNLSKGITYSLHRNIGITVFALGTLQIFALFLRPKKDHKYRVYWNAYHHSVGYTVIVLGVVNIFKGMAILDVEQRWKTGYIAAISVLGAVAVALEAVTWGVVLRRRKEESKSYNGTSNAGRLPLSM

SEQ ID NO: 8484 - protein, 610 aa, Zea mays
  misc_feature (235)..(235): Xaa can be any naturally occurring amino acid
MGPLLRAAALSVALLALAAVGEAHSATEFLNIFKPRNEHDYFHNANQEEDVMPRASDQQNLITAPVTKSGLMKVPPRSAPTAVAQDTVVLPVDNAAGFPGAWSLISENAGVSAMLMVIMPTDRFIMFDTYTSRPSLLLPAGCGAVTDAQRVEPGALGIQRRRPCRPGRRRGRARRVITVSLKNMSTDGRPLSCPGGRMMGNPVDKLSSVSIEKSGWAWFLEAGEGMTRWLTATPXAPAEVLGVREVVERHQRVADAQAIPLQILRDTTDDVENNLYPFVHLLPDGTLFIFANDRSILFDPRNGQVVREFPVLPGGGRNYPASGMSALLPLDLRRGDVLSPEVIVCGGSPKNAFTLGESNTFPPALKDCARINPLKPDARWALDQMPVARTMGDLLILPTGDLLILNGAAKGCSGWGFGRQPVLSPLLYSPRQARGSRFRALAPTTIPRMYHATSAVLPDATVLVAGSNTNSAYNFSGVDFQTEVRVERFTPPYLAPERAANRPAIDVATVPGDGMAYGAKFTFQFSTPVQAVAEPDLKVTMYAPPFTTHGYSMNQRLLVLSVTAFAANGQRYTITVDAPGKPELAPPGYYLLYVIAKGVPSKAAWVKVHK

SEQ ID NO: 8485 - protein, 563 aa, Zea mays
MSEANTTQLDLEKGFSQVSNDNDSSSPATMHKMKVETEDGGSEIESPTPEKRESRSKGVVVSSLARNLLAERYRDRFSNQLVEDEGQTDDEDYNGSVSPSGSQSLFSESIELLEKHKDLLSLFNRMESSIRLLHLRKKMATFNNIATQVEILTKRKLLYSHLAQMKHLFPEAIQIKRILVHDEKSICMYADMEITLVMDVVECTSPDHSLSMTICEAFYSKLLRFLDAHHKGADIPEAILPEPFNSRPREKLYLEAVHNGHAAEPPLHGAVEEGFSNASHFPQSFQKFMSKKIIADGTEKTQLLSDPAELSSVSAYGTKGSNRNPKKQDEHAPVPVNSEISATPSRHLISCCQESTPKQQTSESPLLSGTPAMQTPKRPLLAPLEKPKATCGHISEPRSASSARRSLNTSLTYEGGSPSYYDGMEHTATAKKCMISEDLSSFNKSFEEDSHVFFTDKDKINEVESVDSQERIASLRTTFDIVYDISHSTKNPLITKQELFHNILANNLEIEEIGEIEEQLHILEDLAPDLISKKVINGGEILYSIEPITDKNSVRARLVVEPV

SEQ ID NO: 8486 - protein, 428 aa, Zea mays
  misc_feature (185)..(185): Xaa can be any naturally occurring amino acid
  misc_feature (208)..(208): Xaa can be any naturally occurring amino acid
MADLTDIGCCSCFSFLRKPSVPVRQHQDADGMLSEDLLKRQSAEDPDGSFYTGDDPDVSFYNGDDLDRSFYNGDDPDRSFYDRDDTDYIEGSDDGPPRKSSEDIVQLRTQNGFACREISVKETKKVFRSEDENGNKMVNQYVHLGKIGSGSYGKVVLYRNIKDGKLYAVKVLNKPYMMKVRVVRXETAIDQMFFREVSLMKMLNHPNXFVNPGEVIDDPNMDKFYMVLEYVEGKMVCDNGLEEATARIFLRDIISGLLYLHSHNVIHGDIKPDNLLVTSTGNVKIGDFSVSQVFEDDDDMLWRSPGTPVFTAPECCQGSAYHGRASDTWAVGVTLYCMVSGHYPFLGDTLQETYDKIANDPVEIPGDVNPQLADLLLRLLCKDPGDRITLRAAAEHPWVAGDEGPVPEFICRCGFGRRKRNDVREEVQ

SEQ ID NO: 8487 - protein, 240 aa, Zea mays
QLFFGRCGRCSIMKMLNHPNIVNLVEVIDDPNIDKFYMVLDYVEGKMVCDNGLEEGTARNYLRDIISGLMYLHSHNVIHGDIKPDNLLVTSAGNVKIGDFSVSQVFEDDDDMLWRSPGTPVFTAPECCQGSAYHGRASDTWAVGVTLYCMVSGHYPFLGDTLQETYDKIANDPVQIPGDMNPQLADLLLRLLCKDPGDRITLQAAAEHPWVAGDEGPVPEFICRCGFGRRKRNDVREEVQ

SEQ ID NO: 8488 - protein, 124 aa, Zea mays
MDVLLGSGRFLARRPPLALVPRCSRGSPDKSGSDKGETSADWDKAWSAFKKKGKRTLFSDFSPDKYVIWNPRRSEYPLSEEVDPIKRSERSNLMLWTSPQFTLVGAIIIVLTLLIYTLVVPPPK

SEQ ID NO: 8489 - protein, 446 aa, Zea mays
  misc_feature (102)..(102): Xaa can be any naturally occurring amino acid
MAATIQSVKARQIFGSRGNPTVEVDVFCSDGTFARAAVPSGASTGVYEALELRDGGSDYLGKGVSKAVNNVNSVIGPALIGKDPTAQTEIDNFMVQQLDGTXNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 8490 - protein, 355 aa, Zea mays
KRERERESSLVPPPPPPDHETPLLSKDSSSSSSVITSSLKWILKVVMSMIFVTWVVFLMMMYPEQLGDDFLTFVSSKTFLGTTGTMFLIFSCPILVISVLASLYLIISGEDKVFTKKKISKFPRFRLWTFPVLVDGPFGVVSAAEFLGIMVFSVFFLWSIYAYTLRNLDLLERFHVLPKNRSILLLEVTGLRLGMIGLLCMVFLFLPISRGSILLRLIDIPFEHATRYHVWLGHITMAFFSLHGLCYVVGWIIQGQLLELIFSWNAIGIAILPGVISLVAGLLMWVTSLHTVRKNYFELFFYTHQLYIVFIVFLALHVGDYMFSIFAGGIFLFILDRFLRFCQSRRTVDVRGGPV

SEQ ID NO: 8491 - protein, 519 aa, Zea mays
  misc_feature (144)..(144): Xaa can be any naturally occurring amino acid
LFLSSQSPITPAAQRAETGDALPSPHPPLVSWRRLGGCRCRCRPTSGGQVVLGHFAGDEYHKAVDTFSGIRGSMSNYYDDYDDIDEMEDDYDMDDPIDDMVDEQQGIRDSDAEDNDYGQPNDKIPDTSSADARKGRDIQGIPWXQINITRKKYRQSRLEQYKNYENVPNSGEEAMKDCKPTEKGGIYYEFRRNTRSVKSTILHFQLRNLVWATSKHDIYLVSHYSIRHWSALSGVDTELINVQGHVAPREKHAGSLLEGFYQTQVSTLTVKDNLLVAGGFQGELICKHLDQEGISFCCRTTYDDNAITNAVEIFNTSSGAVHFMASNNDSGVRYYDMERFQLFKHFQFEWPVNHASLSPDRKVVVIVGDDPDGLLIDANSGKTVHSIKGHRDYSFASAWSPDGRTFATGNQDKTCRIWDVRNLSKSVHVLRGNLGAIRSIRFTSDGQFMSMAEPADFVHIYDVKSDYNKRQELDFFGEISGTSFSPDTDTLFVGVWDRMYGSLLQFGRLYNYSYLDSLF

SEQ ID NO: 8492 - protein, 499 aa, Zea mays
PRVRPRVRPLVRPRVRPASLRSQPRSAFLGTGLCGGPLGPCPGEVSPSPAPAGQTPSLTPVPSSGGGNGSGSGSGGTIGGNGGESGHKNKKLSGGAIAGIAIGSALGAGLLLFLLVCLCRRSGGTRTRSLEMPPPEAPAAAAAAGGRKPPEMTSGAAVAPLTTIGHPNAPIGQSTSGKKLVFFGSAAAVAPFDLEDLLRASAEVLGKGAFGTTYKAVLESGATVAVKRLKDVTLSEAEFRERISEIGELQHEFIVPLRAYYYSKDEKLLVYDFMPMGSLSAVLHGNVSSGRTPLNWDLRSSIALAAARGVEYIHSTTSTASHGNIKSSNVLLGKSYQARVSENGLTTLVGPSSSSSRTTGYRAPEVIDSRRVSQKADVYSFGVLLLELVTGKAPSQAALNDEGVDLPRWVQSVNRSEWGSLVFDMELMRHQTGEEPMAQLVLLAMDCTAQVPEARPSMAHVVMRIEEIKKSSVTPNIEQVDDQSSRAESEAAPTNPFAT

SEQ ID NO: 8493 - protein, 158 aa, Zea mays
MAENLAPEKRHSFVHNGQKVFEWDQTLEEVNMYIELPKGVPTKLFHCNIQASHVEVGIRGNPPYLNHDLTHPVKTDSSFWTIEDGEMHITLQKREKGKTWSSPIQGQGILDPYAADQEQKRLMLQRFQEENPGFDFSQAQFSGTCPDPRTFMGGIRSE

SEQ ID NO: 8494 - protein, 158 aa, Zea mays
  misc_feature (110)..(110): Xaa can be any naturally occurring amino acid
MEKSNDHDKASHGGSGGGATEKWEETSLGIRTAETMLRLAPVGLCVAALVVMLKDSETNEFGSISYSNLTAFRYLVHANGICAGYSLLSAAIAAMPRSSSTMPRVWTFFXCLHQFLTTWFLAAGTGSPEPLPFAYVCNSPTSRPTGACYGDPPVFAGM

SEQ ID NO: 8495 - protein, 421 aa, Zea mays
MTDGDDEYKREESVALLVIVFLAALSLLSVIAAFAYYCYITRKVSRRLQAFHIPKRSSSHHTLPPRALPPQQQGTDNPSSNSARDGVGAAAMSVVAAGERGVQVFSYRQLHAATGGFDRAHMVGQGSFGTVYRGVLPDGRKVAVKLMDRPGKQGEDEFEMEVELLSRLRSPYLLGLIGHCSEGEHCLLVYEFMANGGLQEHLYPNRGSCGGISKLDWDTRMRIALEAAKGLEYLHEHVNPPVIHRDFKSSNILLDKDFHARISDFGLAKLGSDRAGGHVSTRVLGTQGYVAPEYALAGHLTTKSDVYSYGVVLLELLTGRVPVDMKRSPGEGVLVNWALPMLTDRDKVVRILDPASEGQYSLKDAVQVAAIAAMCVQPEADYRPLMADVVQSLVPLVKNCYKKKFCNPQFELVFLVTLVDI

SEQ ID NO: 8496 - protein, 440 aa, Zea mays
MPSASLRLAVVGAGAAGLVAARELRREGHAPVVFERAAAVGGTWLYTPPATSSDPLGAAATHSSLYASLRTNLPRETMGFLDFPFAAGAAGSRDPRRFPGHEEVLRYLEAFARRFDLLRLVRFETEVLSVRREDGGRWAVTSRKLGDKGSGEEEFYDAVVVCNGHYTEPRLAVIPGVDAWPGKQMHSHNYRVPEPFLDQVVIIIGASASAVDISRDIASMAEEVHIADRSAPASTCNKQPGYDNLWLHSMIDHAQEDGTVVFQDGSSIKADVIMHCTGYLYDFPFLGDDSTITVDDNRVDPLYKHIFPPEVAPHLSFIGLPWKVIPFPLFELQSKWVARVLSGRINLPSEDRMMEDVKAFYLKLEAHGWPKRYTHNFANYQFEYDDWLAEQCGHPPVEEWRKQMYAVTSMNKAARPESYRDEWDDEHLVAEANEYFKKFL

SEQ ID NO: 8497 - protein, 152 aa, Zea mays
MAQLVDKAKGFVADKLANIQKPEAELADVTVGHVGRDGATLAGRVDVRNPYSHAIPVCEVTYTLRSAGRTVASGTVPDPGSLAGDGATTRLDVPVKVPYDFLVSLAKDAGRDWDIDYEMRVGLTVDLPVVGKLTLPLTKSGELKLPTLSSIF

SEQ ID NO: 8498 - protein, 444 aa, Zea mays
MDEFELEDNLEFILQSIQELMEDPGDNNAFGDANQNELFASIVNYDQENMLPDVSAADVAAGKDIQGIPWEKMLFGRDKYREMKMKNYRNYQNLSYAREDALQECKQVKKDSPYYDFHYNTRRARPSIVHFQLRNLVWATTKHDVYTMHDQSVTHWSSLEQTSTELINADDCIVPKQRGHGSQSVAMVQVTTMAVDSNLLVVGGFQGEIICKRLDDEGVVYSTRVTDDENAITNSLEMYQDPSGSRRLVAANNDCSIRIFDTEYFDLLKHYVFPWSVNSVSVSPNGKLFAVLGDHEDGCVVDPKCGKAIGSLRGHLDYSFASAWHPDGNIVATGSQDTTCRLWDIRNLSQSVAVLGGRMGSIRCVKFSSDGRFLATAEPVDFVHMYDAYADYSRSHEIDLFGEIGGLAFSPDTEAFYVGLADQTYGGMIEFSKRHQHHYLNSLW

SEQ ID NO: 8499 - protein, 65 aa, Zea mays
  misc_feature (11)..(12): Xaa can be any naturally occurring amino acid
MDSEHWISRLXXAAKRFYAAQLGHSDRAGMDELEMDEEVRPEFTCPYCYEDHDVGSLCAHLEEEH

SEQ ID NO: 8500 - protein, 271 aa, Zea mays
  misc_feature (78)..(78): Xaa can be any naturally occurring amino acid
  misc_feature (90)..(90): Xaa can be any naturally occurring amino acid
  misc_feature (102)..(102): Xaa can be any naturally occurring amino acid
  misc_feature (117)..(117): Xaa can be any naturally occurring amino acid
  misc_feature (147)..(147): Xaa can be any naturally occurring amino acid
  misc_feature (161)..(161): Xaa can be any naturally occurring amino acid
MQREPISPDDRPEPAAAAEQPHPQPLECRTAQVFGERAAGEDVQDVDIISAIEFDKSGNHLATGHTGGRATLFERTHXADNACRGELDRXNILYSRHPEFRXYKTEIYSPELDFDYXLKSWESNISLFKPQCWQRTPNAPFLLSTKXDKQTTLGKVHHNKXNPIPGMNLETARMSDKGSISSQGYLYMAKLFLQTGVTPRKMPGPHNNMSFPPGECTSLRLPVVTGQEFTHVARTKRVYAHAHDYHINSISNNRLVSFMILWISNQICKKI

SEQ ID NO: 8501 - protein, 109 aa, Zea mays
  misc_feature (18)..(18): Xaa can be any naturally occurring amino acid
  misc_feature (68)..(68): Xaa can be any naturally occurring amino acid
  misc_feature (87)..(87): Xaa can be any naturally occurring amino acid
  misc_feature (102)..(102): Xaa can be any naturally occurring amino acid
SYPAVAEISVENPSKDSXHYAKRETRQIKKLEYCIRVFARGCSSDASLDAQMEKAHGRFDGVRKVGIXSGTGGNSPMIVSGDHRHRXEFIIAGNLILSNAGXSGWAGRS

SEQ ID NO: 8502 - protein, 165 aa, Zea mays
MLDHLVGLLKLRVVRGVNLAVRDLRSSDPYVVVRIGKQKLKTRVVKKSVNPEWDDELTLSIEDPAVPIRLEVFDKDTFVDDTMGNAEVDIRPLVEIVKMKLQDVADRTVVKKLVPNRQNCLAEESSIYISEGKVKQDMVVRLRNVESGEIELQLQWIDLPGSKGV

SEQ ID NO: 8503 - protein, 517 aa, Zea mays
MASHPPPAEPSSKSNKGQSEHEEIHVSSGGVLAYTDDDDCESRRPLLLRTPASAECYSVSAAVFPFLFPALGGLLYGYDIGATSGATISLKSSTFSGTTWYNLSSVQTGLVVSGSLYGALIGSVLAYTIADFLGRRKELILASISYFIGAFLTAVAPNFAIMVVGRFLYGIGIGLAMHAAPMYIAETAPSQIRGMLISLKEFFIVLGMLLGYIAGNLYVEVVSGWRYMYASSTPLCLIMGVGMCWLPSSPRWLLLCAIQGKGNLPETKENATRCLCRLRGQASPDLVSEQIDLILEELSYIDQEKQASFGEIFQGKCLTALIIGCGLVFFQQVTGQPSVLYYAATIFQSAGFSGASDATRVSILLGLLKLIMTGVAVLVVDRLGRRPLLIGGVSGITVALFLLSSYYTLLKDASYVAVIALLLYVGCYQLSFGPIGWLMISEVFPLRLRGRGLGVAVLVNFASNALVTFAFSPLEDLIGTGALFSGFGVIAVASLAFIFWIVPETKGLTLEEIEASL

SEQ ID NO: 8504 - protein, 218 aa, Zea mays
MAEETVQELRASFASGRTRRAEWRAEQLKGLIRMIDEKEAEISAALHEDLAKPHMESYLHEISITRSSCKFALDGLKSWMKPEKIPAALTTFPSSAQIVPEPLGVVLIISAWNYPFILSIDPVIGAIAAGNAVVLKPSEIAPATSSLLAKLLPEYVDNSCIKVVEGGVAETTSLLEQRWDKIFYTGNGTVGRIVMAAAAKHLTPVALELGGKSPVDLD

SEQ ID NO: 8505 - protein, 392 aa, Zea mays
LGTSRPAGTASGFSSPRLRIRIPPTTSIPFPSLPSCPAGSPARRLCPDPGDMPRYDDRYGGTRLYVGRLAPRTRSRDLEYLFGKYGRIREVELKRDYAFIEFSEHRDADEARYQLDGRDVDGSRIVVEFAKGVPRGPGGSREYMGRGPPPGTGRCFNCGMDGHWARDCKAGDWKNKCYRCGERGHIERNCQNSPRSVRRERSYSRSPSPRRGRGRSPSYSRSRSRSRSRSYSRSRSLSGSPRGGRRDRDDRRSRSLSYSRSPMRSPPAKEKERSPTPGGSRSPRSRSPQDQVMSPPPKDNGDRNGSDRGDSPRGRENSRSRSRSRSPSGGNRSPAANGRSPSPRGDRTPSPMADRSPSPMADRSPSPKGNGNNDGGDDDTGRGGSPTGSKSP

SEQ ID NO: 8506 - protein, 941 aa, Zea mays
  misc_feature (559)..(559): Xaa can be any naturally occurring amino acid
  misc_feature (585)..(585): Xaa can be any naturally occurring amino acid
MLLHAGPSFLLAPPPRFAAAPSSASPRRSRTPQSSPPTSHFARPADPVAQRVRPVAPRPPMATAEEGASSDVGVAVAESAQGFLLDARAYWVTKSLIAWNISDQKTSLFLYASRNATMCMSSQDMKGYDSKVELQPENDGLPSSVTQKFPFISSYRAFRIPSSVDVATLVKCQLAVASFDAHGNRQDVTGLQLPGVLDDMFAYTGPLGTIFSEEAVSMYLWAPTAQDVSVSFYDGPAGPLLETVQLNELNGVWSVTGPRNWENRYYLYEVTVYHQTTGNIEKCLAADPYARGLSANSTRTWLVDINNETLKPLAWDGLAAEKPRLDSFSDISIYELHIRDFSAHDSTVDCPFRGGFCAFTFQDSVGIEHLKKLSDAGLTHVHLLPSFQFGGVDDIKSNWKCVDEIELSKLPPGSDLQQAAIVAIQEEDPYNWGYNPVVWGVPKGSYASNPDGPSRIIEYRLMVQALNRLGLRVVMDVVYNHLYSSGPFAITSVLDKIVPGYYLRRDSNGQTENSAAVNNTASEHFMVDRLIVDDLLNWAVNYKVDGFRFDLNRIKRSIXRLNKTLPKLPRHALPYEHFFIEVNHXNFPGTGIGSFNDRIRDAINGGSPFGNPLQQGFSTGLFLEPNGFYQGNETETRLTLATYADHIQIGLAGNLKDYVVISHTGEARKGSEIRTFDGSPVGYASSPIETINYASAHDNETLFDIISLKTPMDLSIDERCRINHLSTSMIALSQGIPFFHAGDEILRSKSLDRDSYDSGDWFNKIDFTYETNNWGVGLPPREKNEGSWPLMKPRLENPSFKPAKHDIIAALDKFIDILKIRYSSPLFRLTTASDIVQRVHFHNTGPSLVPGVIVMSIEDARNDRHDMAQIDETFSCVVTVFNVCPYEVSIEIPDLASLRLQLHPVQVNSSDALARQSAYDPATGRFTVPKRTAAVFVEPRC

SEQ ID NO: 8507 - protein, 518 aa, Zea mays
  misc_feature (514)..(514): Xaa can be any naturally occurring amino acid
MAPKKRKADPAESPAAVEAATTNHRHEPASSEPKPRGSIYFPITDDPPEPNAAEEDEDEGAGDDEDDAEDIVKLLEPLSREQLVALLRTAAEASPATMAAVRRAVEADPASRKLFVHGLGWGAGAEDLRSAFSRFGELEDCRVISDKQSGRSKGYGFVLFRSRRSALRALNRPQLQIGGRLAFCHLAASGPAPPASQSQNPISNANPNANSNSNTTTNASGSSSSQPDNMPRKIFVGNVHADVDVDRLYNYFAQFGEIEEGPFGFDKNTGKPKGFALFVYKSVESARRALEEPMKNFDGKTLNVQKAIDGRTKGSSGTNTNANSNPTTASVAAAAAAAQMTAPATAAISPYDASAYGATAVPDMSFAQQAAMLGFGAQQQAFAQPNAMLAMIAAMQNPAALGMTPAMFAAMNPAFAAAALGAGGQQAQTAGLTGFGAQGFGTQAFGAGGAAFPNAAGVQAATAAYQGGGAPPGFQGPPGFQVGQATTQTSTAVAAAGYQAGAAGQGQVPGAQMXGTGF

SEQ ID NO: 8508 - protein, 205 aa, Zea mays
MMEPGAPYFGAMGSNASGAGGGLYQPFNSNLAGAGSSTGIQSFPCVRLRSLPFDCKQIVGRKYVEVFRCKKQEYYSAIANEVSQGGYFESEYRRSSPPPRPPKKPAEDKGSMEYTEVLKLRGLPYSATTEDIIKFFLEYELTEENVHIAIRSDGKATGEAFVEFPTAEVAKTAMCKDKMTIGTRYVELFPSTPEEASRARTRGRH

SEQ ID NO: 8509 - protein, 322 aa, Zea mays
MSWSVKGRRPHLQEKKNTHPRPRALCPLPPSHLRRPPHPPPLPPRPAQGQASARPPHHAYRVPAREKKNTHTHTRVRVLSLPHPRAPPPPPPVPLPPPPPPGRLLAMAYRADDDYDYLFKVVLIGDSGVGKSNLLSRFTRNEFSLESKSTIGVEFATRSIHVEDKVVKAQIWDTAGQERYRAITSAYYRGAVGALVVYDVTRHVTFENVERWMRELRDHTDANIVMMLVGNKADLRHLRAVPTEDAKAFAERQNAFFMETSALEAMNVEDAFTEVLAQIYRVVSKKALDIGDDPAAPPRGHTINVGGKDDVSAVKKSACCSS

SEQ ID NO: 8510 - protein, 667 aa, Zea mays
  misc_feature (644)..(644): Xaa can be any naturally occurring amino acid
MEVRGLGQLLAALAAAFFVRAIAGPGPALLPPAEDTEADEADAEAGEGGGGGVPPVTIRWARITCALKNKRGEVARFLLSNVSGEAKPGRLLALMGPSGSGKTTLLNVLAGQLAASSSLHLSGFLYINGRPISKGGYKIAFVRQEDLFFSQLTVRETLSLAAELQLPDLWAPERKESYVNDLLLRMGLVNCADSIVGDAKVRGISGGEKKRLSLACELIASPSVIFADEPTTGLDAFQAEKVMETLRQLAQDGHTVICSIHQPRGSVYGKFDDIVLLSDGETVYMGPAKEEPLTYFSSLGYQCPDHMNPAEFLADLISIDYGSTESVQSSQKRIENLIEAFSNKSVVTEGNNLIAIPEDPELSAKLVRKTTVKKRHGWWRQFRLLFKRAWMQAFRDGPTNKVRSRMSVASAVIFGSVFWRMGKSQTSIQDRMGLLQVAAINTAMAALTKTVGVFPKERSIVDRERAKGSYALGPYLSSKLLAEIPIGAAFPLIFGSILYPMAKLHPTFSRFAKFCGIVTVESFAASAMGLTVGAMAPTTEAAMALGPSLMTVFIVFGGYYVNPDNTPVIFRWIPRISLIRWAFQGLCINEFKGLQFEQQHSYDIQTGEQALERFSLGGIRIADTLVAQGRILMFWYWSTYLLLXKNRPKYQQLLPPLEQDKNKPQVE

SEQ ID NO: 8511 - protein, 170 aa, Zea mays
  misc_feature (25)..(25): Xaa can be any naturally occurring amino acid
MAPTVMMASSATAVAPFQGLKSAAXLPVARRSTRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 8512 - protein, 517 aa, Zea mays
MEPATWAAFLGIALCAAAALFLSRGRRPVYNPPPGPKPWPIIGNLNLMGELPHRSMNELSKRYGPLMQLRFGSLPVLVGASAEMAKLFLKTNDAAFSDRPRFAVGKYTAYDCSGLLWAPSGPYLRQARRICATELFSATRLESFEHIRDEEVRVMLRQLRQAAGRTVRLRDYLQMLALGVISRIVLGKKYVMEEAADGEGDSAPAITPAEFREMVDEFFALHGAFNIGDYIPWLDWLDLQGYVARMKRMKARFGRFLERVLDVHNERRLREGGNFVAKDMLDVLLQLADDTSLEVQLSRDNVKAITQDLIIAGTDSNANTLEWAVSELLKNPKILAKAMEELNHVIGPDRLVTESDLPRLPYIEAVLKETMRVHPAAPMLAPHVAREDTSVDGYDVLAGTVLFINVWAIGRDPGLWDAPEEFRPERFVESKIDVRGHDFQLLPFGSGRRMCPGINLALKVMALSLANLLHGFEWRLPDGVTAEELSMDEAFKLAVPRKFPLMVVAEPRLPARLYTGA

SEQ ID NO: 8513 - protein, 73 aa, Zea mays
  misc_feature (19)..(19): Xaa can be any naturally occurring amino acid
  misc_feature (36)..(36): Xaa can be any naturally occurring amino acid
MIEVVLNDRLGKKVRVKCXDDTIGDLKKLVAAQTGXTRPEKIRIQKWYNIYKDHITLKDYEVHDGMGLELYYN

SEQ ID NO: 8514 - protein, 322 aa, Zea mays
  misc_feature (297)..(297): Xaa can be any naturally occurring amino acid
MASRLVYPVCHNICPEKSYCSCTGVVRPSCDLPKKKKKKKKKKKKKPQPQHNRLAFPSPPAPVSLSLLSDSLSRSRVHLAAASKRDQMAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDFIKVSDDEVAFLTRGDANDEKNVLSLWFDGXKLLVVTDGDKGCRYFTKDFKGSVPG

SEQ ID NO: 8515 - protein, 335 aa, Zea mays
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 8516 - protein, 223 aa, Zea mays
  misc_feature (24)..(24): Xaa can be any naturally occurring amino acid
  misc_feature (42)..(42): Xaa can be any naturally occurring amino acid
  misc_feature (57)..(57): Xaa can be any naturally occurring amino acid
  misc_feature (65)..(65): Xaa can be any naturally occurring amino acid
  misc_feature (84)..(84): Xaa can be any naturally occurring amino acid
  misc_feature (123)..(123): Xaa can be any naturally occurring amino acid
  misc_feature (176)..(176): Xaa can be any naturally occurring amino acid
  misc_feature (182)..(182): Xaa can be any naturally occurring amino acid
MSLTIPTNLVLTPRYTKSLTHAVXKSHARFVCSDDKSSSYAXQSMKAFSDAVVLSSXLLYAPIPXAVDDISGLTPCKDSKQFVXYREKQQIKKLIYSIKLYVQESTLAVAVNHQIEKYIRRFXDNYGKYGWLYGSGGFIHLIEDGAAKCIGEKVQYLPSIHSLCIVGLIGRRGRSXVNTSNXEKTPSMKEIIIKDPKASRIILRGLIWHVTAIREVYQGRLQR

SEQ ID NO: 8517 - protein, 230 aa, Zea mays
  misc_feature (63)..(63): Xaa can be any naturally occurring amino acid
LLWAIGFLEAGRVLSPVDRDDDCAADAEAAAPRDAADDEDNVVSLKVRPLGDCQIGKTSFMVXYVGDDGEEQNGLQMTGLNLMDKTMPVRGARIAYSIWDVAGDHQSVDHIPIACKDAVAILYMFDLTSRCTLNNIVDWYGRARKWNKTAIPILIGTKFDDFAQLPLEMQWAIVNQARAYARAMKATLFFSSATHNINVNKIFKFITAKLFNLPWTVERNLTIGEPIIDF

SEQ ID NO: 8518 - protein, 84 aa, Zea mays
  misc_feature (19)..(19): Xaa can be any naturally occurring amino acid
  misc_feature (24)..(26): Xaa can be any naturally occurring amino acid
  misc_feature (31)..(31): Xaa can be any naturally occurring amino acid
  misc_feature (38)..(38): Xaa can be any naturally occurring amino acid
  misc_feature (45)..(46): Xaa can be any naturally occurring amino acid
  misc_feature (49)..(49): Xaa can be any naturally occurring amino acid
  misc_feature (51)..(51): Xaa can be any naturally occurring amino acid
  misc_feature (54)..(54): Xaa can be any naturally occurring amino acid
  misc_feature (61)..(61): Xaa can be any naturally occurring amino acid
  misc_feature (64)..(64): Xaa can be any naturally occurring amino acid
  misc_feature (72)..(72): Xaa can be any naturally occurring amino acid
  misc_feature (74)..(74): Xaa can be any naturally occurring amino acid
  misc_feature (77)..(77): Xaa can be any naturally occurring amino acid
NPNRDLRSSKPYLAMDGGXGGGGXXXGVGAXVMVGGGXLPGGGGXXLEXVXKTXQFEHKLXYFXLKENPRGXYXKIXEKTLGTR

SEQ ID NO: 8519 - protein, 621 aa, Zea mays
  misc_feature (172)..(172): Xaa can be any naturally occurring amino acid
MATMKLGSKPEIFVLQDLTWRCTIELESDVVVEVGEMSFYLHKFPLLSRSGVLQRMISEYQAPADGGGMCTLQLDDIPGGAKAFELAAKFCYDVKIELNALNVVCLRCAAEYLRMTDDYAEGNLITQAECFLVDVLANWKDSIKALETCEGVLPTAEDLHLVSRCITALASXADTPSCRASGPAAAGMDWWHEDGSFLSLPMFKRLIQAMEAKGMRDESIAGAIMFYAGRFLPGLKRNTSFSNALASYGADGSGGAGGGMSSRNITPRAASVSAPSEGDQRYFLEEIVALLPTKKGVASTKFLLGMLRTAMLLHASPLCRENLERRIGAQLEDASLDDLLVPNLGYHVETTLYDIDCVQRILDYFMSSTDGIGTGYTSPALAEEGGGSLGIPQGATPSSSLSPITMVAKLMDGFLAEVAPDTNLKLPKFQALAAVVPDYARPVDDGIYRAIDIYLKSHPWLSESEREQLCRLLNCQKLSLEACTHAAQNERLPLRVVVQVLFFEQLRLRTSIAGWFFVSDNAAGGDGARPHAGGAIVPKGTAAIAGCPQADADSDVEGDAPDGKETITDVKARVSDLEKECKSMKQEIRRLGKPRRSWSLLTRKCGFGAKVQQAQTAMSGK

SEQ ID NO: 8520 - protein, 164 aa, Zea mays
  misc_feature (29)..(29): Xaa can be any naturally occurring amino acid
  misc_feature (81)..(81): Xaa can be any naturally occurring amino acid
MVVIGRHEERARVRVQGTGCARLPEGGEXGRAGAMAGWGRGVLTKQARLLPLPSIFSPAAAAAPPHLLIWRVSLRVGEAGXEDSGGGVELNVVEEDVPRSRSVYCDQCRVVGWCRHPVCVKRYHFIIENDSGSRELELAPASRPNPHGTARRRPRSARLLPGVQ

SEQ ID NO: 8521 - protein, 284 aa, Zea mays
  misc_feature (240)..(240): Xaa can be any naturally occurring amino acid
  misc_feature (247)..(247): Xaa can be any naturally occurring amino acid
MAKDIEAAAHEGKDYSDPPPAPLVDAEELTKWSLYRAVIAEFVATLLFLYITVATVIGYKHQTDAAASGPDAACGGVGVLGIAWAFGGMIFILVYCTAGVSGGHINPAVTFGLFLARKVSLVRALLYIVAQCLGAICGVGLVKGFQSAFYVRYGGGANELSAGYSKGTGLAAEIIGTFVLVYTVFSATDPKRNARDSHVPVLAPLPIGFAVFMVHLATIPITGTGINPARSLGAAVIYTXDKPWDDXWIFWVGPLVGAAIAAFYHQYILRAGAIKALGSFRSNA

SEQ ID NO: 8522 - protein, 618 aa, Zea mays
MRPPSSGKKTEVSHSVGKCGVSDQACHGKCQSCGIDAKPFCAGVNEVSLLTGSHTDVEASKENRGACSLNNDRADALEEEANVSTARIGHVESADPGGSVGVEKEIFMAVNEESEGEQAGATLEDLFFFNGEEDDDSDWEPASRLVVNRWFCLNCTMPNVDKITYCMNCRELPGSVVDGYDVFKKQIAQTALLSADTGLLPVSTAIGFDERMLLHSELEVKPNPHPERPDRLRAIAASLAAAGIFPSKCALVPPREITKEELLMVHSPDHIESVEQTKNMLYSYFTSDTYANGHSACAAKLAAGLCADLASLIVSGRVRNGFALVRPPGHHAGVKQAMGFCLHNNAAVAALAAKRAGAKKVLIVDWDVHHGNGTQEIFDGDKTVLYISLHRHEDGNFYPGTGAAHEVGVLDGQGFSVNIPWSRGGVGDDDYIFAFQTVVLPIASEFAADITIISAGFDAARGDPLGCCDVTPTGYSWMTSLLAGSSNGRLLVILEGGYNLRSISSSATEVVKVLLGEGPNRASFVVSPSKEALRTVSQVLKIQQQFWPVLGPTYASLQAQQGSVSSNHSNELKKRKRSGGGPGPFWWKMGSKRLLYEALIEPRSRPRKLKGSTGSAAP

SEQ ID NO: 8523 - protein, 569 aa, Zea mays
FRFLPYSRSARRRRRRRSGRALGDGVIGFSSRLSPVASRPRLRSSAHRPVTLQKEIFMAVNEESEGEQAGATLEDLFFFNGEEDDDSDWEPASRLVVNRWFCLNCTMPNVDKITYCMNCRELPGSVVDGYDVFKKQIAQTALLSADTGLLPVSTAIGFDERMLLHSEQLEVKPNPHPERPDRLRAIAASLAAAGIFPSKCALVPPREITKEELLMVHSPDHIESVEQTKNMLYSYFTSDTYANGHSACAAKLAAGLCADLASLIVSGRVRNGFALVRPPGHHAGVKQAMGFCLHNNAAVAALAAKRAGAKKVLIVDWDVHHGNGTQEIFDGDKTVLYISLHRHEDGNFYPGTGAAHEVGVLDGQGFSVNIPWSRGGVGDDDYIFAFQTVVLPIASEFAADITIISAGFDAARGDPLGCCDVTPTGYSWMTSLLAGSSNGRLLVILEGGYNLRSISSSATEVVKVLLGEGPNRASFVVSPSKEALSTVSQVLKIQQQFWPVLGPTYASLQAQQGSVSSNHSNELKKRKRPGGGPGPFWWKMGSKRLLYEALIEPRSRPRKLKGSTGSAAP

SEQ ID NO: 8524 - protein, 618 aa, Zea mays
LPLSPLLALSTQATASALRSGSGRRRHRLLLPPLSSRLAPSPPVLRTPAGDPAHTDVEASKENRGACSLNNDRADALEEEANVSTARIGHVESADPGGSVGVEKEIFMAVNEESEGEQAGATLEDLFFFNGEEDDDSDWEPASRLVVNRWFCLNCTMPNVDKITYCMNCRELPGSVVDGYDVFKKQIAQTALLSADTGLLPVSTAIGFDERMLLHSELEVKPNPHPERPDRLRAIAASLAAAGIFPSKCALVPPREITKEELLMVHSPDHIESVEQTKNMLYSYFTSDTYANGHSACAAKLAAGLCADLASLIVSGRVRNGFALVRPPGHHAGVKQAMGFCLHNNAAVAALAAKRAGAKKVLIVDWDVHHGNGTQEIFDGDKTVLYISLHRHEDGNFYPGTGAAHEVGVLDGQGFSVNIPWSRGGVGDDDYIFAFQTVVLPIASEFAADITIISAGFDAARGDPLGCCDVTPTGYSWMTSLLAGSSNGRLLVILEGGYNLRSISSSATEVVKVLLGEGPNRASFVVSPSKEALSTVSQVLKIQQQFWPVLGPTYASLQAQQGSVSSNHSNELKKRKRPGGGPGPFWWKMGSKRLLYEALIEPRSRPRKLKGSTGSAAP

SEQ ID NO: 8525 - protein, 140 aa, Zea mays
MWIEGGINPQLVKIHLNPHGLSTKRKGLTGFIIFANLFCNMQKVWAATESGNLEVTYTHKEDQGALALSGMPDAQSKPVLLCSLNDNTVRLYDLPSFSDRGRLFSKKEIRAIQMGPGGLFFTGDGTGELKVWQWVDLAQT

SEQ ID NO: 8526 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDGEFKTPPMNFLNERTLKGAFFGNYKPRPDLPNVVELYIKKELEVEKFITPRVPFAEINKGFDLMAKGEGIRCIIRMEK

SEQ ID NO: 8527 - protein, 255 aa, Zea mays
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSGFTINGKPIFHFVGTSTFSEYTVIHVGCLAKINPEAPLDKVCVLSCGISTGLGATLNVAKPKKGSTVAIFGLGAVGLAAMEGARMSGASRIIGVDINPAKYEQAITKLINAILGLIFLHQSSSD

SEQ ID NO: 8528 - protein, 79 aa, Zea mays
  misc_feature (8)..(9): Xaa can be any naturally occurring amino acid
  misc_feature (13)..(13): Xaa can be any naturally occurring amino acid
  misc_feature (15)..(15): Xaa can be any naturally occurring amino acid
  misc_feature (37)..(37): Xaa can be any naturally occurring amino acid
  misc_feature (50)..(51): Xaa can be any naturally occurring amino acid
  misc_feature (54)..(54): Xaa can be any naturally occurring amino acid
  misc_feature (60)..(60): Xaa can be any naturally occurring amino acid
  misc_feature (66)..(66): Xaa can be any naturally occurring amino acid
  misc_feature (68)..(68): Xaa can be any naturally occurring amino acid
MEANSGGXXGGAXEXGRAVTRGGGGSDVELVSKTLQXEHKLFYFDLKENXXARXLKISEXTSATRXTXIVPFPPASPWP

SEQ ID NO: 8529 - protein, 168 aa, Zea mays
MLVYQDLLTGDELLSDSFPYKEIENGILWEVEGKWVTVGAVDVNIGANPSAEEGGEDEGVDDSAQKVVDIVDTFRLQEQPTYDKKGFIAYIKKYIKLLTPKLSEEDQAVFKKGIEGATKFLLPRLSDFQFFVGEGMHDDSTLVFAYYKEGSTNPTFLYFAHGLKEVKC

SEQ ID NO: 8530 - protein, 442 aa, Zea mays
MEQAEVCYLISSISPLRENVVSKGGLCFVKLYQVDNLMRVLCFPTAGGKSVKKPRFSLRGYDFVPLDVKTDNLCIGEQDVSSAVPSTKASQTMVAERLENVEEQTEDLAPEFALPPKANTSVSELLDNLQRRGGSFVRTPSLLHQHAPSISIREQEVSSGVPPTKASQALMDEPFENVNGQTEELPSELPCSIKRPKFSVAELLEDLQGRSGSYVETASLSHQHTRAKHWKPKFLSSEKKTIAILGDRSIDSEDPLEHVIDGTSSEEEDATQNHLSLVNKDENQQTMADLFQEVFNPTNMDGAMKSMTSTGAGNYGRMQQIMQMEKYWHVEFLRQYSREHSYSGDLKGTTVQIMSRSLEGKLTVCSCMFQEKGNDATISNASADGTMDESRTRRTIIFSPKICNNVDLLVGNIIHIFPPWKEVKIQEEHVIICTYFSHHHRT

SEQ ID NO: 8531 - protein, 185 aa, Zea mays
MGLFTVTKKATTPFDGQKPGTSGLRKKVTVFQQPHYLQNFVQSTFNALPVDQVRGATIVVSGDGRYFSKDAVQIITKMAAANGVRRVWVGQNSLMSTPAVSAVIRERVGADDFGIKYNMGNGGPAPESVTDKIFSNTTTISEYLISEDLPDVDISVVGVTSFSGPEGPFDVDVFDSSVDYIKLMK

SEQ ID NO: 8532 - protein, 648 aa, Zea mays
MIHPLVLSLPSPAIISRPRRPRHHTTTPSLPSHSRSLHHYRLLRVTPLVASCGYRRRIVRGASATMGLFTVTKKATTPFEGQKPGTSGLRKKVTVFQQPHYLQNFVQSTFNALPADQVKGATIVVSGDGRYFSKDAVQIITKMAAANGVRRVWVGQNSLMSTPAVSAVIRERIGADGSKATGAFILTASHNPGGPTEDFGIKYNMGNGGPAPESVTDKIFSNTTTISEYLISEDLPDVDISVVGVTSFSGPEGPFDVDVFDSSVNYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLAWLSIIAFKNKDNLGGDKLATVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKTGRDSQEALAPLVDVALKLSKMQEYTGRSAPTVIT

SEQ ID NO: 8533 - protein, 252 aa, Zea mays
  misc_feature (79)..(79): Xaa can be any naturally occurring amino acid
  misc_feature (107)..(107): Xaa can be any naturally occurring amino acid
  misc_feature (133)..(133): Xaa can be any naturally occurring amino acid
MGANGHPPLASTLAQNGSHSGGSGGGGGGGGGANPSNGGTGAALRHDPGLAREWSTEEQAILDELLVKYASDLPVVRYXKIAMKLPEKTVRDVALRCRWMSIALQMXNKKESAKRKKEDHNSSKKSKDKKEKXSDSSSKPPVHMVGRPNVPPYPLPVLPMDDDEISSKAIGGPTGEILETNAHVLGQISSNLSNMQIQDNISLLCQTRDNILRVLKEINDAPDIMKQMPPLPVKINEELVNSLLPRPTVPMQ

SEQ ID NO: 8534 - protein, 244 aa, Zea mays
MISPDAARNVVGIIGNVISFGLFLSPVLTFWRIYKAKDVEEFKPDPYLATLLNCMLWVFYGIPVVHPNSILVVTINGIGLVIEAVYLTIFFLYSDSQKRKKAFAILAVEILFMLAVVLGVILGAHTHEKRSMIVGILCVIFGSMMYASPLTIMSRVIKTKSVEYMPFLLSLVSFLNGCCWTAYALIRFDLYVTIPNALGAFFGLIQLILYFCYYKSTPKNEKNVELPTVSSNVGGGNVTVSVER

SEQ ID NO: 8535 - protein, 281 aa, Zea mays
  misc_feature (46)..(46): Xaa can be any naturally occurring amino acid
LRELLDEKSSEPWSQRRLPTMTATYPAVIDSDVEEDEREFPKPRNXGKSASRPSAMSSHDNFLQKDCTAEQAVTKQIRALRKKLQQIEILEAKQLAGHQLDNQQLAKLESRAALEGELSELGIPSEAYSTSSACPAEGRANRKPEVSKKQKRKNKQATQTPSVKSEPGQQIPIKDLQEVLSVNVSAEKEAYAADPIKHIEAAAFSNTKDIASPLEKKASQPTSSKKKKTVTLQSELVGNASKVKQITRTFQVADGELSYVVQMATITTSLQPHLRALLKRI

SEQ ID NO: 8536 - protein, 174 aa, Zea mays
MLEFMSPYYVESVHSTNASLYKNAVISSFAEIPGSFLSAMIVDRFGRKRSMASMLFTSCVFLLPLVFSRTDILTRISLFGARLCISASFTIVYIYAPEIYPTAVRTTGIGIASSVGRIGGILCPLVAVALVHSCQQTTAILLFELVIFLSGLAVSFFPFETKGCRLNDTDVDMN

SEQ ID NO: 8537 - protein, 370 aa, Zea mays
SSGHKQVTRRFVFGSKLRKMYKKQKMLQKKFFPWNYDWHRDQPHVDESVIKSSEVTRRCKSGPVEHDAVLRAMSRALETTEEAYMDIVENELDRHPELALMGSCVLVMLMKDQDVYVMNLGDSRAILAQDNDQYNSSSFSKGDLRHRNRSRESLVRVELDRISEESPMHNPNSHLNSNTKAKELSICRLRMRAVQLSTDHSTSIEEEVLRIKVEHPDDPHAVFNGRVKGQLKVTRAFGAGFLKKPKFNEALLEMFRIDYVGTSPYISCNPAVLHHRLCANDRFLVLSSDGLYQYFSNDEVVSHVLWFMENVPEGDPAQYLVAELLCRAAKKNGMNFHELLDIPQGDRRKYHDDVSVMVVSLEGRIWRSSG

SEQ ID NO: 8538 - protein, 445 aa, Zea mays
  misc_feature (350)..(350): Xaa can be any naturally occurring amino acid
  misc_feature (364)..(364): Xaa can be any naturally occurring amino acid
PRVRGSFASVDCTALHLLPAAEFSWSRAMAMSSSRALLRRIGGALRRRSFSDAAAGPDSAAVGYHVAGGPSYMRGAVFWEPGRPLTLEEFHMPRPKAGELLIKTKACGVCHSDLHVLKGELPFSSPCVVGHEITGEVVDHGTHTPAEIISRFPVGSHVVGAFIMPCGNCFYCVKGQEDLCESFFAYNRAKGTLYDGETRLFLRGNGKPVYMYSMGGLAEYCVVPANALAVLPASLPYTESAILGCAVFTAYGALRHAAEMRAGDSVAVIGVGGVGSSCLQIAKAFGASEVIAVDVLDEKLRNATTLGATHTVNAAKEDAVERIKEITGGRGVDVAVEALGKALTFSQCAXRVRDGGKAVMIGLXATNVVGEVDITRLVRRQVKIIGSYGARARQDLPQIVKLAESGAFSLRNTVSRKCRFEEANGAYEDLDQGKIVGRAVVEIME

SEQ ID NO: 8539 - protein, 221 aa, Zea mays
MSLTIPTNLVLNPRSNKSLTQSVPKSSARFVCSDDKSSSSAPQSMKAFSAAVALSSILLSAPMPAVADISGLTPCKDSKQFAKREKQQIKKLESSLKLYAPESAPALALNAQIEKTKRRFDNYGKYGLLCGSDGLPHLIVNGDQRHWGEFITPGILFLYIAGWIGWVGRSYLIAISGEKKPAMKEIIIDVPLASRIIFRGFIWPVAAYREFLNGDLIAKDV

SEQ ID NO: 8540 - protein, 545 aa, Zea mays
  misc_feature (156)..(156): Xaa can be any naturally occurring amino acid
  misc_feature (197)..(197): Xaa can be any naturally occurring amino acid
MENLAGQQFVYEVTSLRALFLLLLLPPFIFLIMRNARATTLMFDTKRTRGHRQPADRQQSLPPSPPAVPVLGHLHLVGSLPHVSLRSLARTLGADLMLLRLGSTPVLVVSSSSAAEAVLRTHDHVFASRPHALVSEVVLYGPSDVGFAPHGDCWAXGGRKLITTHLLSVNRVQSFRHAREEEVSVVMGRIAEAAAAXRAVDVGELLGSFTNDLACRAVMGKSFRSEGRNKLFRELVLDTTKLLVGFNVEDFFPFLARFGVLSKLVRAKSERLRRRWDELLDRLIEDRESKYEAAAAGASDLKVKDDDDDNFIHVLLSVQQEYGHITREQMKALLQDVFIGGIDSTSSLLEFTMAELMRKPRVMNKLQAEVRSSTPEGHDGVVGEDSLEHMAYLRAVTKESLRIHNVTPLLAPHLSMDSCTIDGYTVPAGVQVLINSWAIGRDTRYWGDDAEEFVPERFMDGGSAVHVSFKGSDFEFLPFGSGRRMCAGVNFAMATVELMLANLVHRFDWDLPPGQEGRDIDVSQVFGLVVRRKKKLLLVPKLRVY

SEQ ID NO: 8541 - protein, 347 aa, Zea mays
MEFKRDVWSLLLVLLLGQLVAFSMAASSFASSLIANLGVDAPLTQSFLAYLLLTLVYVPIVLRRRQKLQIAWYWYLALAFFDVQGNYLVVKAYQYSYITSVTLLDCWTVVWVVMLTWYALGTRYSLWQFVGAGTCVAGLALVLLSDAKSQDEQDPKKIPLLGDALVIAGTVGFAFSNVGEEYCVKKKDRAEVVAMLGLFGLLISTVQILVFERKGLEAVTWSPTMISLFAGFAVAIFVFYTVAPFVLKMSGATLFNLSLLTSDMWAVAIRVLFYQQEINRLYYLAFAVVAIGLIIYSLNDRSSDDETAGSTEAPAQYQQLPIEDNSTRIGSSSGSQERTHKEEVHIC

SEQ ID NO: 8542 - protein, 68 aa, Zea mays
DWLCRYLRVRKVSLMDVSKKYGTDFQILHAITTGHSWYGQWGFKLSKGCFGITSEEYLKAMDNLSLTP

SEQ ID NO: 8543 - protein, 230 aa, Zea mays
ARNSARADPGLLLPRANLTFWRDGSIVRERNAMLPTISSKDWLDIDFGIAEGVDFIAVSFVKSAEVIRHLKSYIAARSRGSDMAVIAKIESIDSLKNLEEIIRASDGAMVARGDMGAQVPLEQVPSIQQKIVQLCRQLNKPVIVASQLLESMIEYPTPTRAEVADVSEAVRQRADALMLSGESAIGRHLYNAISALIRVIMTMYKCLRRAQLHDAYDVGVRQGAGAGAPA

SEQ ID NO: 8544 - protein, 371 aa, Zea mays
MLRLQHHFLSSIRASSHRHCSLLSIATTATSPDRFVAEEYLVTTCGLTPAQAGRASKGLTHLKSPVKPDAVVAFLAGVGLAKDDITAGIARYPRLLCSKVDKTLTPRFAQLMSLGLSPSQISRLITIVPNIFVAPKKISHLQFYLSFMGCFDRVHSAIRINPMLLSRNLEDVVKPNIAFLLQCGLTVSNVLEFPLLIGMRPESVRERVACAEKLGVPRNTGMFKSALWAVYCVGPNSIGAKLDVIKATLGCSEAELTLVVRKSPPILRMSEGKLSRALKFLKVDVGLKLQYILLRPAILAFSMQRRLMPRHYFIKILKAKGLVKENVDFYNALCLTEKRFAQKFIDPYNQSIAGLADAYAAACAGKMPHED

SEQ ID NO: 8545 - protein, 110 aa, Zea mays
  misc_feature (11)..(11): Xaa can be any naturally occurring amino acid
APQLHDDGLPXLIGSGDHRHWGEFVTPGLLFLYIAGWIGCDGRRYLIAITGEKKPAMMEIIIHVELATRLLSREFIWPVAAYRELINGDLVLDDKVHRILLSGAPVLAHH

SEQ ID NO: 8546 - protein, 253 aa, Zea mays
  misc_feature (72)..(72): Xaa can be any naturally occurring amino acid
  misc_feature (89)..(89): Xaa can be any naturally occurring amino acid
  misc_feature (97)..(97): Xaa can be any naturally occurring amino acid
MAAMNTGMGGLGGRPIHPQANPFGTALQGAGPGLIRTGLETYGGRILDSSSEFMQSNITQYLSDPQYYFQVXNSQYVRNKLKVILFPFXLSYRPPVXDINAPDLYIPLMAFGTYIVAAGYALGVLGRFTPEALTLQFSKGILGWFLQVVLIKGLLYSLGSGEAPLLDIVAYAGYGFAGTSLAMVARIFWSYLYYFIMPWFCLCTGVFLVKTMKRVLLGGPRSYERHPGRNHYFLIFLAVVQFPMLFWLGNICG

SEQ ID NO: 8547 - protein, 99 aa, Zea mays
IWWKKYYGALLCCTWSSDGKYLLTGGEDDLVQVWGMDDRKIVAWGEGHNSWVSGVAFDSYWSPPSSDGNGENVYRFGSVGQDARIQPKNPSPPSRHMRA

SEQ ID NO: 8548 - protein, 510 aa, Zea mays
  misc_feature (371)..(371): Xaa can be any naturally occurring amino acid
MSSPPDLSLLLLRSRQGPVPNPHPARPPAMTDHRDVMLPLSLQYIATRALLLLVIASAVSCSSLPPEDGIRVVSAEKRIDLTGPIVKVFLTLKVENAPTASEASRVLLAFTPTEFQHLSIVKATRAEGKRKKKAFVPLSVQASELATTAPDAPRLYSVLLSTPLKPGDATTLEVLYMLTHSLEPFPAEISQSESQLVYYRDSAVLLSPYHVLEQVTYIKMPSNRIESFTRVDPTTRAGSEVKYGTYSNQMPNSYLPVLVHYENNRPFAVVEELVRKVEISHWGNIQITEQYKLKHGGARHKGVFSRLEYQSRPSISGASSFKNLLARLPPRVHSVYYRDEIGNISSSHLRTDSHKSDLEIEPRYPLFGGWXGTFTIGYGLPLQDFVFESVDGRRYINLTFGCPLLDTVVDDLTVKVVLPEGSKNPEHVVPFVTEKHLETSYSYLDVVGRTTVVLKKKNVVGEHNVPFQVYYEFNPIFMLAEPLMLISAVLLFFVAFIAYLHMDLSIRKSS

SEQ ID NO: 8549 - protein, 360 aa, Zea mays
MVSAGDSADKCLPLFAQPALGRTHSPVRPSVRGAPTRHRHQHHRPPGARHAREEEEEEGTGRQRAMAAVVCVTGAGGFIGSWIVKILLARGYAVRGTSRREAADPKNAHLWALDGAAERLTMLQVDLLDRASLRAAFRGCDGVIHTASPMHDNPEEIIEPIIAGTRNVVEAAADAGVRRLVLSSTIGTMYMDPRRDPDAPLGDSSWSDLEYCKSTENWYCYAKTVAEQGAWEAARARGLDLAVVIPVVVLGELLQPSMNTSTLHRGELCRILAGLFPEYPIPTRCKDQVNPLKKGYKFTNQPLKDLGVKFTPVHGYLYEAVKSLQDKGFLPKTSGAKVPERRSCLPQTTSQPPPEIVSKL

SEQ ID NO: 8550 - protein, 124 aa, Zea mays
MEDFYVTIPYGLLLVAGGVAGYMKRGSAASLVAGGGFGAALLLAGALSAWAFAHGRGGAAAIFATVLQIVCAVLLTVVMGIRYVKTQKIMPAGIVASISALVLIFYVYKISTGGNKVYMSVSAE

SEQ ID NO: 8551 - protein, 685 aa, Zea mays
  misc_feature (178)..(178): Xaa can be any naturally occurring amino acid
  misc_feature (335)..(335): Xaa can be any naturally occurring amino acid
  misc_feature (373)..(373): Xaa can be any naturally occurring amino acid
  misc_feature (382)..(382): Xaa can be any naturally occurring amino acid
  misc_feature (407)..(407): Xaa can be any naturally occurring amino acid
MRSPSPPPWRLRRIRFSFPMLLLVASLAGADDLASDARALVAFRDAVGRRLAWNASDVAGACSWTGVTCEHGRVAVLRLPGATLSGTVPAGTLGNLTALHTLSLRLNGLSGALPADLSSAAALRNVFLNGNRLSGGFPQAILALPGLVRLSLGGNDLSGPIPAELGNLTHLRVLLLEXNNRFSGEISDVKLPPLQQFNVSFNQLNGSIPASLRSQPRSAFLGTGLCGGPLGPCPGEVPPSPAPAGQTPSPTPVPSGSNEGGGGGGGTNGGSGVENGHKGKKLSGGAIAGIGIGSALGAALLLFLLVCLCRRSGGIRTRSLEMPPSSPAPAGGRNXPEMTSAAQGAHRRRRRPPRLLIDMSSPERKRICYNSSXAFNRFTHSXILSSTESTVFFVCASFSLLDLTVNXDPLAVKRLKDVTLSEPEFRERISEIGELQHEFIVPLRAYYYSKDEKLLVYDFMPKGSLSAVLHGNITSGKTPLNWDLRSSIALAAARGVEYIHSTSSTASHGNIKSSNVLLGESYQAHVSDNGLTALVGPSSSPSRATGYRAPEVIDPRRVSQKADVYSFGVLLLELVTGKAPSQAALNDEGVNLPRWVQSVSRSEWGSEVFDIELMRHEAGEEPMAQLVLLALDCVAQVPEARPSMGHVVTRIEEIRKSSVTPNMEEEVDDQSSKAESEAPTNPFTS

SEQ ID NO: 8552 - protein, 640 aa, Zea mays
  misc_feature (43)..(43): Xaa can be any naturally occurring amino acid
MGNTCVGPSITMNGFFQSVSTALWKTPQEGDALPAAANGPGGXPAGAGSQSALPKPASDVHHVAVQSEAPEPVKIAAYHSEPAPAVRSEAPEPVKIAASHSEPAPMAAKPGGAAANASPSPSPRPRPQVKRVSSAGLLLGSVLRRKTENLKDKYSLGRRLGQGQFGTTHLCVERATGKELACKSILKRKLGSDDDVEDVRREIQIMHHLAGHPSVVGIRGAYEDAVAVHLVMELCGGGELFDRIVRRGHYTERKAAELARVIVGVVEACHSMGVMHRDLKPENFLFADHSEEAALKTIDFGLSIFFRPGQIFTDVVGSPYYVAPEVLKKRYGPEADVWSAGVIIYILLCGVPPFWAENEQGIFEEVLHGRLDFESEPWPSISDGAKDLVRRMLVRDPRKRLTAHEVLRHPWVQVGGVAPDRPLDSAVLSRMKQFSAMNKLKKMALRVIAENLSEDEIAGLREMFKMIDADNSGQITFEELKVGLEKVGANLQESEIYALMQAADVDNNGTIDYGEFIAATLHLNKVEREDHLFAAFQYFDKDGSGYITADELQVACEEFGLGDVQLEDLIGEVDQDNDGRIDYNEFVAMMQKPTVGGSRRRPICRTASASGSASGSGRRSGWPRPLCLWLPCCLRVGVDD

SEQ ID NO: 8553 - protein, 471 aa, Zea mays
  misc_feature (189)..(189): Xaa can be any naturally occurring amino acid
  misc_feature (237)..(237): Xaa can be any naturally occurring amino acid
MEADSGKLFVGGISWETDEDRLREYFGRFGDVTEAVIMRDRNTGRARGFGFVVFADSGIAERVTLDKHMIDGRMVEAKKAVPRDDQSIASKNNSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGXPIARSPAGGQNYAMSRVHNFLNGFNQGYNPNPLGGYGMRVDARYGLLXGARNGFSSFGPGYGMGMSVEGGMRGYFGASSGFVNSSNGRQIGSYFNGSSNRLGSPIGYVGLNDDSGSILSSMSRNVWGNGNLNYIGNHTNMNSFPQPGSGGGISGDEISWGSLTSAHGMGNISSLGSGNLGRGTGDNNFGLPSGNYVRSNSTGTIGEPFSASANAYESNNPGAYGSSSIYGDSTWRFNSSEVDIPPFGHDLGNVDPDIKSEISANYMGNYTVNNNQTSRGITS

SEQ ID NO: 8554 - protein, 141 aa, Zea mays
  misc_feature (3)..(3): Xaa can be any naturally occurring amino acid
  misc_feature (7)..(7): Xaa can be any naturally occurring amino acid
  misc_feature (17)..(17): Xaa can be any naturally occurring amino acid
  misc_feature (25)..(25): Xaa can be any naturally occurring amino acid
  misc_feature (31)..(31): Xaa can be any naturally occurring amino acid
  misc_feature (39)..(39): Xaa can be any naturally occurring amino acid
  misc_feature (66)..(66): Xaa can be any naturally occurring amino acid
  misc_feature (71)..(71): Xaa can be any naturally occurring amino acid
  misc_feature (105)..(105): Xaa can be any naturally occurring amino acid
  misc_feature (119)..(120): Xaa can be any naturally occurring amino acid
MLXFLSXALSSFILVLXILASFSSXSFISDXVFEPQNLXIGRNLLQTKKACPVNFEFMNYTIITSXCKGPXFPAKECCGAFKDFACPYADDLSDLSNDCATTMFXYINLYGKYPPGLFXXQCQEGKEGLECPATSPTSASD

SEQ ID NO: 8555 - protein, 326 aa, Zea mays
  misc_feature (9)..(9): Xaa can be any naturally occurring amino acid
  misc_feature (16)..(16): Xaa can be any naturally occurring amino acid
  misc_feature (38)..(38): Xaa can be any naturally occurring amino acid
  misc_feature (110)..(110): Xaa can be any naturally occurring amino acid
HQRPAPRIXRGRRCAXTGAGGFVASWLVERLLAGGRYXPGTVRDPGDAKNAHLAAMDGAADRLRLFRAELLDYGSVAAAIAGCDGVFHVASPGPMTYPIELLAPAVTGTXNVLKACSEAKVKRVVVVSSVAAVMVNPAWPQNEAMDEACWSDVEFCRTTQNWYCLSKTLAELEALDYAKRSGLDVVSVCPSLVIGPLLQSTVNASSSVIVDCLKGDREVKLKLRNFVDVRDVADALLLVYETPGASGRYICDANARQMSEVVALLKDWYPAYSHAATNAWHRFVQVSDEPLFSSKKLQALGWKFRTLEESLRDSVESFKAAGVLVD

SEQ ID NO: 8556 - protein, 318 aa, Zea mays
  misc_feature (156)..(156): Xaa can be any naturally occurring amino acid
MEGAAGIRTRPAVCVTGAGGFVASWLVERLLAGGRYMVHGTVRDPGDAKNAHLAAMDGAADRLRLFRAELLDYGSVAAAIAGCDGVFHVASPVELLAPAVTGTKNVLKACSEAKVKRVVVVSSVAAVMVNPGWPQNEAMDEACWSDVEFCRTTQVXNWYCLSKTLAELEALDYAKRSGLDVVSVCPSLVIGPLLQSTVNASSSVIVDCLKGDREVKLKLRNFVDVRDVADALLLVYETPEASGRYICDANARQMSEVVALLKDWYPAYSHAATKFVQVSDEPLFSSKKLQALGWKFRTLEESLRDSVESFKAAGVLVD

SEQ ID NO: 8557 - protein, 124 aa, Zea mays
MDVLLGSGRFLARRPPLALVPRCSRGSPDKSGSDKGETSADWDKAWSAFKKKGKRTLFSDFSPDKYVTWNPRRSEYPLSEEVDPIKRTERSNLMLWTSPQFTLVGAIIIVLTLLIYTLVVPPPK

SEQ ID NO: 8558 - protein, 401 aa, Zea mays
  misc_feature (65)..(65): Xaa can be any naturally occurring amino acid
  misc_feature (161)..(161): Xaa can be any naturally occurring amino acid
  misc_feature (202)..(202): Xaa can be any naturally occurring amino acid
  misc_feature (222)..(222): Xaa can be any naturally occurring amino acid
  misc_feature (308)..(308): Xaa can be any naturally occurring amino acid
  misc_feature (334)..(335): Xaa can be any naturally occurring amino acid
  misc_feature (378)..(378): Xaa can be any naturally occurring amino acid
  misc_feature (391)..(391): Xaa can be any naturally occurring amino acid
MATVSLTPQAVFSTESGGALASATILRFPPNFVRQLSTKARRNCSNIGVAQIVAAAWSDCPAARXAAADVSAIPNAKVAQPSAVVLAERNLLGSDASLAVHAGERLGRRIATDAITTPVVNTSAYWFNNSQELIDFKEGRHASFEYGSFRNRTTISIGLAXLQKDLTQVEMLMVIDFRSPRNKIYYIISQYLELKCSESTLXFCYIPMFIMLHLVRGAVCVXMTVIRPADMDALQNALDNNNVSLFFTETPTNPFLRCIDIEHVSNMCHSKGALLCIDSTFASPINQKALTLGADLVIHSATKYIAGXNDVIGGCVSGRDELVSKVRIYHHVVXXGVLNPNAAYLILRGMKTLHLRVQCQNDTALRMAQFLEEHPKIXARVYYPGLPSHPXHHIAKSQMTG

SEQ ID NO: 8559 - protein, 618 aa, Zea mays
  misc_feature (211)..(211): Xaa can be any naturally occurring amino acid
MKQEGRRRQHQHQHHRPPPRLELAMAHARGGGGHGHGHEEEAEAAVCLDGDSEAGEARSAGRAPPWRDQLTARGMVASLAVGAMYSVIVMKLGLTTGLVPTLNVSAALIAFVILRGWTQALARFGVATRPFTRQENTVVQTCAVACYSIAVGGGFGSFLLALNKRTYEMAGEDTEGNLPGSYKEPGIGWMTGFLFAVSFVGIVALIPLRKXFFFDFSLTYVGAGMICSHLVNLSLLLGALLSWGIMWPLVSDLKGDWYPADMPESSMRSQGYKAFICIALLLGDGLYNFVKVVAFTVKSLLGRSRLKNAKKEEDIPVLDEIQRNEIFTRDSIPTWLAYSGYLALSAVAVFAIPLMFHEMKWYYVIIAYLLAPALGFCNAYGAGLTDINMAYNYGKVALFILAAWAGKDSGVVAGLVGCGLVKSLVSISADLMHDFKTGHLTLTSPRSMIIAQAIGTAMGCVIGPLTFLLFYKAFDIGNPDGYWKAPYALIYRNMAILGVQGFSALPLHCLQLCYGFFGFAVAANLMRDLLPPKYGKWVPLPMAMGVPFLVGASFAIDMCVGSLMVFIWHIIDRSKASLMVPAVASGLICGDGLWIFPESLLALAKISPPLCMAFRSSH

SEQ ID NO: 8560 - protein, 532 aa, Zea mays
TRPKRRTAFQVMGYCVCVAKGAAEILKLNMALILLPVCRNTLTTLRSTALSHVIPFDDNINFHKVIALSIAIATAIHTLAHVTCDFPRLISCPTDKFMATLGSNFHYKQPTYLGLLESTPGVTGILMIIIMSFSFTLATHSFRRSVVKLPSPLHHLAGFNAFWYAHHLLVLAYVLLVVHSYFIFLTREWYKKTTWMYLIVPVLFYACERVIRKFRENNYHAGIVRAAIYPGDVLSIHMKKPQGFKYKSGMYLFVKCPEVSPFEWHPFSITSAPGDDYLSVHIRTLGDWTSELRMLFGKACQAQVTSKKATLTRLETTVVADAQTEDTRFPKVYIDGPYGAPAQNYRKYDILLLIGLGIGATPFISILKDMLNNLKSNEEVGSIHGSEIGSFKNNGPGRAYFYWVTREQGSFEWFKGVMNEVAGSDHSNVIEMHNYLTSVYEEGDARSALIAMVQSLQRAKNGVDIVSGSKIRTHFARPNWRKVFCDLASAHKNSRIGVFYCGSPTLTKQLKDLSKEFSQTTTTRFHFHKENF

SEQ ID NO: 8561 - protein, 166 aa, Zea mays
MAAAEQQEVVEKGSLMSAVLDKAKGVFSEKIVNIMTPEDAVVDVVFKGVARQGVDYHPKVFVKKHYYQQIIIIQMFYIIKSSARMIVSCAITDPGWLIVNGWSVLVVAVKVLHSITVSMMKNISLVWGIVYHLVIGLSIVILIVGGIIIPVFSQGEMKLLSFLDFF

SEQ ID NO: 8562 - protein, 663 aa, Zea mays
  misc_feature (112)..(112): Xaa can be any naturally occurring amino acid
MAPHTTAAAGGGGGEEALEEASTLRHRHSAAKDGGEEGQANNGVAAAADDDGEGNALSVERAFADQAVPSWREQLTVRAFVVSFFLAIMFSVIVMKLNLTTGIIPSLNVSAXGLLGFFFATEADNPQNVKNPHIGWMIGFLFLVSFIGLFALVPLRKVMIVDYKLTYPSGTATAYLINGFHTPEGAKLAKKQVKTLGKFFLMSFLWGFFQWFYTGGDNCGFQNFPTLGLQAYKNKFYFDFSPTYVGVGMICPHIVNVSVLLGGILSWGIMWPLIGNQKGNWYDASLPESSLHGLQGYRVFISIAIILGDGLYNFVKVLIRTTAGFISMMKKNSTLPVSNNGSPITEGVSFDDERRRDLFLKDQIPRSVAYGGYVAVAAISIGTLPQVFPQLKWYYILVAYIFAPVLAFCNAYGTGLTDWSLASTYGKLAIFIFGAWAGASNGGVLVGLAACGVMMSIVSTAADLMQDLKTGYLTLASPRSMFISQVIGTAMGCVIAPCVFWLFYKAFADIGLSGSEYPAPYAIVYRNMAILGVDGFSSLPKNCLTLCYIFFAAAIVVNLVRDLVPKKVARFIPLPMAMAIPFYLGSFFAIDMFIGTVILFAWETINKAKANAFAPAVASGLICGDGIWTLPQSILALAKVKPPICMKFLSRSVNAQVDGFLGS

SEQ ID NO: 8563 - protein, 96 aa, Zea mays
  misc_feature (22)..(23): Xaa can be any naturally occurring amino acid
  misc_feature (25)..(26): Xaa can be any naturally occurring amino acid
  misc_feature (65)..(65): Xaa can be any naturally occurring amino acid
  misc_feature (76)..(76): Xaa can be any naturally occurring amino acid
  misc_feature (79)..(79): Xaa can be any naturally occurring amino acid
  misc_feature (92)..(92): Xaa can be any naturally occurring amino acid
MAALPLATAEVCDAKGGGGRNXXLXXLQPIFQIYGRRQVFAGPIVTLKGYEDNVLVREFLEEKGXGRVLVVDGGGXMRXAILGGNFMQYGQXNGWG

SEQ ID NO: 8564 - protein, 317 aa, Zea mays
MGSGNLIVKKVVKHSSFDLDIQLDKSWMEDVTCPICLDYPHNAVLLRCTSYEKGCRPFVCDTDQTRSNCLERFKSAYELPSNAKVSSLAVPPLDSIIHIVPSNANNRPSCPLCRGDVIGWVVIGEARLHLNQKKRCCEEDCCSFVGNFNELQKHTQQKHPDSRPSEIDPARQVDWENFQQSSDIVDVLSTIHAQVPNGIVLGDYVIEYGDDDTGEDYEVFRRVRTNWWSCIFCRAFSRSSRSRRRSRARERIGSGRRNGNQVNLENFNLEVPTQPVELREIRFDEIDDEYIVTGAIPSIAAPGRMASFHYRDTRYGR

SEQ ID NO: 8565 - protein, 410 aa, Zea mays
  misc_feature (344)..(344): Xaa can be any naturally occurring amino acid
MATKYAAAAADLVTGRPRKRARLGWDVASAAEAQIGTFCGQEVGDVASLLLSANPSDHTCSSLLPKGVARNASPPWREDDKDGHYVFAVGENLASRYKIYRKMGEGTFGQVLECWDRESKEMVAIKIVRSVKKYSDAAMIEIDVLQKLAKNDAAGKHCVQIRNWFDYRSHICIVCEKLGPSLYDFLQKTGFHPFPIDLIRRIGQQLLESVAFMHRLQLIHTDLKPENILLVSSDYVKLPDPKDGSFSRKLPKSSAIKLIDFGSAAYHHQDRSYIVSTRHYRAPEVILGHGWSYPCDIWSVGCILVELCSGETLFQTHDNLEHLTMMERVLGPLRRHLLKRDEPXPQAVTQVRSVRVVLKLPRLQNLVMQHVDHSAGDFIDLLKRLLAYEPSGRLTAQEALGHVFFTRYRQ

SEQ ID NO: 8566 - protein, 533 aa, Zea mays
  misc_feature (283)..(283): Xaa can be any naturally occurring amino acid
  misc_feature (312)..(312): Xaa can be any naturally occurring amino acid
  misc_feature (335)..(335): Xaa can be any naturally occurring amino acid
  misc_feature (344)..(344): Xaa can be any naturally occurring amino acid
  misc_feature (382)..(382): Xaa can be any naturally occurring amino acid
  misc_feature (386)..(386): Xaa can be any naturally occurring amino acid
MKPSPSKKKGKKKKKSSLPAAAPAPPPAEGAADTEACPPLPGTITLTAATAAAAVVSETESSSSGEASTCLSACFTASSSGTASSHSFSALSSSASTASSSAAGEERRDLTWLLDAFASATFDQIDSAYREAGGDPFVAAGILSSTQDTHPPQPPQPAPQPPPPPDLSPRSGSGGRKAGRRPKRVAVAATGMVADVIGKEYTRPAANSVVSMPNAWKGRDGESDGSGSGGRKDSVEEAEQFLCSMLGDNSELGMGVVRDVLGQYGYDVEKEQLAALCSEWIYXHEFLWGEPQISYAEAVKEAPRSSTWTTRXTEMKAGPQQVLDSLLSMKAILTXLTSDLIYVXPVFMCYSYGCCLGCDVGCSSDAEARDCSWVNYGVMLTXHAAXLCTHRSSDCTTVAYLAEEGKHYRELGRIEDEKASRNIHAARNKHITNTVTIDLHGQHVQHAMNLLKIHMMICICIPSVLLRVITGCGSEGTGKGKIKRSVIELAEKEHIEWREENSGTVALRLGGPREYRFLEHESDSDLVGNFNID

SEQ ID NO: 8567 - protein, 152 aa, Zea mays
MAEEQQHQRWQEGHRLCANNCGFFGSPATLDLCSKCYRDLYQQQPAGAAAGPSAPTASAFQHSSSAVSGAAAVSPDLEPPATAPAGAKAGRCSSCRKRVGLTGFACRCGATFCGVHRYPERHACAFDFRAAGRDAIARANPVVKGDKLKDKI

SEQ ID NO: 8568 - protein, 67 aa, Zea mays
  misc_feature (30)..(30): Xaa can be any naturally occurring amino acid
  misc_feature (34)..(34): Xaa can be any naturally occurring amino acid
  misc_feature (36)..(36): Xaa can be any naturally occurring amino acid
  misc_feature (38)..(38): Xaa can be any naturally occurring amino acid
  misc_feature (43)..(43): Xaa can be any naturally occurring amino acid
MAGGRVAHATLKGPSVVKEIFIGLTLGLIXGGMXNXFXWNEQXEDFFFPPPPGKKKGGGGTKKNVHY

SEQ ID NO: 8569 - protein, 92 aa, Zea mays
MAFLRSFFATKHIIRRSFTTESLSTPKGFFAVYVGENLKKKRYLVPVCYLNKPSFQALLRKAEEEFGFNHPTGGLSLPCDEAFFFTVTSQIR

SEQ ID NO: 8570 - protein, 45 aa, Zea mays
MLLKIKRVPTVVSNYQKDETVEEGGCGRNCLSKCCINGARLPLYT

SEQ ID NO: 8571 - protein, 508 aa, Zea mays
  misc_feature (358)..(358): Xaa can be any naturally occurring amino acid
  misc_feature (376)..(376): Xaa can be any naturally occurring amino acid
  misc_feature (394)..(394): Xaa can be any naturally occurring amino acid
MYMRPPTANDRPPSGGGGGAAAGAAAGDDDFAFYYSYLQDADAAAASATSTLALTVDDPNPSAAGMTNGRRRKQRGADGAGAAGEGEEEATKDGKKRSIAKLLTSLAALEAEEHNDGDYEHTSAAAAAAAAGGGGGGRGGGRRLWVKERDHEWWDRMSSPACPEDEFRRAFRMSRATFEAVCEELGAAVAKEDTMLRAAIPVRQRVAVCIWRLATGEPLRLVSKRFGLGISTCHKLVLEVCAAIKAVLMPKAVQWPEAPDAAAAESARFEAASGIPGVVGAMYTTHIPIIAPKANVAAYYNRRHTERNQKTSYSNSRCRAGRDGGRCLTRTSCIGWPGSMSDGPTCSTGSALYLQRGXAGLLQGQRLVGGAGYPLXMDWLLVPYTHHNMTWAQXHVFNERVDGVRAVARDAFQRLKSRWGCLQKRTEVKLQDLPVVLGACCVLHNICERAGDAVDPDIAFQLFDDDMVAENPVRSTAAVAARDNIAHNLLHRSSSSSSAAAGPRFAFN

SEQ ID NO: 8572 - protein, 218 aa, Zea mays
  misc_feature (198)..(198): Xaa can be any naturally occurring amino acid
MLGRPEKKKKKKKKKVAERSAAAAAIGREERVCRIQQAEGGVSGGPENMSGNGAKKVVDAAVKAGRTIIDWDGMAKLLVTDEARKEFAALRRAFDDVNHQLQTKFSQEPQPIDWEYYRKGIGSKVVDMYKEAFESIEIPKYVDTVTPQYKPKFDAVIAELKEAEKEHQKESERIEKELAEMEEMRKKISTMTADDYFXKYPELRKKFDDEIRNDNWGY

SEQ ID NO: 8573 - protein, 410 aa, Zea mays
  misc_feature (144)..(144): Xaa can be any naturally occurring amino acid
MAPAPALTATSVLKRSHLPGVHSLACRRQPGADRVSVLSPAIPPPRVSWQQGSGVVAKRLLWASASGSFEKDNIGEDAVLPSQIAVENKVDFLKILKSANSIIPHIVLGSTILALVYPPSFTWFTTRYYAPALGFLMFAVGVNXSSAKDFIEAIKRPDAIAAGYIGQFVIKPLFGFLFGTLAVAVLNLPAALGAGIMLVSCVSGAQLSNYATFLTDPHMAPLSIVMTSLSTATAVFVTPTLSYFLIGQKLPVDVKGMMSSIVQIVVAPIAAGLLLNRFLPRLCAAIQPFLPSMSVFVTALCVGSPLAINIKAVLSPFGLTIVLLLFAFHTSSFVAGYHLAGTWFRKSDDVKALQRTISFETGMQSSLLALALANKFFPDPLVGVPPAISVVLMSLMGFALVMVWSKKREA

SEQ ID NO: 8574 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSIMRAALECCHKGWGTSVIVGVAASGQEISTRPFQLVTGRVWKGTAFGGFKSRTQVPWLVDKYMKKEIKVDEYITHNMNLADINDAFHLLHEGGCLRCVLAMQI

SEQ ID NO: 8575 - protein, 595 aa, Zea mays
  misc_feature (110)..(110): Xaa can be any naturally occurring amino acid
MAAMNGKVLGKCGRNMNSLKRKRENPAAYDADIFHNSELHQHPVNDSAVRFHVDKDRKAKIVCHFNKQVLQSYKNFMSSAPPKRILLRIGAVWKDFPEKIVKLAQADFRXKKTITETGYQNQLFLLDFAHMTFIDTKTGLQRPIAWIDENGNRYFPESFVQDQKIFMKKDFGNGYHDYISVESNGTREMNDQLGTSESSAESSNFGSSTEDVSSPKRARAENNSIIKKYCDMGEAIGENEPCTLLPTACNLLPRQANLGEVSRAQRTIEAVEKLLLQGMGSVIESKDIIGIYRTPLLDDHGQVRYHNHEKHVQVTRCHRGNANVRYAWLPCSKSTVHEMMLNSSLQVHKPPIKCAAYGEGTFLTPANRSDACVKFSAVDENGIVHMMLCRVIMGNVEIVHPGSKQHQPSNDYFDSGVDDLKNPRHYIVWDMNLNSHIYSEFVVTVKLPSKTKDSFVSQENCQNSSDLSLVLNSSSPDCISQEMNLEAPPALGGGCAAPMLGDSMAKAPSSPWMPFSMLFAAISTKVSPQIMDMVIGCYEEFKSKKISRCELIKELRHVVGDRVLISTIMRLQDKLPPVERREGPGASAAKMVAKP

SEQ ID NO: 8576 - protein, 318 aa, Zea mays
MEAEAAAKRTRDSGEDAAAAGISAVIPGWFSEISPMWPGEAHSLKVDKVLFQGKSDYQSVMVFQSSTYGKVLVLDGVIQVTERDECAYQEMITHLPLCSIKDPKKVLVIGGGDGGVLREVSRHSSVEQIDICEIDKMVVDVSKQFFPHLAVGFEDPRVSLHIGDGVAFLKNAPEGTYDAVIVDSSDPIGPAQELFEKPFFQLVARALRPGGVVCTQAESIWLHMHIIEDIVVNCRQVFKGSVNYAWTTVPTYPSGVIGFMLCSTEGPAVDFQHPVFNIEEDEHPMKSKGPLKFYNSEIHTASFCLPSFAKRVIESKAN

SEQ ID NO: 8577 - protein, 395 aa, Zea mays
MAGVTATGMAGVPATFSSATAQIGGFLSKKPYAPPLWATHLSPMPCHTFSLGHFPTPIHKWNLPNLPEGTEVWIKRDDLSGMQLSGNKVRKLEFLMADAVAQGADCVITVGGIQSNHCRATAVAAKYLNLDCYLILRTSKLLVDKDPGLVGNLLVERLVGAHVDLVSKEEYGKIGSVALADLLKKRLLEEGRKPYVIPVGGSNSLGTWGYIEAIREIEQQIQQSSDVQFDDIVVACGSGGTIAGLALGSRLSSLNTKVHAFSVCDDPEYFYDYVQGLIDGLNSGFDSHDIVSMENAKGLGYAMNTAEELKFVKDIAASTGIVLDPVYSGKAVYGLLKDMAGNPAKWKGRKVLFIHTGGLLGLYDKADQLSSLAGSWRRMDLEDSVPRKDGTGKMF

SEQ ID NO: 8578 - protein, 276 aa, Zea mays
MYKERSGGGGGGSSRSEILGGAIDRKRINDALNKKLEKSSTSTTTSRVFSSKDKDPFSFTSTKTQLPDVESETDSEGSDVSGSEGDDTSWISWFCNLRGNDFFCEVDEDYIQDDFNLCGLSGQVPYYDYALDLILDVDASNSEMFTDEQHEMVESAAEMLYGLIHVRYILTTKGMAAMTEKYKNCDFGRCPRVFCCGQSCLPVGQSDIPRSSTVKIYCPKCEDISYPRSKFQGNIDGAYFGTTFPHLFLMTYGNLKPQKPTQSYVPKIFGFKVHKP

SEQ ID NO: 8579 - protein, 347 aa, Zea mays
MGNSDAASPASAAAARNSKKKRGSRSAAKLKQSKRDTRREQFLSRGQGNKDAKSAASPTGAVSGSPILASPHPPLPRRRADSRSRGSDPEDRDEAIAAGLEADGSGLDSPGSDKRQSGDCPQRKGFPGNGGGPSLSSGSSVWSSSRSVSDAEEDTGGPEDESEVFDDWEMAADALYVDDSSCNQSSGPTPTLPQAPTTAEPSHAAKPEPIQSKTRAWAPDDIFRPQSLPSISKQTSFPASIGNRWQDMGMSAAQQGILSLPLSCPICCDDLDLTDSSFCPCPCGFHMCLFCHNRILVEDGRCPGCRKQYNTVSAAEGGGGGGSRATVGTGREMEKRLSRSCSMGPSY

SEQ ID NO: 8580 - protein, 63 aa, Zea mays
  misc_feature (37)..(37): Xaa can be any naturally occurring amino acid
MLFHYCNNRSMPTSAALDVVAKNLNLKFFEVPTGWKXFFGNLMDAGMCSICGEESFGTGSDHI

SEQ ID NO: 8581 - protein, 581 aa, Zea mays
MSSSDPDDAPDGGEDSPLFRRSGGPSSGGTVGDVPVSQSLIKAASNVCFSLFVLAVLVVTVVAVTYQPPDPWLQSSAAITTSLSRVLPNSTFLVPDDSLLPTGEDFNSSTAVPAPVRDDDDAAAAVSAASAAAAGNRTCDPDAPLNCSDPRVLAAVKAFNARAFFRKSIVFLSYEAPVSGPKPGQCDVAWRFRNRREKSWRRYRDYRRFSLASGDGCALDIVSVGKFRSGTNAARRPYPKGSKSKRPRVSPPPVDAEINDTIPVVGSEAEFKKGKYLYYMRGGDHCKSMNQFVWSFLCGLGEAKFLNRTFVMDLNICLSGAHTVDGKDVDGKDFRYYFDFEHLKESVPVVEEGDFLKDWKRWDKKKGPGRITVRKVPSYKVTPMQLKRDKSNIIWRQFNGHEPENYWYRVCEGRAAKVIQRPWYAIWKSKRLMNIVTEIAGRMDWDYDGLHVVRGWKAQNKQMYPNLDSDTSPDALVDKVTKLVKPMRDLYIATNEPFYNYFDKLRSHFHVHLLDDYKELWSNTSEWYNETTTLSRGKPVPFDAYMRVIVDTEVFYRSKTQVETFNNLTRDCKDGINTCNL

SEQ ID NO: 8582 - protein, 72 aa, Zea mays
KANNPFYYKELWSNTSEWYNETTTLSRGKPVPFDAYMRVIVDTEVFYRSKTQVETFNNLTRDCKDGINTCNL

SEQ ID NO: 8583 - protein, 233 aa, Zea mays
MYVVKDIGGAIGLMAVALVLLGTWPVVLAVLERRGRLPQHTFLDFSATNFMAAVLIALTFGQIGPASSTPNFLTQLTQYGWAFVGLSVTEVMASSLKVVIGTTLNYFLDGRMNKAEILFPGVGCFLIAAILGSLVHASNAADNQEKLANNNASNAAAAADEEKDLTKHLLELEIQSQEAEPDAGTAGFLVGLEEKRSIKVLGSHALLGLGIVVFAGIFYALFAPAFNLATNDQ

SEQ ID NO: 8584 - protein, 271 aa, Zea mays
  misc_feature (134)..(134): Xaa can be any naturally occurring amino acid
  misc_feature (168)..(168): Xaa can be any naturally occurring amino acid
  misc_feature (197)..(197): Xaa can be any naturally occurring amino acid
  misc_feature (206)..(206): Xaa can be any naturally occurring amino acid
  misc_feature (217)..(217): Xaa can be any naturally occurring amino acid
  misc_feature (226)..(226): Xaa can be any naturally occurring amino acid
  misc_feature (233)..(233): Xaa can be any naturally occurring amino acid
MADSMVASFWGPVTSTTELCEENYAHSSYIAEFYNTISNVPCVLLALIGLVNAFCQGFEKRFSVLHISNMILAIGSMIFHATLQLLLQQSDETPMVWEILLYMYALLPDWHYRSTMPTFLVLYGAAFARSTFLXRFQVVFQAGITVALWLGLHPPGMYQVLLTEPKDXVAKRAPQKLGVPYPLTLGDPSCWPGVDRXFCKKLSHWXLNPQGPAWWHXLMGLNSLLXNPFLMFXCRAQQRGWEAQIPSLLGFLPYVKVQKPKKRELFVFVEP

SEQ ID NO: 8585 - protein, 408 aa, Zea mays
MEAGEFAREPSAGSCVTAGFNGAGGMTRQTHGGYEPERSYRNSAERSSSEKRIPQREHIPSVAAGSSDLRHRLLKQRKSNNNSRSAEALGRHDTHLEDERNDQHRPRGEQQDGLSRSRLHDRIRLPGETAFDSLGSRSEEWDRGSRARLSPPKSSDLRGRLHERLKGRLGEEIPGSSAKGLAVKASSSEDTESLNFAGPKSLAELKAKKGVGRSGEDAVVKGLGSSRMTSEIVWSREAASFEGPKPLSAILKRKREPASEIPAAQPGITQEADNYAAGAEEEIQTLANDTVGENMEGIGEEEEEEEAFHPEDDVAYDDNANEAAVAQELDEYEDADAAAQDYDDEAAAAQEVEEHQDGEAAAEDYDYEGGRRSTPREENEPGLPKTEGPTTILEGGHRFFSPEKVPNG

SEQ ID NO: 8586 - protein, 75 aa, Zea mays
  misc_feature (68)..(68): Xaa can be any naturally occurring amino acid
MDSAAARPDEEEARRRRSTDCIYFLASPLTCKEGSECEYRHSDAARMNPRDCWYWFHGNCANPKCSFXHPVPCRM

SEQ ID NO: 8587 - protein, 371 aa, Zea mays
MTVVDAVVSSTDAGAPAAAAAPVPAGNGQTVCVTGAAGYIASWLVKLLLEKGYTVKGTVRNPDDPKNAHLRALDGAAERLILCKADLLDYDAICRAVQGCQGVFHTASPVTDDPEQMVEPAVRGTEYVINAAAEAGTVRRVVFTSSIGAVTMDPKRGPDVVVDESCWSDLEFCEKTRNWYCYGKAVAEQAAWETARRRGVDLVVVNPVLVVGPLLQATVNASIAHILKYLDGSARTFANAVQAYVDVRDVADAHLRVFESPRASGRHLCAERVLHREDVVRILAKLFPEYPVPARCSDEVNPRKQPYKFSNQKLRDLGLQFRPVSQSLYDTVKNLQEKGHLPVLGERTTTEAADKDAPAAEMQQGGIAIRA

SEQ ID NO: 8588 - protein, 376 aa, Zea mays
  misc_feature (101)..(101): Xaa can be any naturally occurring amino acid
  misc_feature (122)..(122): Xaa can be any naturally occurring amino acid
  misc_feature (131)..(131): Xaa can be any naturally occurring amino acid
  misc_feature (158)..(158): Xaa can be any naturally occurring amino acid
  misc_feature (186)..(186): Xaa can be any naturally occurring amino acid
  misc_feature (217)..(217): Xaa can be any naturally occurring amino acid
  misc_feature (283)..(283): Xaa can be any naturally occurring amino acid
MTVVDAVVSSTDAGAPAAAAAPVPAGNGQTVCVTGAAGYIASWLVKLLLEKGYTVKGTVRNPDDPKNAHLRALDGAAERLILCKADLLDYDAICRAVQGCXGVFHTASPVTDDPEQMVEPGXVAAPEYVIXAAAEAGTVRRVVFTSSIGAVTMDPKRXGPDVVVDESCWSDLEFCEKTRNWYCYGXKAVAEQAAWEAARRRGVDLVVVNPVLVVGPXLLQATVNASIAHILKYLDGSARTFANAVQAYVDVRDVADAHLRVFESPRASGRHLCAERVLHREDXVVRILAKLFPEYPVPARCSDEVNPRKQPYKFSNQKLRDLGLQFRPVSQSLYDTVKNLQEKGHLPVLGERTTTEAADKDAPAAEMQQGGIAIRA

SEQ ID NO: 8589 - protein, 380 aa, Zea mays
  misc_feature (124)..(124): Xaa can be any naturally occurring amino acid
ENPTKPSYQLDRRHHARPHNSTDAGAPAAAAATVPAGNVQTVCVTGAAGYIASWLVKLLLEKGYTVKGTVRNPDDPKNAHLKALDGAAERLILCRADLLDYDAIWRGRESYQTELPTRSSSSRXPADDPAARGTEYVINAAAEAGTVRRVVFTSSIGAVTMDPKRGPDVVVDESCWSDLDFCQKTRNWYCYGKAVAEHAAWETARRRGVDLVVVNPVLVVGPLLQATVNASIAHILKYLDGSARTFANAVQAYVDVRDVADAHLRVFESPRASGRHLCAERVLHREDVVRILAKLFPEYPVPARCSDEVNPRKQPYKFSNQKLRDLGLQFRPVSQSLYDTVKNLQEKGHLPVLGERTTTEAADKDAPAAEMQQGGIAIRA

SEQ ID NO: 8590 - protein, 361 aa, Zea mays
MRDAVAKREAMKGGASSKGPVVVTGASGFVGSWLVMKLLQAGYTVRATVRDPENVGKTKPLLDLPGATERLSIWKADMADEDSFDEAIRGCTGVFHVATPTDFESKDPENEVIKPTVEGMIRILRACKEAGTVRRIVFTSSAGTVCVEERRRPVYDHDNWSDVDFCRRVKMTGWMYFVSKSLAEKAAMAYAAEHGLDLVSVIPTLVVGPFLSAAMPPSLVTALALVTGNEAHYSILKQVQFVHLDDLCDAEIFLFEHPAAAGRYVCSSHDATIHGLAAMLRDRYPEYDIPQKLRGIEDELQPVHFSSKKLLDHGFTFRYTVEDMFDAGIRTCREKGLIPLATAGGVGSASLRTPGETARRM

SEQ ID NO: 8591 - protein, 223 aa, Zea mays
MATLSSCSRLSSGTGAAAIRRQPKPTRAGVLFTSRRGSSASIHASAATAAPAAVEQQNTGVSVSLPTWAEFELGRAPVYWKTSNGLPSSPGEGLTLFYNPAASKMAPNDVFGVAFNGGFNQPIMCGGEPRQMTLQVRGKADPPIYTIRIRVPQHATSLIFSFTNGAEWDGPYTLKFRVPKPWQKKPLSFFNEGLADELNREGACDLAIYPDENIAITSCAMDG

SEQ ID NO: 8592 - protein, 229 aa, Zea mays
MATLSSCSRLSSGTGAAAIRRQPKPTRAGVLFTSRRGSSASVRTAAAAATAAPAAVEQQNTGVSVSLPTWAEFELGRAPVYWKTSNGLPSSPGEGLTLFYNPAASKMAPNDVFGVAFNGGFNQPIMCGGEPRQMTLQVRGKADPPIYTIRIRVPQHATSLIFSFTNGAEWDGPYTLKFRVPKPWQKKPLSFFNEGLADELNREGACDLAIYPDENIAITSCAMDGYLEV

SEQ ID NO: 8593 - protein, 305 aa, Zea mays
  misc_feature (44)..(44): Xaa can be any naturally occurring amino acid
EWPRRRRPSCPPISPASPTSAARRRRPLPPSHSSFASAARAAAXQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 8594 - protein, 336 aa, Zea mays
MLGTGNVHGLGVEALQMLTQMVLSNEEELKIKYFKDDSLNRLCPVDVFLKAMLDVPFVFKRVDAMLYIASFYLEINRLRMSYATLEGACQEMRSSRLFHKVLEAVVNFGNFMSTNSGSPSSKGLEPNTVLKIADVKGADGKAALMQFIVQEIVKPEGYDVMQHGSGACKMSTNTLQCDAECRKHGLEVVAKLAAQLSNTKKAASIDIKRLSQSVSELGMGLGKVHDVVRLNSMVTSVDSARRFHNSMSTFLRHAEEEILKLQSQESICLSSVKEMAEWFIGESVNDEAHMFRIFAGVKEFLAMLDHICKEAGEVSSNNWVGATTASWMAAPMGMMP

SEQ ID NO: 8595 - protein, 538 aa, Zea mays
  misc_feature (312)..(312): Xaa can be any naturally occurring amino acid
  misc_feature (345)..(345): Xaa can be any naturally occurring amino acid
  misc_feature (362)..(362): Xaa can be any naturally occurring amino acid
  misc_feature (386)..(386): Xaa can be any naturally occurring amino acid
  misc_feature (398)..(398): Xaa can be any naturally occurring amino acid
MKPSPSKKKGKKKKKSSLPAAAPAPPPAEGAADTEACPPLPGTITLTAATAAAAVVSETESSSSGEASTCLSACFTASSSGTASSHSFSALSSSASTASSSAAGEERRDLTWLLDAFASATFDQIDSAYREAGGDPFVAAGILSSTQDTHPPQPPQPAPQPPPPPDLSPRSGSGGRKAGRRPKRVAVAATGMVADVIGKEYTRPAANSVVSMPNAWKGRDGESDGSGSGGRKDSVEEAEQFLCSMLGDNSELGMGVVRDVLGQYGYDVEKEQLAAFGLQSELGHEFLWGDPQISYAEAVKEAPRSSTWTTRXTEMKAGPQQVLDSLLSIPETRTYEPTFMDWKNXLIYVFPYLCVIAMDAAXGCDDGGGYRELRGDCSWVNYNIKXRPHAANCALTEXDRSYASYLAEEGKHYRELGRIEDEKASRNIFEARNKHITNTVTIDLHGQHVQHAMNLLKIHMMICICIPSVLLRVITGCGSEGTGKGKIKRSVIELAEKEHIEWREENSGTVALRLGGPREYRFLEHESDSDLVGNFNID

SEQ ID NO: 8596 - protein, 540 aa, Zea mays
MKPSPSKKKGKKKKKSSLPAAAPAPPPAEGAADTEACPPLPGTITLTAATAAAAVVSETESSSSGEASTCLSACFTASSSGTASSHSFSALSSSASTASSSAAGEERRDLTWLLDAFASATFDQIDSAYREAGGDPFVAAGILSSTQDTHPPQPPQPAPQPPPPPDLSPRSGSGGRKAGRRPKRVAVAATGMVADVIGKEYTRPAANSVVSMPNAWKGRDGESDGSGSGGRKDSVEEAEQFLCSMLGDNSELGMGVVRDVLGQYGRSLRQLTDEISNTGLQSELGHEFLWGEPQISYAEAVKEAPRSSTLPSRSTVMKAGPQQVLDSLFKIPETRTYEPSSMDWKKVVKKLQTINYTAASNNHERPKDGGGYRELRGVAARHYDKMKEYYQKAAFAYSKGDRSYASYLAEEGKHYRELGRIEDEKASRNIFEARNKHITNTVTIDLHGQHVQHAMNLLKIHMMICICIPSVLLRVITGCGSEGTGKGKIKRSVIELAEKEHIEWREENSGTVALRLGGPREYRFLEHESDSDLVGNFNID

SEQ ID NO: 8597 - protein, 350 aa, Zea mays
  misc_feature (19)..(19): Xaa can be any naturally occurring amino acid
  misc_feature (74)..(74): Xaa can be any naturally occurring amino acid
  misc_feature (133)..(133): Xaa can be any naturally occurring amino acid
  misc_feature (159)..(159): Xaa can be any naturally occurring amino acid
MAFAPKTSSSSSLSSALQXAAQSPPLLLRRMSSTATPRRRYDAAVVVTTTTTARAAAAAVTVPAAPPQAGRRRXRCHQSKRRHPQRRSRPVSDTMAALMAKGKTAFIPYITAGDPDLATTAEALRLLDGCGAXDVIELGVPCSDPYIDGPIIQASVARXLWPSGTTMDAVLEMLREVTPELSCPVVLLSYYKPIMSRSLAEMKEAGVHGLIVPDLPYVAAHSLWSEAKNNNLELVLLTTPAIPEDRMKEITKASEGFVYLVSVNGVTGPRANVNPRVESLIQEVKKVTNKPVAVGFGISKPEHVKQIAQWGADGVIIGSAMVRQLGEAASPKQGLRRLEEYARGMKNALP

SEQ ID NO: 8598 - protein, 349 aa, Zea mays
  misc_feature (68)..(68): Xaa can be any naturally occurring amino acid
  misc_feature (84)..(84): Xaa can be any naturally occurring amino acid
  misc_feature (156)..(156): Xaa can be any naturally occurring amino acid
MAFAPKTSSSSSLSSALQAAQSPPLLLRRMSSTATPRRRYDAAVVVTTTTTARAAAAAVTVPAAPPQXAGAGRRCRQSKRRHPXERRSRPVSDTMAALMAKGKTAFIPYITAGDPDLATTAEALRLLDGCGADVIELGVPCSDPYIDGPIIQASVXARALASGTTMDAVLEMLREVTPELSCPVVLLSYYKPIMSRSLAEMKEAGVHGLIVPDLPYVAAHSLWSEAKNNNLELVLLTTPAIPEDRMKEITKASEGFVYLVSVNGVTGPRANVNPRVESLIQEVKKVTNKPVAVGFGISKPEHVKQIAQWGADGVIIGSAMVRQLGEAASPKQGLRRLEEYARGMKNALP

SEQ ID NO: 8599 - protein, 124 aa, Zea mays
MEDFYVTIPYGLLLVAGGVAGYMKRGSAASLAAGGGFGAALLLAGALSAWAFAHAGGGAAAIFATVLQIVCAVLLTVVMGIRYVKTQKIMPAGIVASISALVLIFYVYKISTGGNKDYMSVSAE

SEQ ID NO: 8600 - protein, 355 aa, Zea mays
PHYRTPSKSKPSPRRIAAAGSASLDPDPGDMPRYDDRSGNTRLYVGRLSPRTRSRDLEYLFSKYGRIREVELKRDYAFIEFSDPRDADDAQYNLDGREVDGSRIIVEFAKGVPRGSGGSREYNGRGPPPGTGRCFNCGVDGHWARDCQAGDWKNKCYRCGERGHIERNCQNSPRNLRRERSYSRSPSPRRGRGRSRSYSRSRSYSRSRSPTGSPRGGRRDRDERRSRSLSYSRSASPRRSVSPAKEKERSRTPDGSRSPSPRDKVSPPPKDNGAHNGSDREDSPGGREMSKRSRSPSDGYRSPVGNGRSPSRSPSPKVNNGDDPSPKGNNGDDPSPKGNNGDDEHRGSPRGSQSP

SEQ ID NO: 8601 - protein, 733 aa, Zea mays
PPPPQLSVDGDARTPANDRDPAGLLQHDDTENQQQQQACWERFLLKETLNVLLVESDDSTRQVVSALLRCCMYQVISAENGQQAWAYLEDKRNNIDLVLTEVFMPGVSGISLLSRIMSHNICKNIPVIMMSSSDAMSTVFKCLSKGAVDFLVKPIRKNELKNLWQHVWRQRCHSLSCSSGSGSESGIQTQKCTKSKGANESGNNSGSNDDEAGMGLNARDDSDNGSGTQAQNSWTKLAVEIDSPQAMSLDQLADPANSTCAQVIHSKSEICSHRWLPGSSNRNCKKQKYTNDDFKGKDLEIDGPGNLYMDHQSSPNERPIKAADHENNSKEPIKAADHENNSKESMIENLEEPTVRAADLIGSMAKNMDTQQAARAAEDTPNFSSKVPEGKGKNDQHDNYVLPSLELSLKRSRSCGDGANDTVNDDEQRNSALRRSNLSAFTRYHTSAASNQGGTGLVGSCSPHDNSSEAVKTDSTYNMKSNSDAAAIKQGSNGSSNNNDMGSTTKDVVTKPSTNNERVMLPSAIKANGYTSTFHPVQQWMVPDNATAGKAKADEVANNAGRNSHPGDVQSNLTQQHRPTLHYVHFENSGSGALQCGSSNVFDPPLEGQATNNYGVKAGSNSGSNKGQNNGSTAGASTAAANAGRTDTEIRAIDKSGPGGGSGSGNDTYVRRLAASMTPRQEQLKKYREKKKDRNFGKKVRYQSRKRLADQRPRVRGQFVKQAVQNQEGDGER

SEQ ID NO: 8602 - protein, 430 aa, Zea mays
  misc_feature (160)..(160): Xaa can be any naturally occurring amino acid
LGPSRPAGKPSLSSRPCTTAQLILRRRAGRPDHAAGPADAWVARLLLLGAAVLLLASAATAQDCLSATFSGGRTFGRCNNLPSLSASLHWTYHPENGTADVAFRAPSDASGWVAWGINPDRGGSMGGSSVFVASPSQDGSGAVSILMTHLESTCPSLTNXHALKFKVPAGPAAEYSDRAYTIYATVELPGNSTQQFTVWQAGPATSNGGISPHPTAPANLASTQRLDFLSGSSTAASNSRLHRRNIHGMLNAIAWGVLIPVGAIIARYLRVFESADPAWFYLHIACQCSGYILGVAGWGLGLKLGSESAGVTYQPHRSIGIAIFCLATLQVFALLLRPDKKNRYRLYWNIYHHSVGYSVIVLGAVNIFKGLDILKPASGYKTAYIVVLATLGGVALCLEAITWPIAIRKRRRNAADKASNGNGNGWQQGA

SEQ ID NO: 8603 - protein, 87 aa, Zea mays
  misc_feature (12)..(12): Xaa can be any naturally occurring amino acid
  misc_feature (14)..(15): Xaa can be any naturally occurring amino acid
  misc_feature (26)..(26): Xaa can be any naturally occurring amino acid
  misc_feature (28)..(28): Xaa can be any naturally occurring amino acid
  misc_feature (34)..(34): Xaa can be any naturally occurring amino acid
  misc_feature (49)..(49): Xaa can be any naturally occurring amino acid
  misc_feature (73)..(73): Xaa can be any naturally occurring amino acid
MSGNGAKKVVDXAXXAGRTIIDWDGXAXLLVTDXARKEFAALRRAFDDXNHQLQTKFSQEPQPIDWEYYRKGXGSKRSWPRRCARTA

SEQ ID NO: 8604 - protein, 296 aa, Zea mays
MIPPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 8605 - protein, 181 aa, Zea mays
MASSMFSSTAVVTSAAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 8606 - protein, 215 aa, Zea mays
  misc_feature (121)..(121): Xaa can be any naturally occurring amino acid
MAAAKIAPSMLSSDFANLASEAERMVRLGADWLHMDIMDGHFVPNLTIGAPVIQSLRKHTKAYLDCHLMVTKPSDYVEPFGKAGASGFTFHIEVARDNWQDLIQSIKSKGMRPGVSLRPGXAENPVELVLVMTVEPGFGGQKFMPEMMDKVRTLRKKYPSLDIEVDGGLGPSTIDVAASAGANCIVAGSSIFGAADPGAIISVLRKSVEGSQNKN

SEQ ID NO: 8607 - protein, 125 aa, Zea mays
MAAAKIAPSMLSSDFANLASEAERMVRLGADWLHMDIMDGVRWHFVPNLTIGAPVIQSLRKHTKAYLDCHLMVTKPSDYVEPFGKAGASGFTFHIEVARDNWQDLIQSIKSKGMRPGVSLRPGTP

SEQ ID NO: 8608 - protein, 760 aa, Zea mays
MAHEREPLLQQRQTGVGNACGAKDSSSAPAPSAAALPSLARTVLKFLMWAVFLTWAAGIFLYPTKPVQAVFRKWVGLTRDSMFGIAGGIFLTFSAPILIIALLAYVYISFFPSEHVVEKRKLRSLSFRLWTFPVLVDGPFGVVSAVEFIGIVLFIVFVVYSMTYYAVEAVSLVSKFDIPSMTESELILDVIGLRLGAVGLFCMLFLFLPVARGSVLLRLIDIPFEHATRYHVWLGHLTMALFTLHGLFYVISWSMQGRLREELRQWKEIGVANLPGVISLAAGLLMWVTSLHPVRKRFFELFFYTHQLYVVFVVFLAFHVGDFIFSICAGAVFLFMLDRFLRFWQSRAKVDIISAACRPCGTVELVFSKPASLHYNALSFIFIQVRELSFLQWHPFSVSSSPMDGRYHMSVLIKVLGTWTEKLRSIITDVQEKNGGDSELQCGRMTACVEGPYGHESPYHLMYENLVLVAGGIGISPFLAILSDIIHRIEEGKQCMPKNVLVLWSVKKSKELSLLSAVDAQTISSSVSDRLQLDIQAFVTQEPHPPLEDGIVGDDQKVPGMFVKNGTAMSGLVGTGDNFWAAMYFLASTLGFLLAYALVQVYYVKPHNVVAWWYLGLLFMLCMVAGVALPGGLVVLLWHLSEKQRLEDDKWDASQSPRAEQTGPLAAAGGGDDDAAPSVSLAALRTTRYGCRPNFEAEFAAFAERAGDAADVGVLVCGPQGLQTSVARECRARNLRRGGLGAAKSRSGAVFHFNSHSFDL

SEQ ID NO: 8609 - protein, 107 aa, Zea mays
FPTRPPTRPPTRPEGPDGCRYYSKDFSGRVGGLKVSAVDTTGAGDAFVAGVLSQLATDFSLLQDEGRLREALKFANVCGALTVTQRGAIPALPTRQQVLDALANFVA

SEQ ID NO: 8610 - protein, 177 aa, Zea mays
MSDVEPLVLAHVIRDVLDSFAPSIGLRITYNSRLLLSGVELKPSAVVNKPRVDVGGTDLRVFYTLVLVDPDAPSPSNPSLREYLHWMVIDIPGTTGASFGQELMFYERPEPRSGIHRMVFVLFRQLGRGTVFAPDMRHNFNCKSFARQYHLDVVAATYFNCQREAGSGGRRFRPESS

SEQ ID NO: 8611 - protein, 561 aa, Zea mays
MSEGDATQLALEKGLPQVSNDDGSSSPATMHKLKVDTEDAGSKIESPTPEKLESRSKGVVVSSLARNLLAERYKDRFANQFLEDEGDIDDEDYNDSISPGMSRSQRSRSIELLEKHKDLLNLFNRMESSIRLLRLRKRMATFNNIATQVEILAKRKLSYCHLAQMKYLFPEAIQIKRVLLHDEKSLCMYADMEIILVMDVVEYTSPDHSPSMAICDAFYSKLLTFLDAHHKGTDIPEAILPEPFNLRSRGQLNLEASNNGHAAEPHLQGTTKDGFSNASHFPQSFRKLMSQKVITDGAERTQLLLDPTKLSSVSAYDTEGTNRSPKKQDKHASVTVNSEISATPSRHLISRCQEGTPKQETSESPLLAQTPATQTPKRQLPTPLEKLEATCGHISEPRSASSARRSLNTSLKFEGGSPSYHDRMEHVATSKIGIFSEDSSSFNKSLEENGPVFFTDREKINLADPVGVQEKMASLRSTFGIVCDISHSIKNSLITKQELFHNILANNLEIEQMGEIEEQLHILEDLAPDWISKVINGGEIFYSFETIADQNSVWERLVEAV

SEQ ID NO: 8612 - protein, 227 aa, Zea mays
MAPSFTSLLSAANSAAASRLPSAAAGRASTFVRFPHHPTGWAGASVAAPRTARKRAPGVAYATAATEKSIYDYTVKDIDGKDVPLKKFKNKVLLIVNVASQCGLTTANYTELSHIYEKYKTQGFEILAFPCNQFGAQEPGSNTQIKQFACTRFKAEFPIFDKVDVNGPNTAPIYKFLKSSAGGFLGDLVKWNFEKFLVDKNGKVIERYPPTTSPFQIEKDIQKLLAA

SEQ ID NO: 8613 - protein, 230 aa, Zea mays
MAPSFTSLLSAANSAAAATASRLPSAAAGRASTFVRFPHHPTGWAGASVTAPRTARKRAPGVAYATAATEKSIYDYTVKDIDGKDVPLKKFKNKVLLIVNVASQCGLTTANYTELSHIYEKYKTQGFEILAFPCNQFGAQEPGSNTQIKQFACTRFKAEFPIFDKVDVNGPNTAPIYKFLKSSAGGFLGDLVKWNFEKFLVDKNGKVIERYPPTTSPFQIEKDIQKLLAA

SEQ ID NO: 8614 - protein, 230 aa, Zea mays
MAPSFTSLLSAANSAAAATASRLPSAAAGRASTFVRFPHHPTGWAGASVAAPRTARKRAPGVAYATAATEKSIYDYTVKDIDGKDVPLKKFKNKVLLIVNVASQCGLTTANYTELSHIYEKYKTQGFEILAFPCNQFGPPAPRASAQIKQFACTRFKAEFPIFDKVDVNGPNTAPIYKFLKSSAGGFLGDLVKWNFEKFLVDKNGKGIERYPPTTSPFQIEKDIQKLLAA

SEQ ID NO: 8615 - protein, 240 aa, Zea mays
MSLTIPTNLVLNPRSNKSLTQSVPKSSARFVCSDDKSSSSAPQSMKAFSAAVALSSILLSAPMPAVADISGLTPCKDSKQFAKREKQQIKKLESSLKLYAPESAPALALNAQIEKTKRRFDNYGKYGLVCRTRRVYPHFERERETNGKLGGEGPLTSRGLPFSPTYDGMDWGGVGRKPLNKPISRGQHTPRMKKIHPPRFLWARPDSFSRGYPSTPWAANRKVSQVWNLLGKGRLTKGTL

SEQ ID NO: 8616 - protein, 130 aa, Zea mays
MEVPMNSTQSGPHFPVQHQSLSLDIKGNKTDIVISKYEDTFLLIVAQIGCMGTILAAKKDESVFSDPTYNVSVLFGKRNEPLLQACARQLIEHISGSGSARSLVISLGLKDHSQGTLKDIIVAVIENRLW

SEQ ID NO: 8617 - protein, 130 aa, Zea mays
MEVPMNSTQSGPHFPVQHRSLSLDIKGNKTDIVISKYEDTFLVIVAQIGCMGTILAAKKDESVFSDPTYNVSVLFGKRNEPLLQACARQLIEHISGSGSARSLVISLGLKDHSQGTLKDIIVAVIENRLW

SEQ ID NO: 8618 - protein, 251 aa, Zea mays
HASGGSTNSSTEEGKELNDPRVLTDVGDVPIQEIRDCGVEDDRLMHVISESVKTVMEEEPLRPLVLGGDHSISYPVVRAVSEKLGGPVDILHLDAHPDIYDCFEGNTYSHASSFARIMEGGYARRLLQVGLRSITKEGREQGKRFGVEQYEMRTFSKDREKLENLKLGEGVKGVYVSVDVDCLDPAFAPGVSHIEPGGLSFRNVLNILQNLQGDVVAADVVEFNPQRDTVDGMTAMVAAKLVRELTAKISK

SEQ ID NO: 8619 - protein, 619 aa, Zea mays
MKFMKLGSKPDAFQSDGADVRYVVSDLATDVVVHVGEVKFYLHKFPLLSKSGKLQRLVLKAAEDETDEVRIDDLPGGAKSFEICAKFCYGMVVTLSPHNVVAARCASQYLEMTEDMEKGNLIFKIEVFINSSILRSWKDSIIVLQSTKALSPWSEELKVVGRCIDAIASKTSADPANVTWSYSHSSKKGGACAEIVEPAGKPSIAPKDWWVEDLCELDVDLYKRVMVAIKSKGRMSPELIGEALKAYAVRWLPDSYDALVAEDYMRRNQCLVETIIWLLPSDKSSGCSCRFLLKLLKVAILVGGGEHVKEELIRRISFQLHKATVKDLLLPATSPNDGTYDVRLVHNLVQRFVARTALSHNGGFIEKSDEKMIELNFEQESILSVGELVDGYLSEVASDQDLSLSMFVELATAVPEVARPVHDNLYYAVDAYLKEHPDINKSEKKKICSLVDVKKLSADASVHATQNDRLPLRLVVQVLFFQQLRAGPSKELALIDNGEHACTRPTQDQCDRGERRIPKHPNSLNKQVTSLSARESQQHRISEHRGGRNSFKDQLGGLLLQSRSRRIFDKLWSSKGQGEHGGKGSETSGSSQSPPLSAKPAEVKPSPLPPLRGRRYSVS

SEQ ID NO: 8620 - protein, 219 aa, Zea mays
  misc_feature (197)..(197): Xaa can be any naturally occurring amino acid
  misc_feature (207)..(207): Xaa can be any naturally occurring amino acid
SGSRFRPNPASNPMAASAGSKIRNAKLVLLGDVGAGKSSLVLRFVKGQFVEFQESTIGAAFFSQTLAVNDETVKFEIWDTAGQERYHSLAPMYYRGAAAAIVVYDISNQASFTRAKKWVQELQAQGNQNTVVALAGNKADLLEAREVQIEEAKTYAQENGLFFMETSAKTATNVNDIFYEIAKRLLQGQAAQNPQAXAGMVLSQRPXERVVSAASCCSS

SEQ ID NO: 8621 - protein, 554 aa, Zea mays
RRRDQPAASQPHQEGVDSSDAAPPADAAAPDHPAAEKPEKVKRERRSRSSRSASTAAAAHAEVRLGGSFANKARGARGAAGWPAWLSAVAGEAIDGWTPRRADSFEKIDKIGQGTYSNVYKARDSLSGKIVALKKVRFDNLEPESVRFMAREIRILRRLDHPNVIKLDGLVTSRMSCSLYLVFDYMVHDLAGLAASPDIKFTLPRVKCYVRQLLSGLEHCHNRGVLHRDIKGSNLLLDNNGVLKIGDFGLASFFDPNHKQPMTSRVVTLWYRPPELLLGATDYGVGVDLWSAGCILAELLAGKPIMPGRTEVEQLHKIFKLCGSPTEEYWKKSKLPHATIFKPQQPYKRRIADTFKDFPQSALRLIETLLAIDPSDRLTATSALNSDFFKTEPYACEPSSLPQYPPSKEMDAKRRDEEARRLKAAGGRANGDGTRKTRTRDRPRAVPAPEANAELQANIDKRRRLITHANAKSKSEKFPPPHQDGALGFPLGCSNHMEPSFEPPDPSSFSTVFPFEKSAVPTWSGPLADSAAGNQKRKHKSARSSKQPATARAR

SEQ ID NO: 8622 - protein, 101 aa, Zea mays
  misc_feature (14)..(14): Xaa can be any naturally occurring amino acid
  misc_feature (31)..(31): Xaa can be any naturally occurring amino acid
RGMALLKAMPKGRXARYLGDTLKLKVAQGVXGAVADKGSVLRFIPYTMQAVKQGSRARGADSLQSAHDLLRSETLRLEVRTGAAQAEGGIHGLVSYVKKAF

SEQ ID NO: 8623 - protein, 146 aa, Zea mays
MPGHLFEDTFVVTRLDPDGKKFDRVSRVEARSEQLDMYMQLDVATDVYPTHAGEKFNMVIAPTLNLDGTPDTGYYTQAGRKTLADNYEYVMQGKLYKISEDTSSSQNAKVEMYASFGGLLMLLRGDPSTAASFELDQRLFLLIRKV

SEQ ID NO: 8624 - protein, 146 aa, Zea mays
MSEHLFEDTFVVTRLDPDGKGGGGVSRVEARSEQLDMYMQLDVATDVYPMHAGEKFNMVIAPTLNLDGTPDTGYYTQAGRKTLADNYEYVMQGKLYKISEDTSSSQNAKVEMYASFGGLLMLLRGDPSTAASFELDQRLFLLIRKV

SEQ ID NO: 8625 - protein, 123 aa, Zea mays
MDILLGSGRFLARRTPLMLVPRCSRGSRDRSGSDKGETSADWDKAWAKFKKKGKRTLFSDFSPDKYVTWNPRRSEYPLSEEVDPIKRTERSNLMLWTSPQFTLVGAIIIVLTLLIYTLVVPPK

SEQ ID NO: 8626 - protein, 114 aa, Zea mays
MDILLGSGRFLARRTPLMLVPRCSRGSRDRSGSDKGETSADWDKAWAKFKKKGKRTLFSDFSPDKYVTWNPRRSEYPLSEEVDPIKSQLKDLNLMRCTSPQFRWVRRSSSSCHN

SEQ ID NO: 8627 - protein, 255 aa, Zea mays
MATAAVTMTMATHNPRARAPLRVCAAWDMNPGAATVATPKPSKAKAKPPPPPATTTPARPPPLTHADLFARSSEAQGGVKKSTYMGFEKWWLPPAPVVKKPRSLYSAVSLAYLGDCIYELYARRHFFFPPLSINEYNKRVMDVVKCESQDLLLNKLLGEDFLTEEERDILRWGRNIVSSKTRTRKRAGIAVYNRASSLETLIGYLYLTNFKRLEQLMFQLGFTSGASSQHIADELRSSFQKTTPASATPPQPATQ

SEQ ID NO: 8628 - protein, 118 aa, Zea mays
MAALAASSTAAFAAKPRLPRARLTDGLPHLIVSGDQRHWGEFVTPGLLFLYIAGWIGWVGRSYLIAISGEKKPAMREIIIDVELATRLLPRGFIWPVAAYRELINGDLVVDDKDIGYY

SEQ ID NO: 8629 - protein, 175 aa, Zea mays
  misc_feature (5)..(5): Xaa can be any naturally occurring amino acid
  misc_feature (14)..(14): Xaa can be any naturally occurring amino acid
  misc_feature (17)..(18): Xaa can be any naturally occurring amino acid
AESNXQGMDGFWLXKGXXLLLRLLKSLQEDVQERAATALATFVVMDDETANVDPARSEAVMQNGGIRMLLDLARCSRESAQSEAAKAIANLSVNTKVAKAVADEGGITILTDLAKSMNRLVAEEAAGGLWNLSVGEDHKVVILWMLIHCMYNLLLLGCFFVIIQWLHFRRQKKKK

SEQ ID NO: 8630 - protein, 347 aa, Zea mays
MGNSDAASPASAAAARDSKKKRGSRSAAKLKQSKRDTRREQFLSRGQGNKDAKSAASPTGAVSGSPILASPHPPLPRRRADSRSRGSDPEDRDEAIAAGLEADGSGLDSPGSDKRQSGDCPQRKGFPGNGGGPSLSSGSSVWSSSRSVSDAEEDTGGPEDESEVFDDWEMAADALYVDDSSCNQSSGPTPTLPQAPTTAEPSHAAKPEPIQSKTRAWAPDDIFRPQSLPSISKQTSFPASIGNRWQDMGMSAAQQGILSLPLSCPICCDDLDLTDSSFCPCPCGFHMCLFCHNRILVEDGRCPGCRKQYNTVSAAEGGGGGGSRATVGTGREMEKRLSRSCSMGPSY

SEQ ID NO: 8631 - protein, 278 aa, Zea mays
MSSSVGGGSAGGGGVDMVSLLEKAKDLDQLKKEQDEIVADINKIHKKLLASPEMVDKPVDTILLKLRGLYARAKELSENEISASNALIGLLDGLLQSGASTAQKKKIEVGEQKKKRIKSDTDSARFSAASMRNQLDQAASLKGEQVAARVKSDDEKDEWFVVKVIHFDKETKEYEVLDEEPGDDEESTQKKYKLPMSYIIPFPKKGDPSSAPDFGQGRQVLAVYPGTTALYRATVASHRKRKSDDYILEFDDDEEDGALPQRAVPFYRVVALPEGHRQ

SEQ ID NO: 8632 - protein, 137 aa, Zea mays
  misc_feature (103)..(103): Xaa can be any naturally occurring amino acid
PCSILDGQLVAARVKSDDEKDEWFVVKVIHFDKETKEYEVLDEEPGDDEESTQKKYKLPMSYIIPFPKKGDPSSAPDFGQGRQVLAVYPGTTALYRATVASHXSYILEFDDDEEDGALPQRAVPFYRVVALPEGHRQ

SEQ ID NO: 8633 - protein, 91 aa, Zea mays
SQKKYKLPMSYIIPFPWKGDPSSAPDFGQGRQVLAVYPGTTALYRATVASHRKRKSDDYILEFDDDEEDGALPQRAVPFYRVVALPEGHRQ

SEQ ID NO: 8634 - protein, 157 aa, Zea mays
  misc_feature (135)..(135): Xaa can be any naturally occurring amino acid
HCYFCLQTTLLDYIRKSKLVASEAGGITQGIGAYQVLLPVDGNHQACVFLDTPGHEAFGAMRARGARVTDICIVVVAADDGVRPQTSEAIAHARAAGVPIIIAINKIDKEGANAERVMQELSQIGIMPEMWGGDXPMIEISALTGDNVDELLETVML

SEQ ID NO: 8635 - protein, 146 aa, Zea mays
MPRSGISGTLRSPQIDVVIDTGNPFLNRTVDGFLKIGAVGACKVAAEETFDCLHRGDVSKRKVEHALKKMCKEGTYWGTVAGVYVGVVYGVERVRGRSDWKNAMVGGALSGALVSAASSNHGDKIVKDAITAGAVATAVEFANYLT

SEQ ID NO: 8636 - protein, 146 aa, Zea mays
  misc_feature (104)..(104): Xaa can be any naturally occurring amino acid
MPRSGFSGSFRSPKIDVVIDMGNPFLNRTVDGFLKIGAVGACKVAAEETFECLHRGDVSKHKVEHALRKMCKEGAYWGTVAGVYVGMVYGVERVRGRSDWKTRXIGGALSGALISGASNSDRGKVVKDAITAGAVATAVEFINCIT

SEQ ID NO: 8637 - protein, 129 aa, Zea mays
MPRSGISGTLRSPQIDVVIDTGNPFLNRTVDGFLKIGAVGACKVAAEETFDCLHRGDVSKRKVEHALKKMCMEGAYWGTVAGVYPGVALAVRRCSRAHGLALGPVQLHVTTLVGVRLHGGAVQAFGSRR

SEQ ID NO: 8638 - protein, 256 aa, Zea mays
MASRKFFVGGNWKCNGTGEDVKKIVTVLNQAEVPSEDVVEVVVSPPFVFLQQVKGLLRLDFAVAAQNCWVRKGGAFTGEISAEMLVNLQVPWVILGHSERRALLGESSDFVADKVAYALTQGLKVIACIGETLEQREAGTTMDVVAAQTKAIAEKISDWTNIVLAYEPVWAIGTGKVATPAQAQEVHDGLRKWLHSNVSPAVAELTRIIYGGSVNGANCKELAAQPDVDGFLVGGASLKPEFVDIIKSATVKSSSA

SEQ ID NO: 8639 - protein, 392 aa, Zea mays
  misc_feature (103)..(103): Xaa can be any naturally occurring amino acid
  misc_feature (265)..(265): Xaa can be any naturally occurring amino acid
  misc_feature (296)..(296): Xaa can be any naturally occurring amino acid
GYLEAGRADLSFQDRSWTLANGTGVIDIQHPCRSNVAVRKELHKPASDRSCIHLEFDISGTGLVYETGDHVGVYAENSVQTVEEVERLLDLSPDTFFSIHADXEDGSPRKGGGSLAPPFPSPCTLRTALLRYADLLNPPKKAALLALASHASDPAEAERLRFLASPSGKDEYSQWITASQRSLLEVMAAFPSAKPPLGVFFAAIAPRLQPRYYSISSSPKMAPSRIRVTCALVFGPSPTGRIHQGVCSTWMKNTIPLEHSEECSXAPIFVRQSNFKLPADPSTPIIMIGPGTGLAXPFRGFLQERLALKQSGAELGTSILFFGCRNRNMDYIYEDELQTFLEAGALSELIVAFSQEGPTKEYVQHKMVEKVSIKLCIPNKFVAKGVHNYSLR

SEQ ID NO: 8640 - protein, 473 aa, Zea mays
MAGAAAAAVASGVSARPAAPRRASAGRRARLSVVRAAISLEKGEKAYTVQKSEEIFNAAKELMPGGVNSPVRAFKSVGGQPVVFDSVKGSRMWDVDGNEYIDYVGSWGPAIIGHADDKVNAALIETLKKGTSFGAPCLLENVLAEMVISAVPSIEMVRFVNSGTEACMGALRLVRAFTGREKIIKFEGCYHGHADSFLVKAGSGVATLGLPDSPGVPKGATYETLTAPYNDVAAVKKLFEDNAGEIAAVFLEPVVGNAGFIPPQPGFLNALRDLTKQDGALLVFDEVMTGFRLSYGGAQEYFGITPDVTTLGKIIGGGLPVGAYGGRRDIMEMVAPAGPMYQAGTLSGNPLAMTAGIHTLKRLTEPGTYEYLDKITGELVRGILDVGAKAGHEMCGGHIRGMFGFFFTGGPVHNFGDAKKSDTEKFGRFYRGMLEEGVYFAPSQFEAGFTSLAHTSQDIEKTVEAAEKVLKRI

SEQ ID NO: 8641 - protein, 77 aa, Zea mays
  misc_feature (69)..(69): Xaa can be any naturally occurring amino acid
MSLARSLWDDYSAYEHWAKIEVPKDKDELAELQARLRKRFPVDAYNKARMELDPNKVLSNAKLEKMFPXLEPPHQTK

SEQ ID NO: 8642 - protein, 186 aa, Zea mays
RTCRRTRPPPAAQVLLVLDEEGRLVAAGSPGEVCVRGDNVTAGYKGNPEANEAAFRFGWFHTGDIGVVDDQGYVRLVGRIKELINRGGEKISPIEVDAVLLGLPGVAQAVSFGVPDDKYGEEINCAVIPRDGSALREEEVLAHCRRNLASFKVPKKVFITDDLPKTATGKIQRRIVAQHFVQPTSA

SEQ ID NO: 8643 - protein, 336 aa, Zea mays
MGADYYKVLGVDRGASDDDLKKAYRKLAMRWHPDKNSTNKKEAETKFKEISVAYEVLSDPKKRAIYDQLGEEGLKGQPPPGAGGPGTSPFFPGGVHSTAHHFNPRSADDIFKEFFGSPGMGGMRTEPGFQRSVFGNDIFSSRFRAEGSTSMQQPLRKAAAIENPLPVGLADLYKGVTKKMKISRETIDASGRISNTEDILTIQVKAGWKKGTRITFPDKGNEAPNMKPADIVFIIDEKPHDVFTREGNDLVVTEKISLVEALTGYTARVTTLDGRSLSLHINSIIHPKYEEVMPGEGMPMPKDPTKKGNLRIKFNIMFPSRLTSDQKAGIKRLLGS

SEQ ID NO: 8644 - protein, 225 aa, Zea mays
MVKRWLPLEANPDVMNQFMWGLGVPEDVGFCDVYGLDDELLAMVPQPVLAVLLLYPQDRSKESQASATSSVETKEPSKNVYFTKQTVGNACGTVGIIHALGNATSRIKLGEGSYFDRFYKRTADMDPIQRAAFLEEDEEMENAHSIAATAGDTEAKDGVIEHYICFSCVDGELYELDGGTSQPIPHGPSTPDTLLQDAAEVIKARIAMYSQSNNFNVMALSGKAI

SEQ ID NO: 8645 - protein, 855 aa, Zea mays
METSISPPGTSKQSAVRKPSPGSSLKDLCLVSKQGSIAEVESALALLKKSGGNIDGRNAFGLSALHLATWRNHLPIVRRLLDAGADPDARDGESGWSSLHRALHFGHLCIAGVLLQFGASLALEDTKGRTPVDLISCPVSQANGDFPDAVATEVFSWGSGTNYQLGTGNAHIQKLPCKVEALHGSYIKTVAASKFHSVAVSSNGELYTWGFGRGGRLGHPDIHSGQTTAVITPRQVTVGLGRKRVNAVAAAKHHTVIATELGELFTWGSNREGQLGYPSVDTQPTPRRVGSLKQRIISVAAANKHSAAVADTGEVFTWGCNKEGQLGYGTSNSASNCIPRMVEYLKGKVLRGVSAAKYHTIVLGADGEVFTWGHRLVTPRRVVVARCLKKGGNTNLKFHRMERLQVISVAAGTTHNTALTADGALFYWVSSDPDLKCQQIFSMCGRNIVNISAGKYWTAVATSTGDVFMWDAKKRKDETPIFTRVHGVKRATFVCVGETHMLVLSSIYHPEYPPKPKSQGLKSMLEWNGGTEELGEDILFDDVQPNSGLSGSSGEMSKGVPSLKSLCEKVAVEYLLEPKNSIQLLEIADSLEAKELKKHCEDLAIRNLDYIFTVGASSIMNASSEILVNLEKLLDEKSSEPWSQHRLPTMTATYPAVIDSDVEEDEAREFPKTRKCGKSASRPSAMSSDDSFLQKDCTAEQAVSKQIRALRKKLQQIEILEAKQLAGHQLDSQQVAKLESRAALEGELAELGIPSEIYSTSSACPAEGRTNRKPEVSKKQKRKNKQSTQTPSVKNEPGQQIPITELQVLQVNVSAEKEAYAADPIKPMEAAAFSNTKDTASPPEKKPSQPTPSKK

SEQ ID NO: 8646 - protein, 224 aa, Zea mays
GQLGYPSVDTQPTPRRVGSLKQRIISVAAANKHSAAVADTGEVFTWGHRLVTPRRVVVARCLKKGGNTNLKFHRMERLQVISVAAGTTHNTALTADGALFYWVSSDPDLKCQQIFSMCGRNIVNISAGKYWTAVATSTGDVFMWDAKKQWNGGTEELGEDILFDDVQPNSGLSGSSGEMSKGVPSLKSLCEKVAVEYLLEPKNSIQLLEIADSLEAKELKKHCE

SEQ ID NO: 8647 - protein, 209 aa, Zea mays
  misc_feature (101)..(101): Xaa can be any naturally occurring amino acid
MSYYGDRRAESSIVEAFTLSPLPYPVILVLLMVTLLLGASWFFTYDDFIEEASQQLSWALLGVPIALVLLIRWISSVDSFEGYLGFYPEGEPLEGPLRAGXAEGSSPWGVALLVLLLLVLASFHSTIHDMWGAVNGCAPAPGSCLSARLVCLCSVDRSIDEVLMSFFFSSFCPLRAALAWYVVLHARTYGSMIPCTYLLGGCCGAGYRV

SEQ ID NO: 8648 - protein, 600 aa, Zea mays
PRVRPRVRPRVRPRVRKPSSSSKNKKKKGFFFFLDGAGAGTSAGLVGRSVARLVLDDNNFTGGIPAGVSSLGLLQYFDVSGNQLQGWIPSSVFALPALRYINLSRNRLAGQLPATTACAEALAFVDVSANLLTGARPPCMRGNSSARTVLVAGNCFADAKQQRASSYCNPGALAAVLPPPQGNGGGGGQGTGKGREIGMVLAIAGSVVGAALLIALAMVVVLRRARRQRPEATILPKSPAATPTNKADGWKAPAKATQKIITPADKRHASQAARVNTLEVPAYRVCTLEELQEATDNFSSSNLIKTSPLAQDYNGQLQDGSRVLVRCLRLKPKYSSQSLVQYMEIISKLRHRHLVSIIGHCIVSDEENPNNASSVYLVSECVTNGSLRSHLTEWRKREMLKWPQRVCAAIGIARGVQFLHNLTAPGFVQNNLNIEHILLDKTLTSKISNFSLPMISTSKNGKILSETPFAVHEDNDIGSAQNAAQGDKEDIYQIGLILLEVITGKPTESQSQLESLKAQLSEALTEDPDRLKDMADPAIHGTFAVDSLSTVAEIALKCTAGDPSDRPSIDDVLWNLQYSMQVQDGWASSESLGLSVKSQV

SEQ ID NO: 8649 - protein, 86 aa, Zea mays
  misc_feature (71)..(71): Xaa can be any naturally occurring amino acid
MSEHLFEDTFVVTRLDPDGKKFDRVSRVEARSEQLDMYMQLDVATDVYPMHAGEKFNMVIAPTLNLDGTPXTGYYTQGDVCIVRRA

SEQ ID NO: 8650 - protein, 295 aa, Zea mays
MMGGWGVSDGYEGSKRTRMMMESNPYFAVNAGSPLDVSKRSRIVEPGPPYFGAMGSNTGGASGGFYQPFNSSNLAGAGASTGIQNFPGVRLRGLPFDCNDIDICKFFVGLDIVDCLLVNKNGRFTGEAFVVFPTAMQTEFALHRNRQNMGRRYVEVFRCKKQEYYSAIANEVSQGGYFESEYRRSSPPPRPPKKTAEDKGSMEYTEVLKLRGLPYSATTEDIIKFFLEYELTEENVHIAIRSDGKATGEAFVEFPTAEVAKTAMCKDKMTIGTRYVELFPSTPEEASRARTRGRH

SEQ ID NO: 8651 - protein, 295 aa, Zea mays
MMGGWGVSDGYEGSKRTRMMMESNPYFAVNAGSPLDVSKRSRIVEPGPPYFGAMGSNTGGASGGFYQPFNSSNLAGAGASTGIQNFPGVRLRGLPFDCNDIDICKFFVGLDIVDCLLVNKNGRFTGEAFVVFPTAMQTEFALHRNRQNMGRRYVEVFRCKKQEYYSAIANEVSQGGYFESECRRSSPPPRPPKKTAEDKGSMEYTEVLKLRGLPYSATTEDIIKFFLEYELTEENVHIAIRSDGKATGEAFVEFPTAEVAKTAMCKDKMTIGTRYVELFPSTPEEASRARTRGRH

SEQ ID NO: 8652 - protein, 206 aa, Zea mays
MPAAAAAAAAVSELELLVPRGPGGGAMDQLRPEPAAGARHEIEKTAAPDVESEPAAAEPEPERVPPWREQVTARGMVAALLIGFVYTVIVMKLSLTTGLTPTMNVSAALLAFLALRGWTRALGRLGIACRPFTRQENTVVQTCVVACYTIGFGGKPVRDDFLACQSTSGFGSFLLGLDKKTYELSGVSTPGNVPGSYREPAIGWMT

SEQ ID NO: 8653 - protein, 338 aa, Zea mays
QYYLKTGTCKFGATCKFHHPREKAAMATRVQLNELGYPLRLNEKECAYYLRTGQCKFGSTCKFHHPQPSTMMVAVRGSVYSPGQSATSPGHHAYQGAVTSWPLSRSASFIASPRWPGHSSYAQVIVPPGLVQVPGWSPYAAQIGSSSSDDQQRTPGAAQYYTGSRQSGTPGIGDRGMFSSYQAGSVPVGLYAVQTENVFPERPDQPECQFYMKTGDCKFGSVCKFHHPRERIIPTPNCALSPLGLPLRPGEPICSFYNRYGMCKFGPNCKFHHPMGNPMYGHASSPTSEAQTSRRMLAHVPSHPEVSPDSGSGRSRRIVHSDSQQIPSVERITEREAS

SEQ ID NO: 8654 - protein, 561 aa, Zea mays
MLDRPPRRGFAFIVPSMSMQEPTSAATQLHAAMEASLSLSSLQLAFTAVAAIAALGVAVTVTRYNRRYMGLRLPPGPPGWPVVGNLFQVAFSGKLFIHYIRELRKEYGPILTLRMGERTLVIISSAELAHEALVEKGREFASRPRENTTRNIFSSNKLTVNSAVYGPEWRSLRRNMVSGMLSTSRLREFRHARRRAMDRFVSRMRAEAAASPDGASVWVLRNARFAVFCILLDMTFGLLDLREEHIVRIDAVMKRVLLAVGVRMDDYLPFLRPFFWRHQRRALAVRREQIDTLLPLINRRRAMLRDMQQRQSSSPPPDPSVAAPFSYLDSVLDLRIEGRDDGALTDDELVTLCAELLNGGTDTTATAIEWGMARIVDSPSIQARLHEEVMQQVGDARPVDDKDTDAMPYLQAFVKELLRKHPPTYFSLTHAAVQPGCKLAGYDVPVDANLDIFLPTISEDPKLWDRPTEFDPDRFVSGGETADMTGSAGIRMIPFGAGRRICPGLAMGTTHIALMVARMVQAFEWRAHPSQPQLDFKDKVEFTVVMDRPLLAAVKPRNLAF

SEQ ID NO: 8655 - protein, 289 aa, Zea mays
  misc_feature (143)..(143): Xaa can be any naturally occurring amino acid
  misc_feature (216)..(216): Xaa can be any naturally occurring amino acid
PTRSSTRPLEIDNVGGWRYMFGFSAPLAAIMAIGMWTLPSSPRWLLLRAVQGKASLEDNKKKAIQALRTLRGRTASEKVLADDVDDTIVSIKAAYAGQEAEGNVWDVFEGASLKAFTIGGGLVLFQQITGQPSVLYYAASILXGVAVFKVDDVGRRPLLIGGVGGIALSLFLLAAYYKILNNFPFVAVGALLLYVGAYQVSFGPISWLMVSEIFPXRTRGRGISLAVLTNFGSNALVTFAFSPLKELLGPANIFFLFGVIAVLSLVFVILVVPETKGLSLEEIESKILK

SEQ ID NO: 8656 - protein, 216 aa, Zea mays
MAAGAGARAKAAGALALALVLALAGANSEGDALSALRRSLRDPGGVLQSWDPTLVNPCTWFHVTCDRDNRVTRLDLGNLNLSGHLVPELGKLEHLQYLELYKNSIQGTIPSELGNLKNLISLDLYKNNISGTIPPSLGKLKSLVFLRLNGNHLTGPIPRELSGISSLKVVDVSSNDLCGTIPTSGPFEHIPLSNFEKNPRLEGPELQGLAIYDTNC

SEQ ID NO: 8657 - protein, 99 aa, Zea mays
MEVPMNTTQSGPHFPVQHRSLSLDIEGNKTDIVINKYEDTFLVIVTQIGCMGTILAAKKDESVFSDPTYNVSVLFGKRDEPLLLACARQLIEHISGSGS

SEQ ID NO: 8658 - protein, 257 aa, Zea mays
MDAADVWGRSSSSSSSSAAAARRLQARYDLYMGIDDADAGLDEVTEPRGGAESYNCPFCGEDFDFVGLCCHIDDEHAVEAKSGACPICATRVGMDLIGHLTMQHGSYFKMQRRRRVRKVSSGSHSLLSLLRKDLRNGSLQSFLGGSSYVSNPPAAAPDPFLSSLICTLPVAEPSKDLHSDSSDNNFLLNKFPDEKPVERYVTSSLSFLLPHSSPSLPRYHWIWAEPSLSEKDQKERVQRSKFVRGLVLSTIFDDDNL

SEQ ID NO: 8659 - protein, 170 aa, Zea mays
MPRSRINGNFIDKTSLIVANILLQIIPTTSGEKRAFTYYRDGMLAQSEGNYAEALQNYYEAMRLEIDPYDRSYILYNIGLIHTSNGEHTKALEYYFRALERNPFLPQAFNNMAVICHYRGEQAILQGDSEIAEAWFDQAAEYWKQAIALTPGNYIEAQNWLKITKRFEFE

SEQ ID NO: 8660 - protein, 170 aa, Zea mays
MPRSRINGNFIDKTSSIVANILLQIIPTTSGEKRAFTYYRDGMLAQSEGNYAEALQNYYEATRLEIDPYDRSYILYNIGLIHTSNGEHTKALEYYFRALERNPFLPQAFNNMAVICHYRGEQAILQGDSEIAEAWFDQAAEYWKQAIALTPGNYIEAQNWLKITKRFEFE

SEQ ID NO: 8661 - protein, 152 aa, Zea mays
  misc_feature (18)..(18): Xaa can be any naturally occurring amino acid
VSPIEYGHVLLIPRVLDXPPQRIDPESFLLALQMAAEGGSPYFRLGYNSLGAFATINHLHFQAYYLSVPFPVEKAATHKIPLSEDTKKNGVTVSKLINYPVRGLVFEGGNTLDDLATVVSNACIWLQDNNVPYNVLISDCGKRVFLFPQVNF

SEQ ID NO: 8662 - protein, 220 aa, Zea mays
MSAAAAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAASIISTEQGEELRKQIGAVAYIECSSKTQRNVKAVFDTAIKVVLQPPRRREVTRKKMKTSSNQSLRRYLCGSGCFTS

SEQ ID NO: 8663 - protein, 335 aa, Zea mays
  misc_feature (330)..(330): Xaa can be any naturally occurring amino acid
MAPLGDGGAAAAAASNNLVVSFGEMLIDFVPDVAGLSLAESGGFVKAPGGAPANVAYAIAKLGGSSAFVGKFGDDEFGHMLVCVLKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTDATAQDXIAKAN

SEQ ID NO: 8664 - protein, 165 aa, Zea mays
MLDHLVGLLKLRVVRGVNLAVRDLRSSDPYVVVRIGKQKLKTRVVKKSVNPEWDDELTLSIEDPAVPIRLEVFDKDTFVDDTMGNAEVDIRPLVEIVKMKLQDVADRTVVKKLVPNRQNCLAEESSIYISEGKVKQDMVVRLRNVESGEIELQLQWVDLPGSKGV

SEQ ID NO: 8665 - protein, 509 aa, Zea mays
MATVSLTPQAVFSTESGGALASATILRFPPNFVRQLSTKARRNCSNIGVAQIVAAAWSDCPAARPHLGGGGRRARGVASSHAAAASAAAAASAAAEVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAAAMLSALVPAGGHIVTTTDCYRKTRIYMETELPKRGISMTVIRPADMDALQNALDNNNVSLFFTETPTNPFLRCIDIEHVSNMCHSKGALLCIDSTFASPINQKALTLGADLVIHSATKYIAGHNDVIGGCVSGRDELVSKVRIYHHVVGGVLNPNAAYLILRGMKTLHLRVQCQNNTALRMAQFLEEHLKIARVYYPGLPSHPEHHIAKSQMTGFGGVVSFEVAGDFDATRKFIDSVKIPYHAPSFGGCESIIDQPAIMSYWDSKEQRDIYGIKDNLIRFSIGVEDFEDLKNDLVQALEKI

SEQ ID NO: 8666 - protein, 482 aa, Zea mays
  misc_feature (21)..(21): Xaa can be any naturally occurring amino acid
  misc_feature (60)..(60): Xaa can be any naturally occurring amino acid
  misc_feature (82)..(82): Xaa can be any naturally occurring amino acid
  misc_feature (306)..(306): Xaa can be any naturally occurring amino acid
  misc_feature (308)..(308): Xaa can be any naturally occurring amino acid
  misc_feature (325)..(325): Xaa can be any naturally occurring amino acid
  misc_feature (335)..(335): Xaa can be any naturally occurring amino acid
MATVSLTPQDVFSTESGGALXSATILRFPPNFVRQLSTKARRNCSNTPPPPPPPRSRRDXRAKRPFPRRRRNPSSSYAMATXVAHSAGGHLHRVRRRPGFCHHPPLPASAAADVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVPAGGHIVTTTDCYRKTRIYMENELPKRGISMTVIRPADRDALPNALDHNNVSLFLAAALTIPLLRCTDIEHVSXNXGCVSGRDELVSKVRIYXPCSWWCLNPXNAAYLILRGMKTLHLRVQCQNDTALRMAQFLEEHPKIARVYYPGLPSHPEHHIAKSQMTGFGGVVSFEVAGDFDATRKFIDSVKIPYHAPSFGGCESIIDQPAIMSYWDSKEQRDIYGIKDNLIRFSIGVEDFEDLKNDLVQALEKI

SEQ ID NO: 8667 - protein, 178 aa, Zea mays
  misc_feature (172)..(172): Xaa can be any naturally occurring amino acid
RPRVRPRVRPRVRPRVRAGAAAVETAAAAAAANGKACCHAAKGPGYATPLEAMEKGPREKLVYVTCVYNGTGINKPDYLATVDLDPSSPTYSQVIHRLPVTHIGDELHHSGWNSCSSCHGDPSAKRRFLILPSLLSGLVYVVDTATDPRAPFLHKVVESEDIAENTGLGFPXTSNCLR

SEQ ID NO: 8668 - protein, 74 aa, Zea mays
LLAFLTTVVNLTVGWRNGIRGSAYGPQFVAKPLAPDNPPLKVRFIDNIDPGGIDHQIAQLGSQLATSYSCNCHF

SEQ ID NO: 8669 - protein, 527 aa, Zea mays
MAMAMMAMRRAVALGARHIPAAAASSFRVVSLRHMSADAGAAMEKIRAAGLLRTQGLIAGQWVDAYDGKTIEVQNPATGEVLANVSCMGSRETSDAIASAHSTFYSWSKFTASERSKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSEFTPLTALAAADLALQAGIPAGALNVVMGNAAEIGDALLQSTQVRKITFTGSTAVGKKLMAGSANTVKKVSLELGGNAPCIVFDDADIDVAVKGSLAAKFRNSGQTCVCANRILVQEGIYEKFAKAFIQAVQSLKVGNGLEESTSQGPLINEAAVQKVEKFINDATSKGANVMLGGKRHSLGMSFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGIDEYLELKYICMGNLG

SEQ ID NO: 8670 - protein, 486 aa, Zea mays
  misc_feature (127)..(127): Xaa can be any naturally occurring amino acid
MATQVLEDESETDDERLQRSGSPCMSRSQRSRSIELLEKHKDLLNLFNRMESSIRLLRLRKRMATFNNIATQVEILAKRKLSYCHLAQMKYLFPEAIQIKRVLLHDEKSLCMYADMEITLVMDVVEXQAPDHSPSMTFCEAFYSKLLTFLDAHHKGTDIPEAILPEPFNLRSRGQLNLEASHNGHAAEPHLQGTTKDGFSNASHFPQSFRKLMSQKVITDGAERTQLLLDPTKLSSVSAYDTEGTNRSPKKQDKHASVTVNSEISATPSRHLISRCQEGTPKQETLESPLLAQTPATQTPKRQLPTPLEKLEATCGHISEPRSASSARRSLNTSLKFEGGSPSYHDRMEHVATSKIGILSEDSSSFNKSSDAWGPVFFTDREKINLADPVGVQEKMASLRSTFGIVCDISHSIKNSLITKQELFHNILANNLEIEQMGEIEEQLHILEDLAPDWISKKVINGGEILYSFETIADQNSVWERLVEAV

SEQ ID NO: 8671 - protein, 567 aa, Zea mays
VLLKVYPRDYKRVLENMKLQKGVANHAKEPKMANGISVTTKKVQLDQSASRPTRVANAKKYRGFITYERESISYRDPKERVKDWKEVAIESTPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMIPRPPLQRTGRKVAIVGSGPAGLAAADQLNKMGHFVTVFERADRIGGLMMYGVPNMKTDKIGIVQRRVNLMAEEGVTFVVNANVGSDPLYSIERLRSENDAVILACGATKPRDLTIPGRELSGVHFAMEFLHANTKSLLDSNLEDGKYISARGKKVVVIGGGDTGTDCIGTSIRHGCTSLVNLELLTKPPSNRAADNPWPQWPRIFRVDYGHQEAATKFGKDPRSGEVLTKRFIGDENGKVKALELVRVKWEKVDGRFQLKEIQGSEEIIEADLVLLAMGFLGPEASIAEKLGLEKDNRSNFKAQFGDFATSVDGVFAAGDCRRGQSLVVWAITEGRQAAAAVDKYISRHDQNVAGDITPFGAGLVQPVGA

SEQ ID NO: 8672 - protein, 509 aa, Zea mays
  misc_feature (122)..(122): Xaa can be any naturally occurring amino acid
  misc_feature (169)..(169): Xaa can be any naturally occurring amino acid
  misc_feature (204)..(204): Xaa can be any naturally occurring amino acid
  misc_feature (216)..(216): Xaa can be any naturally occurring amino acid
  misc_feature (234)..(234): Xaa can be any naturally occurring amino acid
MATANGSSKGPFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGQGAXDFPGAAHLLRYYAGAADKVHGATLKMAQRMHGYTLKEPRGGVVGHHXVPWNYPTTMFFFKVGPAARRRLAPVVVKPAEQTPXLSALFYAHLARXEAGVPAGVLNVVPGFGPXTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 8673 - protein, 368 aa, Zea mays
  misc_feature (37)..(37): Xaa can be any naturally occurring amino acid
  misc_feature (66)..(66): Xaa can be any naturally occurring amino acid
  misc_feature (100)..(100): Xaa can be any naturally occurring amino acid
  misc_feature (163)..(163): Xaa can be any naturally occurring amino acid
  misc_feature (172)..(172): Xaa can be any naturally occurring amino acid
  misc_feature (292)..(292): Xaa can be any naturally occurring amino acid
MASEPVARAVAEEVGRWGSMKQTGVTLRYMMEFGSRXPTQRNLLLSAQFLHKELPIRFARRALELXSLPFGLSNKPAILKVRDWYMDSFRDIRYFPEVRXRNDELAFTQMINMVKVRHNNVVPTMALGVQQLKKELGRSRKVPFEFDEIDEFLDRFYMSRIGXIRMLIGQHXVALHDPKPEPGVIGLINTRLSPIQVAQAACEDARSVCLREYGSAPDINIYGDPNFTFPYVTLHLHLMLFELVKNSLRAVQERYMNSDKDVPPVRIIVADGEEDVTIKVSDEGGGIPRSGXLPRIFTYLYSTAKNPPELDRPNTEGVTMAGYGFGLPISRLYARYFGGDLQIISMEGYGTDAYLHLSRLGDSEEPLP

SEQ ID NO: 8674 - protein, 317 aa, Zea mays
MELRELGGTGLRVSAVGFGASPLGNVFGDVPRDTARAAVRRALDLGINFFDTSPYYGGTISESVLGDCLRHAAVPRDRVVVATKCGRYKDEGFDFSANRVTRSIDESLARLGLDYVDILHAHDIDFTHLEQIVNETIPALQKIKENGKARFIGITGLPLSIYPYVLDRVAPGSVDVILSYCHYGINDTSLVDLLPYLKSKGVGVISASPLSMGLLTDNGPPEWHPAPEELKSACKAAADHCRKKGKSITKLAMQYSLMNNEISTVLVGMNSLEQVEENVAAALELSTSGIDDELLREVEAILEPVKNLTWPSGIQQA

SEQ ID NO: 8675 - protein, 317 aa, Zea mays
MELRELGGTGLRVSTVGFGASPLGNVFGDVPRDTARAAVRRALDLGINFFDTSPYYGGTISESVLGDCLRHAAVPRDRVIVATKCGRYKDEGFDFSANRVTRSIDESLARLGLDYVDILHAHDIEFTHLEQIVNETIPALQKIKENGKARFIGITGLPLSIYPYVLDRVAPGSVDVILSYCHYGINDTSLVDLLPYLKSKGVGVISASPLSMGLLTDNGPPEWHPAPEELKSACKAAADHCRKKGKSITKLAMQYSLMNNEISTVLVGMNSLEQVEENVAAALELSTSGIDDELLREVEAILEPVKNLTWPSGIQQA

SEQ ID NO: 8676 - protein, 303 aa, Zea mays
MNTSPSRYRAMMGGWGGSDGYEGSKRTRMMMESNPYFAVNAGSPLDVSKRARMMEPGAPYFGAMGSSASGAGGGFYQPFNSNLAGAGSSTGIQSFPCVRLRGLPFDCNDIDVCKFFVGLDIVDCLLVNKNGRFTGEAFVVFPTAMQAEFALHRDRQNMGRRYVEVFRCKKHEYYCAIANEVNQGGYFEPEYRRSPPPPRPRKPSEDKGSMEYTEVLKLRGLPYSATTEDIIKFFLEYELAEENVHIAYRSDGKATGEAFVEFPTAEVAKTAMCKDKMTIGTRYVELFPSTPEEASRAKSRGRH

SEQ ID NO: 8677 - protein, 221 aa, Zea mays
SQASSCPPVYDYESEAVGAMADSAHRRGAEVASATFAWPSMRIHGADLRKRLARGRRRGGGGRGLFVFPLASRMTGARYPYLWMSAAHQQGWHVALDACALGTKDLDTLGLSLIRPDFIVCNFFKVFGENPSGFAGLFVKRSSGLAALERSVGSTAENGFYSEEPRAEETERLAKEEQDGEGRESVMEVECRGLDHADALGLIAIGNRLRCSSNWLVVALQ

SEQ ID NO: 8678 - protein, 182 aa, Zea mays
  misc_feature (161)..(161): Xaa can be any naturally occurring amino acid
MSEDPACSRRSRCDLGGDERWLSGPAGDDHFDRLPDALLLVIFNRIGDVKALGRCSLVSLRFHELVPLVDSVLVRVDCVIPDEPPPSTPFSPTASVRARGVFSQIARIVLGGIVKPIHALGQILSPANSASGFPASSDSSPSSSSSSSSCLPADVSHHSPXSEVLRSFKELRHLRIEAPGGR

SEQ ID NO: 8679 - protein, 451 aa, Zea mays
  misc_feature (345)..(346): Xaa can be any naturally occurring amino acid
  misc_feature (358)..(358): Xaa can be any naturally occurring amino acid
  misc_feature (397)..(398): Xaa can be any naturally occurring amino acid
MGSVPEEKAKLGFGGLVGDLREVYESGRTQGLEWRQSQLRGLVRLLEEKEEEIFDVLHEDLGKHRGEAFRDEVGVLKKSVVDKLQNLKNWAAPEKAHTPLVAFPATALVVPEPLGVVLVFSCWNLPIGLALEPLSGALAAGNAVVVKPSELAPATSAFLAANIPKYLDSKAVKVVEGGPEVGEKLMEHRWDKVLFTGSSRVGRLIMAQAAKHLTPVALELGSKCPCIVDWLDSDRDSQVAVNRIIGAKWSTCSGQACIAIDYLLVEEEFAPILIEMLKSTLERFFTKPEYMARILNEKQFQRLSGFLADRRVASSVVHGGHFNPKTLSMEPTLLLNPPLDSDIMXXEIFGPLLPIITXVKKIEDSIKFLRSKPRPLAIYAFTRNEKLKQRIIDETSXXSITFNDAIVQVRRAHSLLVRKLTNIWCAEHTDRSPRHFVPVWPGQHPVRWRGA

SEQ ID NO: 8680 - protein, 449 aa, Zea mays
  misc_feature (114)..(114): Xaa can be any naturally occurring amino acid
NPHPKTHGGDKHSKPPSSPFVSLMEPLPSATAAGVGAPGPGPGYPESTESSPRSRRGDSWDEPFPSSAAAAAGGGGRLRLMCSFGGRIVPRPTDKSLCYLGGETRIVAVDRHAXLADVHARLSRSLIDGRPFTLKYQLPNEDLDSLISVSTDEDLDNLVDEYDRIAATSSGSGSSRTSRIRLFLFPATPESSSSLGSLLDDSSKSENWFVDALNSAISGSLDGIPRGISTDSASVNCLLGLEDDSSVHSRSGVTNSAPAEDQRASQPKLPAGATAVAAAVGAGRHPHDVQSVSGPDSPMLDKNSSFGSTSSGPSLSNLPPIHVRPEDRPSDARIMQPTAGEDHFAEMGISEQQLPPYMQHQQQVPIPAMAGMSPSEASSRVFSDDDKSDHGGGGRKAQPLKQEVPAIVDPTNRAVYYNDRSPPADLKRDMPVGTEAASYRLPVSAPDAA

SEQ ID NO: 8681 - protein, 184 aa, Zea mays
  misc_feature (9)..(9): Xaa can be any naturally occurring amino acid
FTLKYQLPXEDLDSLISVSTDEDLDNLVDEYDRIAATSSGGGSSRTSRIRLFLFPAKPESSSSLGSLLDDSSKSENWFVDALNSAISGSLDGIPRGISTDSASVNCLLGLEDQRASQPKLPAGAAAAAVGAGRHPHDVQSVPDSPMLDKNSSFGSTSSAPSLSNLPPLRVRPEDRPSDARIMQP

SEQ ID NO: 8682 - protein, 353 aa, Zea mays
  misc_feature (167)..(167): Xaa can be any naturally occurring amino acid
  misc_feature (184)..(184): Xaa can be any naturally occurring amino acid
MASPSIPAALRHPHLPADGGLLFHSSGDPTARSSLSFRIGDMTMRRCQTGPGPVLAARSPGLGNVDNLHESSSLSRSWDLNRQIDDDRDVLIECRDVHKSFGEKQVLRGVSFKIRHGEAVGIIGPSGTGKSTILKVMAGLLAPDKGDVIICGKKRHGLVSDEDIEGXRIGLVFQSAALFPGLTXRENVGFLLYENSSLPEDRIGKLVTETLAAVGLKGVEDRMPSELSGGMKKRVALARSIIFDDTKDVVEPEVLLYDEPTAGLDPIASTVVEDLIRSVHMTGRDALGKPGKIASYVVVTHQHSTIRRAVDRLLFLHEGKVVWEGMTHEFTTSANPIVQQFASGSLDGPIKYF

SEQ ID NO: 8683 - protein, 283 aa, Zea mays
ALEKRFNQLQVDGVLLRSRFGKCIGMDGSDEFAMQVFDSLARKRGITKQVLTKDELKDFWDQLSDQGFDNRLRTFFDMVDKNADGRITAEEVKEIISLSASANKLSKLKERADEYTALIMEELDRDNLGYIELEDLEALLLQSPSQAAARSTTHSSKLSKALSMKLASTKGTGPFYHYWQEFMYFLEENWKRIWVMTLWLSICICLFIWKFIQYRNRAVFHIMGYCVTTAKGAAETLKFNMALVLFPVCRNTITWIRSKTKIGAVVPFNDNINFHKVIAAGVA

SEQ ID NO: 8684 - protein, 518 aa, Zea mays
MAPPRISFLELCLSFLCFVVFYYLHIRSKRKNPFVPLDWPLVGMLPALLGNLHHLHDWITSLLVASQLSFLFTGPPRSGMQFFVTADPANVRHVFTSNFANYPKGPEFEEIFDVLGGGIFNADGDSWRRQRAKAQLLMSSAPFRALVSRYSRAKVDTALLPLLSHMAATGEAFDLQDVFLRLTFDTTTTLVFGVDPGCLSVGLPEVPFARAMDDAMGVLLLRHVVPMTWWKLARRLRIGHERKMAEAWRTIDQFVADTIAKRRAEKARHGNEQVSADLLSSYINDDEDEEGGVDAFLRDTTINLMLAGRDTTGSALSWFFYLLTRNPRVVGKIRQELECVKSKSSGSGGGMASFDPDELSRLTYLHAALCESLRLYPPVPQELKEAAAADVLPCGHEVRAGDKILVSLYAMGRMEEVWGSDCREFRPERWIPELEDGRRVVQVRYVPSYKFMSFNSGPRTCLGKDMAFVQLKAAAAAVVSNFDVEAVPGHVVEPKLSIILHMKNGFMATVKRRRQTFA

SEQ ID NO: 8685 - protein, 181 aa, Zea mays
METYTTDDALTAMGFGKFQALVLVYAGTGWLADSMELMLLSFVGPLVRQQWNVSAQHESLLSSVVFTGMLLGACSWGYISDKYGRRTALLFSVTLTAGAGLTSALSPNYISLLALRFLVGVGVGGTHVFSSWFLEFVPTKNRGAWMLVFSAFWTIGTIFEASLAWVGLSRLSWRGLLAFTS

SEQ ID NO: 8686 - protein, 436 aa, Zea mays
MVFASGSAAGGPQVLTARFVRQVVQGRWFMVFACLLILSASGATYIFSIYSKVLKSTLGYDQRTLNTLSFFKDLGANVGVISGLINEVTPPWVVLAMGAAMNLAGYLMIYLAIDGRTARPPVWLMCIYICVGANSQSFANTGALVTCVKNFPESRGVVLGLLKGFVGLSGAIFTQLYLAIYGDDAKSLVLLIAWLPAAVTILFVHTVRIMPYPRASRRRGPSAAATSNDAFFCFLYISIALATYLLVMIVVQKQVNFSHAAFAVSAAALLLILFLPLAVVVKQEYKIQKELEESLREDPTVTVEKPATAASLQLVAAAAAAPEPAVAQSMTTGTEAKRSSCLGSCLRHMFSPPAQGEDYTILQALVSVDMLVLFLATICGVGGTLTAIDNMGQIGQSLGYPAKSINTFVSLISIWNYAGRVTAGFASEVFLARYKF

SEQ ID NO: 8687 - protein, 150 aa, Zea mays
MDVSGAGGKAKKGAAGRKAGGPTKKSVSRSSRAGLQFPVSRVGRYLKKGRYAQRVGTGAPVYLAAVLEYLAAEVLELAGNAARDNKKTRIIPRHVLLAIRNDEELGKLLAGVTIAHGGVLPNIHTVLLPKKVAEKAAKEPKKAAKSPKKA

SEQ ID NO: 8688 - protein, 381 aa, Zea mays
  misc_feature (246)..(246): Xaa can be any naturally occurring amino acid
MATLNPFELLGADDNDDPSLLIAAAAAAAQKAEAKKSAVAPAGKAAQPAATTKFPTRPAPPSQTVRDARGGGSSARGGFGRGERGRGRGGRGYGQNRGFSGDNGNEFQGGYGGGGYGDGAVTGGSEGERERDTRPPYRGGGRRGGYRNVEFGDDSERPPRRNYERHSGTGHGYEMKRDGAGRGNWGTATDELIAQDAEDSPKMEEAAPVAEKQGEQNDAPAADENKDNKDATANEEEEKEEDKLCXEMTLEEFEKIREEKRKALLALKAEERKVEVDKDLRSLQPLSNKKENDEVFIKLGSDKDKKKENAERDERAKKSVSINEFLKPAEGERYYGGRGRGRGRGDRGGFRGGYGGGYSRGPAAAAPSIEDQAQFPSLGGK

SEQ ID NO: 8689 - protein, 111 aa, Zea mays
MICVDTFRLQEQPPFDKKSFESYIEKYIKNLTAVVEPEKAYEFKKGVEGATKFLLSKVKDLQFFVGESMNDDASVVFAYYKDGATNPTFLYFSHGLKEIKCYACGDIRYPC

SEQ ID NO: 8690 - protein, 357 aa, Zea mays
MEGGAGASEKGTVLVTGASGFVGSWLVMKLLHAGYTVRATVRDPANVGKTKPLMDLPGAKERLSIWKADLAEEGSFHDAIRGCTGVFHVATPMDFLSKDPENEVIKPTVEGMISIMRACKEAGTVRRIVFTSSAGTVNLEERQRPVYDEESWTDVDFCRRVKMTGWMYFVSKTLAEKAALAYAAEHGLDLVTIIPTLVVGPFISASMPPSLITALALITGNAPHYSILKQVQLIHLDDLCDAEIFLFENPAAAGRYVCSSHDVTIHGLAAMLRDRYPEYDVPQRFPGIQDDLQPVRFSSKKLQDLGFTFRYKTLEDMFDAAIRTCQEKGLIPLATAAGGDGFASVRAPGETEATIGA

SEQ ID NO: 8691 - protein, 312 aa, Zea mays
MSSSSNSGKKPAPAGGRGGPTIRTLADINRGPAGFPGAGGGSSDDDEPQEYYTGGEKSGMLVQDPTRRNDVDAIFEQARQAGAIHGMPPFLGGESSSSRSFTGTGRLLTGETVPSAAPQEPVPIRIRHNIHLWNNGFTVDDGPLRYYDDPENEEFLESLKMSKCPKELVPTDGEHVDVSVIKRMEDYREPVRPQSAFQGVGRTLGGGPSPDESATPAPAPAAPAASRSAGIVVDDSQPFTSIQLRLADGTRMVARFNMHHTVGDIRSFIDASRPGTARPYQLQTGFPPKQLADPTQTVVQAGLANSVIMQKM

SEQ ID NO: 8692 - protein, 208 aa, Zea mays
ITIYFSLRDDKKKKKKKKKKKKKKKKKKKKSFFLSLAPCLLAICEPAGAICERRIDPHRRRTPRRRRPAFSSPASAVPLYPPGFRPNLCVRISRETVTAMAAAGGGSTDDGPILQAENLTSNGKAGYYRRTFLAIIGGGGAGIWGFTGLMGVGLHLLIMMGASIGLLAKSKVSVQAYFHSWTRISIEGVFGGPMAFLLVWTYPFSLTI

SEQ ID NO: 8693 - protein, 231 aa, Zea mays
  misc_feature (186)..(186): Xaa can be any naturally occurring amino acid
  misc_feature (213)..(213): Xaa can be any naturally occurring amino acid
MATVSLTPQAVFSTESGGALASATILRFPPNFVRQLSTKARRNCSNIGVAQIVAAAWSDCPAASAAAEVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSAXLVPAGGHIVTTTDCYPKTRIYMETELXPKRGISMTVIRPADMDAL

SEQ ID NO: 8694 - protein, 146 aa, Zea mays
  misc_feature (99)..(99): Xaa can be any naturally occurring amino acid
MASWDNLGELSNIAQLTGLDAVKLISLIVRAASTARLHKRNCRRFAQHLKLIGGLLEQLRVSELKKYPETREPLEQLEDALRRGYLLVNSCQDRSYLYXLAMGWNIVYQFRKAQSEIDNYLRLVPLITLVDNARIRVGNRLSSLSL

SEQ ID NO: 8695 - protein, 557 aa, Zea mays
MAAANGDACRSVGGVPRPTNPMVTPLLTDLYQFTMAYAYWKAGKHLDRAVFDLYFRKNPFGGEFTIFGGLEECIRFIANFKFTEEEIKFLRSVMPACEDDFFEYLRSIDCSDVEVYAIPEGYAVFPKVPLMRIEGPVAVVQLLETPFLSLVNYASLVTTNAARHRLVAGKSKNLLEFGLRRAQGPDGGISASRYCYMGGFDATSNVAAGRLFGIPIRGTHSHAFVSSFMGLDEITDKTLTSSDGSNTCEDFISLVQNWLIRIQDSSSLHGTFGETSQSELAAFTSYALAFPNSFLALVDTYDVMRSGVPNFCAVALALNDMGYKAVGIRLDSGDLAYLSVEARKFFHAVEKEFVVVGFGKTSITASNDLNEETIDALNKQGHEVDAFGIGTYLVTCYAQAALGCVFKLVEINKQPRIKLSEDVMKVSIPCKKKCYRLYGKEGYPLVDIMTGEDEPGPKIGERLLCRHPFNESKRAYVVPQHVEELLKCYWPGNSSNSREELPSIHEIRTRCIHHLDRMRPDHMRRLNPTPYKVSVSAKLYDFIHFLWLNEAPVGELQ

SEQ ID NO: 8696 - protein, 104 aa, Zea mays
LLKHICFPGLAFHPLDGILQAIPHVLALFLLPTHFRTHIALVFLEAVWTTNIHDCIHGKVWPVMGAGYHTIHHTTYRHNYGHYTVWMDWMFGTLREPDDILKKA

SEQ ID NO: 8697 - protein, 618 aa, Zea mays
MRPPSSGKKTEVSHNVEKCGVSDQACHGKCQSCGIDAKPFCAGVNEVSLLTGSHTDVEASKENRGACSFNNDRADALEEEANVSTARIGHVESADPGGSVGVEKEIFMAVNEESEGEQAGATLEDLFFFNGEEDDDSDWEPASRLVVNRWFCLNCTMPNVDKITYCMNCRELPGSVVDGYDVFKKQIAQTALLSADTGLLPVSTAIGFDERMLLHSELEVKPNPHPERPDRLRAIAASLAAAGIFPSKCALVPPREITKEELLMVHSPDHIESVEQTKNMLYSYFTSDTYANGHSACAAKLAAGLCADLASLIVSGRVRNGFALVRPPGHHAGVKQAMGFCLHNNAAVAALAAKRAGAKKVLIVDWDVHHGNGTQEIFDGDKTVLYISLHRHEDGNFYPGTGAAHEVGVLDGQGFSVNIPWSRGGVGDDDYIFAFQTVVLPIASEFAADITIISAGFDAARGDPLGCCDVTPTGYSWMTSLLAGSSNGRLLVILEGGYNLRSISSSATEVVKVLLGEGPNRASFVVSPSKEALRTVSQVLKIQQQFWPVLGPTYASLQAQQGSVSSNHSNELKKRKRSGGGPGPFWWKMGSKRLLYEALIEPRSRPRKLKGSTGSAAP

SEQ ID NO: 8698 - protein, 453 aa, Zea mays
PCNCRELPGSVVDGYDVFKKQIAQTALLSADTGLLPVSTAIGFDERMLLHSELEVKPNPHPERPDRLRAIAASLAAAGIFPSKCALVPPREITKEELLMVHSPDHIESVEQTKNMLYSYFTSDTYANGHSACAAKLAAGLCADLASLIVSGRVRNGFALVRPPGHHAGVKQAMGFCLHNNAAVAALAAKRAGAKKVLIVDWDVHHGNGTQEIFDGDKTVLYISLHRHEDGNFYPGTGAAHEVGVLDGQGFSVNIPWSRGGVGDDDYIFAFQTVVLPIASEFAADITIISAGFDAARGDPLGCCDVTPTGYSWMTSLLAGSSNGRLLVILEGGYNLRSISSSATEVVKVLLGEGPNRASFVVSPSKEALSTVSQVLKIQQQFWPVLGPTYASLQAQQGSVSSNHSNELKKRKRPGGGPGPFWWKMGSKRLLYEALIEPRSRPRKLKGSTGSAAP

SEQ ID NO: 8699 - protein, 180 aa, Zea mays
MASSMLSSAAVGTSPAQATMVAPFTGLKSSAAFPVTRKANNDITSITSNGGRVSCMQVWPPIGKKKFETLSYLPDLTDAELAKEVDYLLRNKWIPCVEFELEHGFVYREHGNSPGYCDGRYWTMWKLPLFGCTDSAQVLKEVEECKKEYPNAFIRIIGFDNTRQVQCISFVAYKPPSFTG

SEQ ID NO: 8700 - protein, 559 aa, Zea mays
MGSSGFSWTLPDHPKLPKGKSVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 8701 - protein, 418 aa, Zea mays
  misc_feature (196)..(196): Xaa can be any naturally occurring amino acid
FFWGSIQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPXIDRTSGEYLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 8702 - protein, 220 aa, Zea mays
KPFPLVLVLVHHFRPAPSSALRLPRRTASAWLPRFPSCSTSAPPPFAAVASMDAPPQGYRTNVGICLADPSLTKIFSASRIDIPSAWQMPQGGIDAGEEPRAAAFRELREETGVTSAEIVAEAPVWLTYDFPTVVRTKLNARWGTDWKGQAQKWFLFRLTGNDDEINLNGDGSEKPEFGEWTWMTPQEVIEKAVDFKKPVYEEALKHFAPYLQSDPAASS

SEQ ID NO: 8703 - protein, 160 aa, Zea mays
MDAGAKVVKKAAAGRRGGGGPKKKPVSRSVKAGLQFPVGRIGRYLKQGRYSQRVGTGAPVYLAAVLEYLAAELLELAGNAARDNKKNRIIPRHVLLAIRNDEELGKLLAGVTIAHGGVLPNINPVLLPKKTAVAAAKEGKEKKSPKKAAAAKSPKKVAAS

SEQ ID NO: 8704 - protein, 172 aa, Zea mays
ARKEGESRGLDRRGCRSKVVKKAAAGRRGGGGPKKKPVSRSLEAGLQFPVGRIGRYLKQGRYSQRVGTGAPVYLAAVLEYLAAELLELAGNAARDNKKNRTIPRHVLLAIRNDEELGKLLAGVTIAHGGVLPNINPVLLPKKTAVAAAKEGKEKKSPKKAAAAKSPKKVAAS

SEQ ID NO: 8705 - protein, 615 aa, Zea mays
  misc_feature (191)..(191): Xaa can be any naturally occurring amino acid
MASISGAAAPPSSAVCRLRLRRHLLLRPSHLRLRAPHSIADLSRSSNSAPNPARPALGSGPENGSGGVRAVEKDPIKLWERYVEWLYQHKELGIFVDVSRMGFTEEFLRQMEPRMQQAFVDMRELEKGAIANPDEGRMVGHYWLRDPALAPNSFLRNKIETALDRILAFSQDVVSGKILSPSGRSLQSLYXIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVNQGLSVYGNKGSTDQHAYIQQLREGVHNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAICENPTEPLTLDEIADRCHCPEDIEMIYKIIQHMAANDRALIAEGSCGSPRSVKVYLGECSVDEDMQAA

SEQ ID NO: 8706 - protein, 241 aa, Zea mays
MAANLEDVPSLDLMHELLRRMKCSSKPDKHLILIGPPGSGKGTQSPLIKDEYCLCHLATGDMLRAAVAAKTTLGIKAKEAMGKGELVSDNLVVGIIDEAMKKPSCQKGFILDGFPRTVTQAQKLDEMLVKQGANVDKVLNFAIDDAILEERITGRWIHPPSGRTYHTKFAPPKSPGVDDVTGEPLIQRRDDTAEVLKSRLEAFHRQTEPVIDYYSKKGLVVNLPAEKPPKEVTAEVQKALS

SEQ ID NO: 8707 - protein, 229 aa, Zea mays
MAANLEDVPSLDLMHELLRRMKCSSKPDKHLILIGPPGSGKGTQSPLIKDEYCLCHLATGDMLRAAVAAKTTLGIKAKEAMGKGELVSDNLVVGIIDEAMKKPSCQKGFILDGFPRTVTQAQKLDEMLVKQGANVDKVLNFAIDDAILEERITGRWIHPASGRTYHTKFAPPKSPGVDDVTGEPLIQRRDDTAEVLKSRLEAFHRQTEPVIDYYSKKGLVVNLPAEKPQ

SEQ ID NO: 8708 - protein, 226 aa, Zea mays
SHARVRKLGIRLELEPVATNMLESMIDHPTPTRAEVSDIAIAVREGADAIMLSGETAHGKYPLKAVKVMHTVALRTESSLYNPTTSPSLVASAQGLQNEDFSASQLSKMFGSHATMMANTLRTPIIVFTQTGSMAVLLSHYRPSSTLFAFTNEERVKQRLALYQGVIPIHMQFSDDAEETFSRAISSLLKAQYVKKGDYVTLVQSGVTSIWREESTHHIQVRKVQV

SEQ ID NO: 8709 - protein, 120 aa, Zea mays
GTVKCEVVDGGELKSRRHLNVRGKSATLPSITEKDWEDIKFGVENGVDFYAVSFVKDAKVIHELKDYLKGVNADIHVIPKIESADSIPNLQSIIAASDGAMVARGDLGAELPIEDVPLLQ

SEQ ID NO: 8710 - protein, 92 aa, Zea mays
ACLQSIIAASDGAMVARGDLGAELPIEDVPLLQAEIVQTCRSMEKPVIVATNMLESMIDHPTPTRAEVSDIAIAVREGADAIMLSGETAHGK

SEQ ID NO: 8711 - protein, 123 aa, Zea mays
RNRVAAEKIQEAINGGYKRIAVLYGGGHMPDLGRRLREELDMVPADVQWVTAWSIRSREIDSESLPLLKTLAEASGWPLNRYETLALLIFSSVLAVDLWFWELFFGTAVNCASLAGSWIGQLA

SEQ ID NO: 8712 - protein, 523 aa, Zea mays
MAGGGVAALGVKTERAAQYKGRMTLAVATTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNMMFQLATTLGIFTANLINYGTQNIKPWGWRLSLGLAAVPALLMTLGGLFLPETPNSLIERGRVEEGRRVLERIRGTADVDAEFTDMVEASELANTVEHPFRNILQPRNRPQLVMAVCMPAFQILTGINSILFYAPVLFQSMGFGGNASLYSSVLTGAVLFSSTLISIGIVDRLGRRKLLISGGIQMIVCQVIVAVILGVKFGAEKQLARSYSVAVVVVICLFVLAFGWSWGPLGWTVPSEIFPLETRSAGQSITVAVNLLFTFAIAQAFLSLLCAFKFGIFLFFAGWITVMTVFVYVFLPETKGVPIEEMVLLWRKHWFWKKVMPDMPLEDGWGAAEGHAAPANNNHKG

SEQ ID NO: 8713 - protein, 100 aa, Zea mays
  misc_feature (53)..(53): Xaa can be any naturally occurring amino acid
ACSSGAGFPGGISVLFSASGEACNDIMAYSLILSCCCYTCCVRRKLRQKLDIXGGCCDDFLSHLLCCCCALVQEWREVEIRGAYSEKTKVTPPACQYMEH

SEQ ID NO: 8714 - protein, 290 aa, Zea mays
MGKDDVIESGAGGGEFAAKDYTDPPPAPLIDAAELGSWSLYRAVIAEFIATLLFLYITVATVIGYKHQTDASASGADAACGGVGVLGIAWVFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 8715 - protein, 260 aa, Zea mays
  misc_feature (30)..(30): Xaa can be any naturally occurring amino acid
RNTWAGRALPWDEDINFHKTIAAAYKLLEXIFHAGNHLVCDFPRLYNSSNEKYAPLGQYFGETKPTYFTLVTGVEGITGVIMGIWMIIAFTLATPWFRRSLVKLPKPFDKLTGFNAFWYSHHLFIIVYLALIVHGQFLYLIHVWYRKTTWMYLAVPVCLYVGERVLRFFRSGSYSVRLLKVAIYPGNVLTLQMSKPPAFRYKSGQYMFVQCPAVSPFEWHPFSITSAPGDDYLSIHVRQLGDWTRELKRVFAAACEPPVG

SEQ ID NO: 8716 - protein, 427 aa, Zea mays
MDDAGRAPPPAPAAVTVSATAAPAPTPPSATVAADKSSLDPDALYEEGMWQQMAMNSGATMQPGSYPERPGEPDCTYYLRTGLCRFGMSCRFNHPPDRNLAIASARMKGEYPERVGQPECQYYLKTGTCKFGPTCKFHHPREKAGIAGRVQLNTLGYPLLPNEKECAYYLKTGQCKYANTCKFHHPELFNVVPSSRGSPIYTSVHSSASAGPQSYTGTMSSWTFPRASFIPSPRWQSPSNYAPMVVPHGLVQVPSWNSYPGQLQSPGAQQTYGSSQQGEASAGNQGMLSPYRSSSFPVPQYALQRDNVFPERPDEPECQYYMKTGDCKFGAVCKFHHPRVRSQPPPDCVLSPMGLPIRPGEELCKFYSRYGICKFGANCKFDHPTMAAPMGVYAYGFSGSASVAPASTNAPMTRHLLGSPSGSGYMS

SEQ ID NO: 8717 - protein, 180 aa, Zea mays
MRGAEEERSGTATDAGGEEEKQERSVGLMAGLMDKAKGFVVEKVMQIPKPEAALDHVSFRSISREGVELHSHVDISNPYSHRIPICEITYTFKSAGKVIASGTMPDPGWIAASGSTKLDLPVKVPYDFIVSLMKDLGGDWDIDYMMEVGLTVDLPAIGAFTIPLTTEGEIKLPTFRDLLF

SEQ ID NO: 8718 - protein, 180 aa, Zea mays
MRGAEEERSGAATDAGGEEEKRERSVGLMAGLMDKAKGFVVEKVTQIPKPEAALDHVSFQSISREGVELHSHVDISNPYSHRIPICEITYTFKSAGKVIASGTMPDPGWIAASGSTKLDLPVKVPYDFIVSLMKDLGGDWDIDYMLEVGLTVDLPAIGAFTIPLTTEGEIKLPTFRDLLF

SEQ ID NO: 8719 - protein, 421 aa, Zea mays
  misc_feature (74)..(74): Xaa can be any naturally occurring amino acid
MALPGPAATRAAVRLCRIAASASSYLPSAAADGRRELELPFALVAERGMVVGGHRGMGMNAVGAAARGALRGRXERENTLLSFGRAAAHAAVAFVEFDVQVTKDGCPIIFHDDFILTQGTGAVYERRVTDLLLEDFLSYGPQKESCKVSKPLLRRAGDGRVLNWTTEDDDSLCTLQEAFQRVSPRLGFNIELKFDDSIMYHRKDLQCALKAVLQVVFEHARNRPVFFSSFHPDAAQMMRELQSLYPVLFLTEGGTSKHHDPRRNSFDDAVRVCLEYDLHGIVSEARGVLKNPSAVARAQESNLALLTYGQLNNVWEAVYIQYLMGVHGVIVDRVEEISDAVAGFGLGKPGLGRGGAGVDGAKTHQAEAFSQQQLGFLLRLIPELIEQRHRKDGTPYVTSQFLTLEADGKNSSLGSTLVPTD

SEQ ID NO: 8720 - protein, 370 aa, Zea mays
  misc_feature (14)..(14): Xaa can be any naturally occurring amino acid
LLSVEALHQLHIFXIFILAIAHVISCVLTMLLESVRIRQWKHWEDEIQKGATDNGPRKVTYVHQSEFIREHSKGIGRDTTMLSWLHSFLKQFYGSVTKSDYTTMRLGFITTHCRSNPKFDFHRYMMRALEADFKKVVGISWYLWIFVVVFMLLNINGWHTYFWISFIPLLLLLAVGTKLEHVITQLAQEVAEKHSAVEGDLVVNPSDDHFWFGRPKIVLYLIHFILFQNAFEIAFFFWILTTYGFNSCIMDHVPFIVPRLVVGAIIQLLCSYSTLPLYAIVTQMGTFFKKEIFDEHVQQSLLGWAQKAKKRKALRNNGNGSNGAAAGSSHPSATARLELMRRAVALEEGSAGGNGSEASAAELHDTGPKL

SEQ ID NO: 8721 - protein, 140 aa, Zea mays
EKSTVRRGKRERPGEESLQPPCIPTSGSRVSRPPSGSLRCSARSASTPPRHPITIGFGYDDIEPEDDLHSDFPCPYCYEDHDVASLCAHLEDEHPFESKIVSCPVCSARISKDLVDHITLQHGYLFKISFLDDYIFLDMF

SEQ ID NO: 8722 - protein, 539 aa, Zea mays
PFFLFIELALVLCFITLYYRHLQSKKTSPLEPTEWPVVGHLPGLVANIHRFHDWATGVLAGVGCNFEARGGRTGLRYFITCDPSNVRHIFTSNFANYPKGEEYAAIFDVLGGGIFNADGESWRRQRVKAQMLMTGPRFRAFTARCSRDKVERSLLPFLAHHAAADDEGRPTPCDLHDVFLRLTFDMTCTLVFGVDPGCLALGLPGVPFARAMDDALETLFLRHITPTACWKLMSVLGVGQEKKMAAARRTIDCFVATTVAKRRADMLREGEGEGVCSSFDLLSSFICHEDDSSENDDDDDVFLRDTTVNLLLAGRDTTGAALSWFFYLVSKNPRVEQKLLDELAPIVASRRRAGGAAADAASGMVTFDADELGSGLVYLHAALSECLRLYPSVPFEHKVAAAADVLPSGKELKAGDKVLVFNYSMGRMEGVWGKDCMEFRPERWLNVEGTKLRYEPSYKFISFNAGPRTCLGKEMAFVQMKTVAAAVLWNFAVEVVPGHVVEPKLSIILHMKNGLAVKVTRRDDGTAPSSSCVRHTACF

SEQ ID NO: 8723 - protein, 96 aa, Zea mays
MVCAKCEKKLGKVIVPDKWKEGASNTNESGGRKINENKLLSKKNRWTPYGNTKCIICKQQVHQDAKYCHTCAYSKGVCAMCGKQVLDTKLYKQSNV

SEQ ID NO: 8724 - protein, 246 aa, Zea mays
  misc_feature (230)..(230): Xaa can be any naturally occurring amino acid
  misc_feature (238)..(238): Xaa can be any naturally occurring amino acid
MATAGKVIKCRAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASGIIGVDINPXKYEQAKKXGCTEFVNP

SEQ ID NO: 8725 - protein, 354 aa, Zea mays
  misc_feature (284)..(284): Xaa can be any naturally occurring amino acid
  misc_feature (304)..(304): Xaa can be any naturally occurring amino acid
AGPPPPPPPPPPPPPPPPVGYWESRVRKPDTSKETRSPALSPPPQAANFRSVPAPTDAFPSRPPESSDQGDKSEDTTPRPKLKPLHWDKVRASSDRVMVWDQLKSSSFQVNEEMIETLFICNPANAPAKEATRRPVLPTPKAENKVLDPKKAQNIAILLRALNVTKEEVSDALCEGNTENFGADLLETLLKMAPTKEEEIKLREFKEESSPVKLNPAEKFLKAVLDVPFAFKRVDAMLYIANFDAEVNYLKKSFETLEAACDELRSTRLFLKLLETVLKTGNRXNVGPYPGDAHAFKLDTFVEXLLEVKGTDGHTTLLHFVVQEMIRTEGARVSASTQTTSRTQANPLRKELEC

SEQ ID NO: 8726 - protein, 329 aa, Zea mays
MRMRAVVITCAGGPEVLEAREVEDHPALGEGEVLLEVAAAGVNRADTVQRMGRYPPPAGASPYPGLECSGTILALGPNVPSRWAVGDKVCALLSGGGYADKVVAPAGQLLPIPEGVSLTHAAGLPEVACTVWSTVFMTSHLSPGESFLIHGGSSGIGTFAIQIAKHLGIKVFVTAGSEEKLAACKALGADVCINYRTEDFVERIKQETNGKGVDVILDNIGGSYLQRNLNSLGVDGRLFIIGFQGGIAAEVNLQAVLARRLTIQAAGLRNRSLANKAEIVSEVEKNVWPAVAAGKVKPVIYKTFPLCEAAEAHRLMEASTHIGKILLLP

SEQ ID NO: 8727 - protein, 210 aa, Zea mays
  misc_feature (58)..(58): Xaa can be any naturally occurring amino acid
AINGGATSRWRCVEACYNYGFLPADRGRHQPPPAPHATLPHAAEDAGELWEYFPCPFXICNHLQEEHCFDTRNAVCPICANNLGKDMAAHFRLQHTHLLKRRKPYRPSSCPAAATSPATYQVNSYYEEAEPQQHYSRPYKDPAPDPLLSQFICSVDAIPGDANAQKDDQRLKLNNKGATASDDDASSKLGLEERLQRIDFLTEILMSPIL

SEQ ID NO: 8728 - protein, 249 aa, Zea mays
MGFLEDFQASVEALPSMLHRNYSLMRELDKSLHGVQLENEQRCQQEIEDIKHGLESGSITYDPAKLKFSEEAMEEQKHCVRIADEKVALATQTYDLVDAHIQQLDQFMRKLEEIRQGKEAAAAVTAGTAVATTATPTVNAGATTADANPKSGRSGERGRGGRKKAKVPTEQSVPVPVPLPPIDLELPVDPNEPTYCLCNQVSYGEMVACDNPNCKIEWYHYGCVGVKEQPKGKWYCPNCIGFQKKRKGK

SEQ ID NO: 8729 - protein, 149 aa, Zea mays
GYLEAGRVDIESSHGDMFTEEQNELVESAAEMLYGLIHARYILTSKGLAAMLEKYRNYDFGRCPRVYCCGQPCLPVGQSDIHRSSTVKIYCPKCEDIYYPRSKYQGNIDGAYFGTTFPHLFLMTYEHLKLQKPLQRYVPRVFGFKLHKP

SEQ ID NO: 8730 - protein, 419 aa, Zea mays
  misc_feature (164)..(164): Xaa can be any naturally occurring amino acid
MDDAGRPPPHAPVAVTASASASATAAPAPPQPSATAAVDRSSPDPDALYEEGMWQQMAMDSGATMQPGSYPERPGEPDCTYYLRTGLCRFGMSCRFNHPPDRNLAIASARMKGEYPERAGQPECQYYLKTGTCKFGPTCKFHHPREKAGIAGRVQLNTSGYPLXPGHCKYANTCKFHHPELFNVVPSSRGSPIYTSVHSSASAGPQSYTGTMPSWAFPRASFIPSPRWQSPSNYAPMIVPQGLVQMPSWNSYTGQLQSPGAQQTYGSSQQGEASTGNQGMLSPYRSSSFPVPQYALQRENVFPERPDEPECQYYMKTGDCKFGAVCKFHHPRVRSLPPPDCVLSPMGLPLRPGEELCKFYSRYGICKFGANCKFDHPTVVAPMVYAYGFSASASPASASTNVPMARRLLGSPPGSGYTS

SEQ ID NO: 8731 - protein, 340 aa, Zea mays
PRPPSACVLEALPYHTIPYHIYLSIYLLILELWTYFLTPSGTGKTTLSTDHNRLLIGDDEHCWSENGVSNIEGGCYAKCIDLSQEKEPDIWNAIKFGAVLENVVFDEHTREVDYADKSVTENTRAAYPIEYIPNAKIPCVGPHPKNVILLACDAFGVLPPVSKLDLAQTMYHFISGYTALVAGTEDGIKEPQATFSACFGAAFIMLHPTKYAAMLAEKMQKYGATGWLVNTGWSGGRYGVGKRIRLPYTRKIIDAIHSGELLTANYQKTEVFGLEIPTEIKGVPSEILDPINTWTDKAAYKETLLRLAGLFKKNFEVFASYKIGDDSNLTDEILAAGPNF

SEQ ID NO: 8732 - protein, 302 aa, Zea mays
MEPGSTPPNGSAPATPGTPAPLFSSGGPRVDSLSYERKSMPRCKCLPLPAVEGWGVATHTCVVEIPAPDVSLTRKLGAEFVGTFILIFFATAAPIVNQTSGGCKFRHQHPASPALAVATVILSTGHISGAHLNPSLTIAFAALRHFPWLQVPAYVAVQALASVCAAFALKGVFHPFLSGGVTVPDATVSTAQAFFTEFIISFNLLFVVTAVATDTRAVGELAGIAVGAAVTLNILVAGPTTGGSMNPVRTLGPAVAAGNYRQLWIYLLAPTLGALAGASVYTAVKLRDENGETPRTQRSFRR

SEQ ID NO: 8733 - protein, 250 aa, Zea mays
MGRKFFVGGNWKCNGTTDQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 8734 - protein, 315 aa, Zea mays
MGSGNLIVKKVVKHSSFDLDIQLDKSWMEDVTCPICLDYPHNAVLLRCTSYEKGCRPFVCDTDQTRSNCLERFKSAYELPSNAKVSSFAMPPLDSIIHIVPSNANNRPSCPLCRGDVIGWIVIGEARQHLNQKKRCCEEDCCSFVGNFNELQKHTQQKHPDSRPSEIDPARQVDWENFQQSSDIVDVLSTIHAQVPNGIVLGDYVIEYGDDDNGEDYEVFRGVRTHWWSCIFCKAFSRSSRSRRRARERRGGGRRIGNQANLENFNIEVPAQSVELREIRFDEIDDEYIVTGAIPSMATPGRMASFHYRDTRYGR

SEQ ID NO: 8735 - protein, 157 aa, Zea mays
MDASGAGSKAKKGAAGRKAGGPRKKSVSRSVKAGLQFPVGRIGRYLKKGRYAQRVGTGAPVYLAAVLEYLAAEVLELAGNAAKDNKKTRIVPRHLLLAIRNDVELGKLLSGVTIAHGGVLPNINPVLLPKKVAEKASSGGSKESKSPKKAAKSPKKA

SEQ ID NO: 8736 - protein, 150 aa, Zea mays
MAMGSLAFATALVFVFVFAIAVPAVAAAAQAPAPAPTSDGTSIDPFYRGCGVNAHAVQAELIGIPRLWSVCAPPAAAAMAMGSLAFATALVFVFAIAVPAVAAAAQAPAPAPTSDGTSIDQGIAYLLMIMALVLTYLIHPLDASAPYKLF

SEQ ID NO: 8737 - protein, 213 aa, Zea mays
MSKMAEEKAAAVGGLGGAGAADAAQQQQLAAGEAAAARVRPVETLLRAAPLGLCVAAMTVMLRNQQSNEYGAVAYSDLGGFKYLVYANGLCAAYSLVSAFYTAVPRPATVSRSWLVFLLDQVFTYLILAAGAAAAELLYLAYNGDKEVTWSEACGVFGSFCRQARTSVAITFGTVLCFILLSLISSYRLFSAYEAPPSSALGSKGVEIAAYPR

SEQ ID NO: 8738 - protein, 190 aa, Zea mays
DGRENLAVCRVGKYLVFCLERKSRRQYKDVQDGGGEGGAGAVRGDAASGTRLLPGEKKQKTIQRCPRWRRRVRPVETLLRAAPLGLCVAAMTVMLRNQQSNEYGAVAYTDLGGFKYLVYANGLCACYSLVSAFYTAVPRPATVSRSLIVFLLDQVFTYLILAAGATAAELLYLAYNGDKEGTWSEALRVF

SEQ ID NO: 8739 - protein, 155 aa, Zea mays
  misc_feature (105)..(105): Xaa can be any naturally occurring amino acid
  misc_feature (129)..(129): Xaa can be any naturally occurring amino acid
MGRKFFVGGNWKCNGTTDQVEKIVKTLNEGQVPPSDVVEVVVSPPYVFLPVGKSQLRQEFHGAAQNCWVKKGGAFTGEVSAEMLVNLGVPWVILGHSERRALAGXESNEFGGDKGAYALSQGLKCIAWXGETLEPEGRRGLSMGGWVLHKQKAIG

SEQ ID NO: 8740 - protein, 74 aa, Zea mays
  misc_feature (37)..(37): Xaa can be any naturally occurring amino acid
MIEVVLNDRLGKKVRVKCNEDDTIGDLKKLVAAQTGXTRPEKIRIQKWYNIYKDHITLKDYEVHDGMGLELYYN

SEQ ID NO: 8741 - protein, 1024 aa, Zea mays
  misc_feature (47)..(47): Xaa can be any naturally occurring amino acid
  misc_feature (64)..(64): Xaa can be any naturally occurring amino acid
  misc_feature (133)..(133): Xaa can be any naturally occurring amino acid
  misc_feature (165)..(165): Xaa can be any naturally occurring amino acid
  misc_feature (203)..(203): Xaa can be any naturally occurring amino acid
  misc_feature (231)..(231): Xaa can be any naturally occurring amino acid
  misc_feature (249)..(249): Xaa can be any naturally occurring amino acid
SWPTAHNIDEASAIAIGKPPPYDALLYLQSAASDWKAIEFEFPKIFXLFGSEHILVLSSEKEGXHIGTLKDAAHEAVDVDIVLHVKTKNSDGADLMDDIVHAARNQSKSDKPVVGHIAKAAPEGKLLDTWITXLPMKPALVKWDSLKALAPGCRRVCRSVFYVIXIISSSLVHLNEMCQLNFGSRIIGETKFKSIDLLMPSLXNISLVRWISGLYNIYARLHFIHGICIPXIRQHGGCFLHVDALSNIXYESARIIKKAKGSKYSSYCSNVARTYLIDATPTQNKAYETLRKAHEAAIQQVKPGNQMSAVYQAAVAVIERDAPELLPNLTKSAGTGIGLEFRESGLNLNAKNDRRIKKGMVFNVSLGLHNIQAETTSEKTKQFSLLLADTVLVNERGHEILTAPCSKAFKDVAYSFNEDDDAVAAEVKIKSKTIDVMPTKATLRSDNQEMSKEELRRQHQAELARQKNEETARRLAGVGTGSGDGRGPAPPPPQLVAYKNVNDVPFVRDLVIQVDQKNEAVLLPIYGSMVPFHVSTVKSVTSHQDNRTCTIRIFFNVPGMPFSNDSKFNSQGAIYLKEITFRSKDPRHSSEVVQQIKTLRRQVASRESERAERATLVTQEKLQIGSNRMKMMRLSDVWIRPAFGGRGRKLTGNLEAHFNGFRYSTSRSDERVDIMFGNIKHAFFQPAEKEMITLLHFHLHNHIMVGNKKTKDVQFYVEVMDVVQTLGGSRRSALDPDEIEEEQRERDRKNRINMDFQNFVNKVNDHWSQPQFKGLDLEFDVPLRELGFHGVPYKASAFIIPTSTCLVELIETPFLVVSLSEIEIVNLERVGFGTKNFDMAIVFKDFKKDVLRIDSIPSASLDAIKEWLDTTDLKYYESRLNLNWRPILKTIIDDPQKFIDDGGWEFLNMEASDSETEDTEESDQGYVPSDAEPESESEDDDSDSESLVESDDDDEESDEDSEEEKGKTWEELEREASNADREHGAESDSEEERRRRKAKTFGKSRAPERSSFKGAPPSKKPKFR

SEQ ID NO: 8742 - protein, 150 aa, Zea mays
  misc_feature (142)..(142): Xaa can be any naturally occurring amino acid
AASKLPLYAFKLTPAKGSQEDAASTKLLVDILLSEWEDRMTRGLFRYDVTACETKVIPGNLGFVAQLNEGRHLKKRPTEFRVDRVLQPFDPAKFNFTKVGQEEVLFQFENSGGDDSYFPEHAPIIAVDRAPNVIAINVSPIXYGHVLLIP

SEQ ID NO: 8743 - protein, 168 aa, Zea mays
  misc_feature (102)..(102): Xaa can be any naturally occurring amino acid
MALRHLVTGQNNCAPDGASSSNPLNALANAFLGQSSKAQSIKELPGSVSVPSTSGFSAPAPLSNIPGSENEFKQDQRPFVQGSDFIHGGPANDWIKSFRPPXVPELGGIEAHFPDFEQIYNNAGTTFQPPLDGPPQRVLSGVLHSFLTSGPAGVPFQPLPVPAALGLS

SEQ ID NO: 8744 - protein, 151 aa, Zea mays
  misc_feature (24)..(24): Xaa can be any naturally occurring amino acid
  misc_feature (40)..(40): Xaa can be any naturally occurring amino acid
PCSDDISPLLSILQLSQGADKWVXEFSSQHNQGALNDSWXDEFSKLNVTDEWAEEFSGGGFGESSADPWVDEFQEHLSSFKQSSGASRGVYVYSENNPYVGHPNPMQEGQELFRKGLLSEAVLALEAEVLKNPDNAEGWRLLGITHAENDD

SEQ ID NO: 8745 - protein, 168 aa, Zea mays
MAALPLATAEACDANAALIMNGDLRSLQPIFQIYGGRQIFAGPVVTLKIFEDNVLLREFLEEKGHGRVLVVDAGGSMRCAVLGGNLAQLMQNNGWAGIVVNGCIRDVDEINGCDVGVRALNSHPMKSNKKGVGEKHVPVTFAGTRICDGEWLYADSDGILISRSELSV

SEQ ID NO: 8746 - protein, 135 aa, Zea mays
AKSVRRRLQWCHSKLDLLLSRPNNCNKLRQGLSIYTSCSTVRCSFLLNLQVIVTQIGCMGTILAAKKDESVFSDPTYNVSVLFGKRDEPLLLACARQLIEHISGSAPARALVISLGLKDHSQGTLKDITVAVMIE

SEQ ID NO: 8747 - protein, 139 aa, Zea mays
MSTLSLGATSLATKLARMTWLSTLGFEVESGANTSAREGGIATTFRLQEQPAFHKKSLVSYIKKYIKNLTAVLEPEKADEFKKGVEGATKFLLSKLKDLQFFVGESMKDEASVVFAYYKDGATNPTFLYFSHGLKEIKC

SEQ ID NO: 8748 - protein, 213 aa, Zea mays
MAGAGAKAAGTLALALVLALAGANSEGDALSALRRSLRDPGGVLQSWDPTLVNPCTWFHVTCDRDNRVTRLDLGNLNLSGHLVPELGKLEHLQYLELYKNNIQGTIPSELGNLKNLISFDLYKNNISGTIPPALGKLKSPVFLRFNGNHLTGPIPRELAGISSLKVVDVSSNDLCGAIPPSGPFEHIPLSNFEKNPRLEGPELQGLAIYDTNC

SEQ ID NO: 8749 - protein, 184 aa, Zea mays
  misc_feature (159)..(159): Xaa can be any naturally occurring amino acid
MASTIKAASTSSRWSSSPAAVHSSPLSKRRRAVAAVAPAAPAAPAKLTAGAGGRCLPVSQTMSRLRAQGKTAFIPYITAGDPDLATTAEALRLLDACGADVIELGVPFSDPYADGPVIQASAARALASGTTPDGVLAMLKEVTPELSCPVVLFSYFNPXVRWGLADFAAAVKEAGVHGLIVPDL

SEQ ID NO: 8750 - protein, 252 aa, Zea mays
  misc_feature (169)..(169): Xaa can be any naturally occurring amino acid
SSSFQLLTAALWHLDLHRRRRSDPSPPLTPGVGCETLDPGALPVLGLIGLRNKGLPRRTASAWLPRFPSCSTSAPPPFAAVASMDAPPQGYRTNVGICLADPSLTKIFSASRIDIPSAWQMPQGGIDAGEEPRAAAFRELREETGVTSAAIVAEAPVWLTYDFPPDVRXKLNARWGTDWKGQAQKWFLFRLTGNDDEINLNGDGSEKPEFGEWTWMTPQEVIEKAVDFKKPVYEEALKHFAPYLQSDPAASS

SEQ ID NO: 8751 - protein, 88 aa, Zea mays
ELPSVYPSRSNVPEAVYMQPLMGVNGVIVDLVPEITEAVSELIALPEPEPDLEVGSLSNQAAARGATTPNFSQREISFLLRLIPELVQ

SEQ ID NO: 8752 - protein, 264 aa, Zea mays
SSVADLYVNDAGGTAHRAHASTEGVTKYLKPAVAGFLMQKELDYLVGAVANPKKPFAAIVGGSKVSTKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFDEALDTTKTVIWNGPMGVFEFQKFAAGTEAIAKKLAELTTTKGVTTIIGGGDSVAAVEKAGLADKMSHISTGGGASLELLEGKTLPGVLALDDA

SEQ ID NO: 8753 - protein, 136 aa, Zea mays
  misc_feature (100)..(100): Xaa can be any naturally occurring amino acid
  misc_feature (113)..(113): Xaa can be any naturally occurring amino acid
MATNRSVGTLGEADLKGKKVFVRADLNVPLEDAQKITDYIRMRASVPTIKFLLEKGAQVILASHLGRPKGVTTKHSLKPLVSRLSELLVIEVVMAHDCIXGEEPEKLAAALPXGGVLLLEIVRFYKEEEKTDLLLV

SEQ ID NO: 8754 - protein, 222 aa, Zea mays
MANIDMAAVLADMDRDAAADARTPRTKLVCTLGPASRSVPMLEKLLRAGMNVARFNFSHGTHEYHKETLDALRQAMHNTGILCAVMLDTKGPEIRTGFLKDGKPIKLTKGQEITVSTDYDIKGDTNTISMSYKKLPQDVKPGHVILCADGTISLSVLSCDPAAGTVRCRCENTAMLGERKNCNLPGIVVDLPTLTEKDKEDILGLGVPNDIDMIAFDLVPQR

SEQ ID NO: 8755 - protein, 370 aa, Zea mays
MMGGFLSRVLLLAFGYAYPAYECYKTVELNKPQIEQLIFWCQYWILVALLTVLERFGDFTISWLPFYSEAKVLFFVYLWYPKTKGTTYVYGTFFKPYISQHENEIDRNLLELRARATDMVVLYFHKAASVGQNTFFDVLKYVAAQSPSRKSRLHPHQEPQQQQPQVQVELQQPQPQKQAAPVMRRGASIAARQAAMAQQSLETIPVPSSPKIKRQTSGRPGSVASTKPAAAASTPKPGGSPKKGEVKPAVDPVQTPATSADSPKSEPSAPPLSETEGVDNMAIDEVSGDAAEGAEELDPALEETPMEETIRVTRAKLRRRTATEDSAGELAACRCFPPAHCIDLFPSFRLTCCLLEWRYVVVHLVLVTQS

SEQ ID NO: 8756 - protein, 303 aa, Zea mays
  misc_feature (194)..(194): Xaa can be any naturally occurring amino acid
MHRDRGVSAAAIPGDRKRIGEPMDRSSPSTSWGFSGGREKERIGVGKQPEMPRSGGGSTAMSKSKLSDAESETDSEESDVSGSDGEDTSWISWFCSLKGNEFFCEVDDDYIQDDFNLCGLSNQVPYYDYALDLILDVESSHGDMLTEEQNELIESAAEMLYGLIHVRYIITSKGLSAMVNSLELFLMDMLLFLXICISSYLMFVQLDKYRNVEFGRCPRVNCSGQPCLPVGQSDVPRSSTVKIYCPRCEDIYTPRSKYLSNIDGTYFGTTFPHLFLMTYPHLKPQKPLQQYVPRVFGFKIRKP

SEQ ID NO: 8757 - protein, 259 aa, Zea mays
  misc_feature (219)..(219): Xaa can be any naturally occurring amino acid
  misc_feature (240)..(240): Xaa can be any naturally occurring amino acid
  misc_feature (248)..(248): Xaa can be any naturally occurring amino acid
  misc_feature (252)..(252): Xaa can be any naturally occurring amino acid
  misc_feature (256)..(256): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELXQRFFAEWNKGELLSFLVEITXADIFSIRXDQGXGYLXDKV

SEQ ID NO: 8758 - protein, 124 aa, Zea mays
PFRRVPTVVSNYQEDADKPRAGCGRNCLGDCCLPASKLPLYASKLSPAKGSQEDAASTKLLVDILLSEWEDRMTRGLFRYDVTACETKVIPGNLGFVAQLNEGRHLKKRPTEFRVDRVLQPFDP

SEQ ID NO: 8759 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSKKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 8760 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGRKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 8761 - protein, 446 aa, Zea mays
  misc_feature (284)..(284): Xaa can be any naturally occurring amino acid
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDXLKDLYKSFVSEYPIESIEDPFDQDDWSTYAKLTDEIGRKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 8762 - protein, 436 aa, Zea mays
MPPSLFTPRFRFSSAPVPEPLLGLIDLGASRDLSGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSNKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 8763 - protein, 354 aa, Zea mays
MFVIHKYNSTTERMQKKKKKKKKKKKKKEVFKPKTMEPVRKSVCVTGAGGFVASELVKLLLSRGQYAVRGTVRDPGASKNAHLKVLEGAEERLQLLKADLMDYNSIASAVAGCEGVFHVASPVLSHRPSNPEVEVIAPAVIGTTNVLKACYEAKVRRVVVVSSCGAVYANPIYPKGKVFDEDCWSDEDYCRKKEDWYLVSKTLSEREALAFAAKTGLDVVTVCPSLVFGPLMQPTVNLSSEMILKYFKDLETVENVLSNMVDIRDVADALLLTYEKPEASGRYICSSHAIKISDMINILKTMYPSYPYPKNFVEDDVNSVYSSEKLQKLGWSFKPIEESLRDTVESYKAFGILN

SEQ ID NO: 8764 - protein, 277 aa, Zea mays
NPSLFLRGCNVEVGAVLIRIELDGASAGSKICNARLVLLGDVDAGKSSLVLRYVKGQFVEFQESTIGAAFYSQTLAVNDETVKFEIWDTAGQERYHSLAPMYYRGAAAAIVVYDITNPASFTRAKKWVQELQAQGNQNTIVALAGNKADMLDARQVPAEEAKAYAQENGLFFMETSAKTAINVNDIFYEIAKKLLQGQQAPSPQAGMVLNQRPNERTVSSSSCCSRAVFQPRSAVIKCIRGGLWKISHVACVAAFQADVLPFCSSFPFTCSSCKCQY

SEQ ID NO: 8765 - protein, 201 aa, Zea mays
FDADAIPTNEAMKKQIAVASKAMPFYCALPTLSEYMIESGWTRCYFNISEMGFSAYLCYMAMYLIFVEFGIYWMHRELHDIKPLYKHLHATHHIYNKENTLSPFAGLAFHPLDGILQAIPHVLALFLLPTHFRTHIALVFLEGVWTTNIHDCIHGKVWPVMGAGYHTIHHTTYRHNYGHYTVWMDWMFGTLREPDDILKKA

SEQ ID NO: 8766 - protein, 104 aa, Zea mays
LLKHICFPGLAFHPLDGILQAIPHVLALFLLPTHFRTHIALVFLEGVWTTNIHDCIHGKVWPVMGAGYHTIHHTTYRHNYGHYTVWMDWMFGTLREPDDILKKA

SEQ ID NO: 8767 - protein, 580 aa, Zea mays
KYIELPVACAILICLFALQHYGTHKVGFLFAPIVCIWLVCISAIGLYNIIRWDPHVYRALSPYYMYQFLRKTQTGGWMSLGGILLCVTGSEAMYADLGHFSQSSIQIAFISVVYPALVLAYMGQAAFISQHHSFESSYHIGFYVSVPETLRWPVLVIAILAAVVGSQAIITGTFSIIKQCSSLSCFPGVKIVHTSSTLHGQIYIPEINWMLMILCLAVTIGFRDTKHLANAQGLAVITVMLVTTCLMSLVIVLCWNKSIFLALGFLLFFGTIEVIYFSASLVKFHEGAWVPISLSFIFMVIMSVWHYGTIKKYEFDVQNKVSVNWLLNLGPSLGIVRVRGIGLIHTELMSGIPAIFSHFVTNLPAFHQVLVFLCVKSVPVPHVQPEERFLVGRIGPKEYRLYRVIVRYGYRDVQKDDLEFEKELVSNIAEFIRSSGEYDKNGFVEDTDKPLPFEKLSTISTGINMLEEDGEVDAYVSPHKEIDPHNAAPKRKKARFMIPKSAQVDSEVRRELQELMDAREAGMSFILGHSYMKAKSGSSFIKRIVINFFYEFLRKNSRGPAYAANIPHASTLEVGMVYQV

SEQ ID NO: 8768 - protein, 388 aa, Zea mays
MNGGGEDGKQQPHLVLAHKLFLLSHSDVDDLAKVDLRADVFAAVKSDDMAALYESLAADGVLETDAALLAEMRARIDEEIRKLDEKIADAEENLGESEVREAHLAKSLYFIRVGEKEKALEQLKVTEGKTVAVGQKMDLVFYTLQIGLFYMDFDLISKSIDKAKNLFEEGGDWERKNRLKVYEGLYCMATRNFKKAASLFLDSISTFTTYELFTYDTFIFYTVLTSVISLDRVSLKQKVVDAPEILAVIGKVPHLSEFLNSLYNCQYKSFFIAFSGLTEPIKLERYLQPHFRYYMREVRTVVYSQFLESYKSVTMEAMAAAFGVTVDFIDQELSRFIAAGKLHCKIDKVAGVLETNRPDARNAIYQATIKQGDFLLNRIQKLSRVIDL

SEQ ID NO: 8769 - protein, 170 aa, Zea mays
MDAADVWGRSSSSSSSSAAAARRLQARYDLYMGIDDADAGLDEVTEPRGGAESYNCPFCGEDFDFVGLCCHIDDEHAVEAKSGACPICATRVGMDLIGHLTMQHGSYFKMQRRRRVRKVSSGSHSLLSLLRKDLRNGSLQSFLGGSSYVSNPPAAAPDPFVSSNLITASQ

SEQ ID NO: 8770 - protein, 263 aa, Zea mays
  misc_feature (200)..(200): Xaa can be any naturally occurring amino acid
  misc_feature (221)..(221): Xaa can be any naturally occurring amino acid
MVSSMPLSSLLLLLSAASFGGGVRLGDGGYEDWRLGTATYVKEFQSHPLNDGGGACGYGDLDIFRYGRYTTGLSAALFGRGGACGGCYELRCVNHIQWCLRGSPTVVVTATDFCPANMGLADDDAGGWCNFPREHLELSEAAFLRVAKAKAGIVPVQFRRVSCDRAGGMRFTITGSAHFLQVLITNVAADGEVAAVKVKXLEDGVDPDGAELGPELAVRRXDLRAQPLSFEVTGGRGRTVTAYSVAPADWMFAQTFEGKQFAE

SEQ ID NO: 8771 - protein, 647 aa, Zea mays
  misc_feature (9)..(9): Xaa can be any naturally occurring amino acid
  misc_feature (21)..(21): Xaa can be any naturally occurring amino acid
ISLSASANXLSKLRERADEYXALIMEELDRDNLGYIELEDLEALLLQSPSQAAARSTTHSSKLSKALSMKLASNKGTGPFYHYWQEFMYFLEENWKRIWVMTLWLSICICLFIWKFIQYRNRAVFHIMGYCVTTAKGAAETLKFNMALVLFPVCRNTITWIRSKTKIGAVVPFNDNINFHKVIAAGVAGGVALHAGAHLTCDFPRLLHASDAAYEPMKPFFGDKRPPNYWWFVKGTEGWTGVVMVVLMTIAFVLAQPWFRRNRLKDSNPLKKMTGFNAFWFTHHLFVIVYALLVVHGICLYLSRKWYKKTTWMYLAVPVLLYVSERILRLFRSHDAVRIQKVAVYPGNVLALYMSKPPGFRYRSGQYIFINCRAVSPYEWHPFSITSAPGDDYLSVHIRTRGDWTSRLRTIFSEPCRPPTDGESGLLRADLSKGITESSARFPKLLIDGPYGAPAQDYREYDVLLLIGLGIGATPLISIVKDVLNHTQHGGSISGTEPEGSGKAKKRPFMTKRAYFYWVTREEGSFEWFRGVMNEVAEKDKDGVIELHNHCSSVYEEGDARSALIVMLQELQHAKKGVDILSGTSVKTHFARPNWRSVFKHVAVNHENQRVGVFYCGEPVLVPQLRQWSADFTHKTNTKFEFHKENF

SEQ ID NO: 8772 - protein, 325 aa, Zea mays
DAWAYLFSLFSHLSQNLSVSRLSRAPFSHARPAPPPVAPPRPRPALEEPTPAATAAASPAPDRAPPRPRGGGGRGGRGGGMKGGSKAVVVAHKHAGVFISKSKEDALCTKNMVPGESVYGEKRVSVQNEDGTKVEYRVWNPFRSKLAAAVLGGVDNIWIAPGTRVLYLGAASGTTVSHVSDIVGPDGLVYAVEFSHRSGRDLVNMAKKRTNVIPIIEDARHPARYRMLVGMVDVIFSDVAQPDQARILALNASYFLKNGGHFVISIKANCIDSTLPAEAVFAAEVEKLKADQFKPAEQVTLEPYERDHACVVGGYRVPKKQKATS

SEQ ID NO: 8773 - protein, 149 aa, Zea mays
LILQSFLINQQTLHQTLTAVAAKPAFTAEGSHTLTNPSKFLNKPQYNESSLVGKTSTDSDPKRWPSASGTTVSHVSDIVGPDGLVYAVEFSHRSGRDLVNMAKKRTNVIPIIEDARHPARYRMLVGMVDVIFSDVAQPDQARILALNAS

SEQ ID NO: 8774 - protein, 1080 aa, Zea mays
  misc_feature (818)..(818): Xaa can be any naturally occurring amino acid
METSISPPGTSKQSAVRKPSPGGSLKDLCLVSKQGSIAEVESALALLKKSGGNIDGRNAFGLSALHLATWRNHLPIVRRLLDAGADPDARDGESGWSSLHRALHFGHLCIAGVLLQFGASLALEDTKGRTPVDLISCPVSQANGDFPDAVATEVFSWGSGTNYQLGTGNAHIQKLPCKVEALHGSYIKTVAASKFHSVAVSSNGELYTWGFGRGGRLGHPDIHSGQTTAVITPRQVTVGLGRKRVNAVAAAKHHTVIATELGELFTWGSNREGQLGYPSVDTQPTPRRVGSLKQRIISVAAANKHSAAVADTGEVFTWGCNKEGQLGYGTSNSASNCIPRMVEYLKGKVLRGVSAAKYHTIVLGADGEVFTWGHRLVTPRRVVVARCLKKGGNTNLKFHRMERLQVISVAAGTTHSTALTADGALFYWVSSDPDLKCQQIFSMCGRNIVNISAGKYWTAVATSTGDVFMWDAKKRKDETPIFTRVHGVKRATFVCVGETHMLVLSSIYHPEYPPKPKSQGLKSMLEWNGGTEELGEDILFDDVQPNSGLSGSSGEMSKGVPSLKSLCEKVAVEYLLEPKNAIQLLEIADSLEAKELKKHCEDLAIRNLDYIFTVGASSIMNASSEILVNLEKLLDEKSSEPWSQHRLPTMTATYPAVIDSDVEEDEAREFPKTRKCGKSASRPSAMSSDDSFLQKDCTAEQAVSKQIRALRKKLQQIEILEAKQLAGHQLDSQQVAKLESRAALEGELAELGIPSEIYSTSSACPAEGRTNRKPEVSKKQKRKNKQSTQTPSVKNEPGQQIPITELQVLQVNVSAEKXEAYAADPIKPMEAAAFSNTKDTASPPEKKPSQPTPSKKKNRKGGLSLFLSGALDDTPKPSLPAPAVPATPKPEGPAWGGVKITKGPASLRDIQTEQSRTNEPASAKAKDRHENSPDSAGRATRLSSFIPDARSSPVAVVAPARAAAAPPSSEGDRSTPPWSSSATSPNVSQPSLRDIQQMQQRHHGGVSHSPKTQTSGFSIPPHSGAPEAAGGGGVKDNVPNRWFRPETDAPSSIRSIQIEEQAMKDFRRFYSSVRIVKPQV

SEQ ID NO: 8775 - protein, 152 aa, Zea mays
MDASKLKKVAGKKFGGPRKKSVTRSVKAGLQFPVGRIGRYLKKGRYAQRVGSGAPVYLAAVLEYLAAEVLELAGNAAKDNKKTRIVPRHLLLAIRNDQELGRLLSGVTIAHGGVIPNINPVLLPKKTAEKAEKTAAKSPKKATKSPKKATKA

SEQ ID NO: 8776 - protein, 457 aa, Zea mays
MSHYHSADFEEMEDEYDMNEPVDDMEGEDEYQELVIRDSDAEDEDDADQLHKLSDTSAADARSGKDIQGIPWETIEVTRETYRQARLEQYKNYENIPNSGVAAMMVQFVNQPKKACKSTEKGRTYYEFRRNTRSVKSTISHFQLRNLVWATSKHDVYLLLHYSVLHWSALNGVDTEIMDVHGHVAPSEKHPGSLLEGFLHTQISTMAVKDNLLVAGGFQGELICKHLDREGISFCCRTTYDDNAITNALEIFNTSSGALHFIASNNDCGVREYDMERYQLFKHFRFDWPVNHTSLSPDGKLVIIVGDDTDALLIDANSGKTIHSMKGHLDFSFASAWSPDGLTFATGNQDKTCRIWDARNLTESVHVLRGNVGAIRSIRFTSDGHFLSMAEAADFVHIFDIKSDYNKRQELDFFGEVSGMSFSPDTDTLYVGISDRTYGSLLQFGRLYNYSYLDSLL

SEQ ID NO: 8777 - protein, 171 aa, Zea mays
  misc_feature (82)..(82): Xaa can be any naturally occurring amino acid
  misc_feature (105)..(105): Xaa can be any naturally occurring amino acid
  misc_feature (152)..(152): Xaa can be any naturally occurring amino acid
METYTTDDALTIMGFGKFQALVLFYAGMGWVAEAMELMLLSFLGPFIREEWNVSPENESLLSSVVFAGMLLGACAWGFVSDXYGRRTGLIFSTLFTSGMGFLSAXSPNYLCLVALRFLVGVRVGGSHVFISWVLEFGPAQNRGTWMVIFVLXWTLPTIFESLLALVRIGQH

SEQ ID NO: 8778 - protein, 231 aa, Zea mays
  misc_feature (135)..(135): Xaa can be any naturally occurring amino acid
VRAHSCALPLRLRLCTINTPCVRCVCLGRGRTDSQRRRDLPAVSLSLAILLAVLRRSRHGGVRLGRNLLGLWRRALCGRRRRRGGYCRLQQQQQPTCAGSGCTPGRGATARKLAPVLRWGRSLARRLRLGWRRPXGGGHRMLPDGDGEPAVSTPKGQVAVYVGGEGEASQSLRYVVPVVYFNHPTFGELLREAEEEFGFQHPGVISIPCPAARFERAAALAAAAKKGFGRW

SEQ ID NO: 8779 - protein, 388 aa, Zea mays
  misc_feature (93)..(93): Xaa can be any naturally occurring amino acid
MALLKAARVADVPTLDVVVAPGLVAVAKARSAAAVGGRFSVIGHRGKGMNALASEDPRLRDVRENTVRSFNDAGRFPVDYVEFDVQMLRREPXIPILQVTKDGCPIIFHDNFIFTQDDGKISQKRVADIQLEDFLQYGLQNEQGKVGKPLLRRLKDGRMVNWDVQSEDALCTLEEAFDKVNPRLGFNVELKFDDSLEYTEEELTRILQAILKVVFEYAKDRPILFSSFQPDAAQLMRKLQGTYPVYFLTNGGTELYADVRRNSLEEAVKLCLAGGLQGIVSEARGIFRHPAAVPKIKEANLSLLTYGTLNNVPEAVYMQHLMGVNGVIVDLVPEITEAVSELIALPLPEPDLEVGSLSNQAAARGATTPNFSQREISFLLRLIPELVQ

SEQ ID NO: 8780 - protein, 257 aa, Zea mays
MADSMVASFWGPVTSTTELCEENYAHSSYIAEFYNTISNVPCVLLALIGLVNAFRQGFEKRFSVLHISNMILAIGSMIFHATLQLVLQQSDETPMVWEILLYMYVLYSPDWHYRSTMPTFLFLYGAAFAVVHFFARFQFVFKLHYIGLCFLCIPRMYKYYIQTKDVAAKRLAKLWVLTLTLGTLCWLVDRIFCKKLSHWYVNPQGHAWWHVLMGLNSYYANTFLMFCRAQQRGWEARITYLLGFLPYVKVQKPEKRE

SEQ ID NO: 8781 - protein, 242 aa, Zea mays
CRPFVCDTDQTRSNCLERFKSAYELPSPPLDSIIHIVPSNANNRPSCPLCRGDVIGWIVIGEARQHLNQKKRCCEEDCCSFVGNFNELQKHTQQKHPDSRPSEIDPARQVDWENFQQSSDIVDVLSTIHAQVPNGIVLGDYVIEYGDDDNGEDYEVFRGVRTHWWSCIFCKAFSRSSRSRRRARERRGGGRRIGNQANLENFNIEVPAQSVELREIRFDEIDDEYIVTGAIPSMATPGRMAS

SEQ ID NO: 8782 - protein, 424 aa, Zea mays
  misc_feature (22)..(22): Xaa can be any naturally occurring amino acid
  misc_feature (176)..(176): Xaa can be any naturally occurring amino acid
  misc_feature (188)..(188): Xaa can be any naturally occurring amino acid
MARKKIREYDSKRLLREHLKRXLAGIDLTILSAQITQSTDFAELVSQQPWLSTMKLVVKPDMLFGKRGKSGLVALNLDFNQVKEFVKERLGVEVEMGGCKAPITTFIVEPFVPHDQEYYLSIVSERLGSTISFSECGGIEIEENWDKVKTIFLPTEKPMTSDSCAPLIATLPLEAXGKIGDFIKGVFXCFLDLDFSFLEMNPFTMVNGEPYPLDMRGELDDTAAFKNFKKWGGIEFPLPFGRVLSPTESFIHELDEKTSASLKFTVLNPKGRIWTMVAGGGASVIYADTVGDLGYASELGNYAEYSGAPNEEEVLNYSRVVLDCATADPDGRKRALLIGGGIANFTDVATTFNGIIRALREKESKLKASRMHIYVRRGGPNYQSGLAKMRKLGAELGVPIEVYGPEATMTGICKQAIECIMAAA

SEQ ID NO: 8783 - protein, 312 aa, Zea mays
MEAAPRRQQQQQEEEEEGCPCGGPEAADHFERLHDAVLLDVLNRIGDVKALGRCALVSRRFHALVPLVDSVFVRVDCVIPDDPPSSSSAGAAPGSPPHQAPAPTARGRGALARVARALLGGVARPIHALGQILSSAAATVSRRSEPLPASPPPAPVADVSHHSPSEVLRSFRELRRLHIELPTGELGIDDGVLLKWKADFGSTLGSCVILGASSVSSKSPAGSAQAETAAADSAAAAPDTGRETEEPGSLPDSLYTNGGLKLRVVWTISSLIAASARHYLLHPIICNHGTLESLDLTDADGQGVLTMDKRQL

SEQ ID NO: 8784 - protein, 303 aa, Zea mays
MEAARQQQEECPCGGAEAADQFERLHDAVLLDVLNRIGDVKALGRCALVSRRFHALVPLVDSVFVRVDCVIPDDPPPSSSSSSSSSSAAPGTPPRQAPAPTARGRGALAHIARVLLGGIARPIHALGQILSPAAAAVSRRSEALPASPRAPVADVSHHSPSEVLRSFKELRRLHIELPTGELGIDDGVLLKWKADFGSTLVSCVILGASSISSKPPTGYTQAESETATAATPDTSRETEEPGSLPDSLYTNGGLKLRVVWTISSLIAASARHYLLQPIIWNHELLESLDLTDADGQGVLTMDN

SEQ ID NO: 8785 - protein, 73 aa, Zea mays
MIEVVLNDRLGKKVRVKCNEDDTIGDLKKLVAAQTGTRPEKIRIQKWYNIYKDHITLKDYEIHDGMGLELYYN

SEQ ID NO: 8786 - protein, 253 aa, Zea mays
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMDVVAAQTKAIAEKIKDWSNVVVAYEPVWAIGTGKVATPAQAQEVHASLRDWLKTNASPEVAESTRIIYGGSVTAANCKELAAQPDVDGFLVGGASLKPEFIDIINAATVKSA

SEQ ID NO: 8787 - protein, 241 aa, Zea mays
MLVKKNNSTAMAAGVLPLASLNHISIVCRSVEASLRFYADVLGFVPIRRPGSFDFDGAWLFNYGIGVHLLQSEDPGSLPENKGEINPKDNHISFQCESMVAVERRLKEMGIPYVQRCVEEGGINVDQIFFHDPDAFMIEVCNCDNLPVVPLAAAADQRAPAVLGACKRAAAVGVKQQQQQSSAGGVPSSAAPAAAAQRVPSAAQAPIVRVAEESSSHRPSRARDSSCQWRGRSVSCRPAGC

SEQ ID NO: 8788 - protein, 184 aa, Zea mays
  misc_feature (28)..(28): Xaa can be any naturally occurring amino acid
  misc_feature (35)..(35): Xaa can be any naturally occurring amino acid
AETDLAGERILFTEIIASVSDIKFARDXRHILSRXYMTLKLWDLNMDSGPVATFQVHEYLRPKLCDLYENDSIFDKFECCLSGDGLHVATGSYSNLFRVFGCSPESVEASTLEASRNPMRRQVVDPARPARTLTGAVRRGGENTSVDASGNSCDLSTKLLHLAWHPTENSIACAAANSLYMYYA

SEQ ID NO: 8789 - protein, 183 aa, Zea mays
GTLGSCRLSFFTEIIASVSDIKFARDGRHILSRDYMTLKLWDLNMDSGPVATFQVHEYLRPKLCDLYENDSIFDKFECCLSGDGLHVATGSYSNLFRVFGCSPESVEASTLEASRNPMRRQVVDPARPARTLTGAVRRGGENTSVDASGNSCDLSTKLLHLAWHPTENSIACAAANSLYMYYA

SEQ ID NO: 8790 - protein, 430 aa, Zea mays
  misc_feature (263)..(263): Xaa can be any naturally occurring amino acid
MAAGDAGRAPTAAAAQSLVESFCGVTSATPQEAAFYLESHNWALESAVRSYYDSVDGEADAVAADPVPPPPAAPAGGGEDTEDEDCVVGGGGGGDDDEDDEDYVDGDGSDDEDAALAAEAAEEEERRRPFKRLKRTHDARGGSGSSAKARGNVRTLADLDSGKGTAGSDENSEDDDEWTPPPEYETRDRSRRKNNTDEIFKQAKKKGAKQGPFEARPRSSSRNFTGTGRLLTGETVERNASQPPEEITHNIHFWRNGFTVNDXPLRSFDDPANAPFLKSIKDSDCPTELEPADEKSIVNVNLVRTEEEFTEPVKCAAPFEGERRNLMEPSGIYTSNDAAASSSATASRTITVDDSLPSTSLPIRFADGSRLVARFSPPRWVSDVRAFIDATRPGASDYTLQAGFPPKPLEDTAKTIEEAGVANSVIIQSV

SEQ ID NO: 8791 - protein, 210 aa, Zea mays
PSGWPGKQAKKKGAKQELNASQPPEEITHNIHFWRNGFTVNDGPLRSFDDPANAPFLKSIKDSDCPTELEPADEKSIVNVNLVRTEEEFTEPVKCAAPFEGERRNLMEPSDNNTSNDAAASSSATASRTITVDDSLPSTSLQIRFADGSRLVARFNTSHRISDVRAFIDATRPGASDYTLQAGFPPKPLEDTAKTIEEAGVANSVIIQSV

SEQ ID NO: 8792 - protein, 157 aa, Zea mays
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASGGSKEPKSPKKGAKSPKKA

SEQ ID NO: 8793 - protein, 241 aa, Zea mays
AEAFWLMLSLSLVLLNLPQMCILIFIGNNGETYFNTAALVSCVQNFPKSRGPIVGILKGFAGLSGAILTQIYAIVHSPDDAALIFMVAVGPTMIVIALMFIVRPVGGHRQVRPSDNTSFTFVYSVCLLLAAYLMGVMLLEDLVDLSQSVTVLLTIVLIIFLLVPIVIPVLLSFFSDDDETLHALLLPSPRKEEPSASTSSEEQQEVILSEVEDEKPKDVDLLPASERQKRIAELQTRLFQA

SEQ ID NO: 8794 - protein, 565 aa, Zea mays
MGSTAAVSVSASAIASRGCARSEAARRPGGIRVCGLRSEVLTCHSLRISQAPARLTVARPPPPAAATNGAAAGTCGFDYDLVIIGAGVGGHGAALHAVEEGLKTAIIEGDVVGGTCVNRGCVPSKALLAVSGRMRELHDEHHMKSLGLQVSSPGYDRQAVADHANNLASKIRINLTNSMKALGVDILTGVGTIVGKQKVRYGKAGFPDKEITARNIIIATGSVPFVPKGIEIDGKTVFTSDHALKLESVPDWIAIVGSGYIGLEFSDVYTALGSEVTFVEALDQLMPGFDPEIAKLAQRVLINPRKIDYHTGVFASKITPAKDGKPVLIELIDAKTKEHKETLEVDAALIATGRAPFTKGLGLENINVVTQRGFVPVDERMRVMDADGNVVPNLYCIGDANGKLMLAHAASAQGISVVEQISGKDHILNHLSIPAACFTHPEISMVGLTEPQAREKADKEGFEINVVKTSFKANTKALAENEGDGIAKLIYRPDTGEILGVHILGLHAADLIHEASNAIALGTRVQDIKFAVHAHPTLSEVLDELFKAAKVNSGVSHSVNEPVAA

SEQ ID NO: 8795 - protein, 170 aa, Zea mays
MSGNGAKKVVDAAVKAGRTIIDWDGMAKLLVTDEARKEFAALRRAFDDVNHQLQTKFSQEPQPIDWEYYRKGIGSKVVDMYKEAFESIEIPKYVDTVTPQYRPKFDAVIAELKEAEKEHQKESERIEKELAEMEEMRKKISTMTADDYFEKYPELKKKFDDEIRNDNWGY

SEQ ID NO: 8796 - protein, 482 aa, Zea mays
MALTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMVVSGGEEGARNGPSLMPGGSFEAYKYVKDIVLKVAAQVPDSGPCVTYIGKGGSGNFVKMVHNGIEYGDMQLISEAYDVLKFVGKLTNSELHQVFSEWNKGELLSFLIEITADIFGIKDEHGDGYLVDKVLDKTGMKGTGKWTVQQAAELSVAAPTIEASLDSRFLSGLKDERVEASKIFQGDYYSTGSPVDKAQLVEDVRQALYASKICSYAQGMNIIKAKSAEKGWGLNLGELARIWKGGCIIRAIFLDRIKKAYDRNPGLASLLVDPEFAQEIMDRQAAWRRVVCLAINNGVSTPGMSASLAYFDSYRRDRLPANLVQAQRDYFGAHTYERVDMPGSFHTEWFKIARNISNN

SEQ ID NO: 8797 - protein, 225 aa, Zea mays
LRKLFTRPGDSRPGYLAFLLGRTVVALAIQFPHLNRHSAARQLHCRRRWRSLRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMGVSGGEEGARNGPSLMPGGSFEAYKYVEDIVLKVAAQVPDSGPCVTYIG

SEQ ID NO: 8798 - protein, 178 aa, Zea mays
MALTRIGLAGLAVMGQNLALNIAEKGFPISVYNRTTSKVDETVQRAKAEGNLPVYGFHDPASFVNSIQKPRVVIMLVKAGAPVDQTIATLAAHLEQGDCIIDGGNERYENTERREKAMEERGLLYLGMGVSGGGEGARNGPSLMPGGSFDAYKYVEDIVLKVAAQVPDSGPCVTYIGK

SEQ ID NO: 8799 - protein, 204 aa, Zea mays
MAATAGGNKIRNAKLVLLGDVGAGKSSLVLRFVKGQFVEFQESTIGAAFFSQTLAVNDETVKFEIWDTAGQERYHSLAPMYYRGAAAAIVVYDITNAASFTRAKKWVQELQAQGNSNTIVALAGNKADLLDTRQVSADEAKAYAQENGLFFMETSAKTATNVNDVFYEIAKKLLQGQQVQNPQGGMVLNQRPPERMVSSSSCCA

SEQ ID NO: 8800 - protein, 204 aa, Zea mays
MAATAGGNKIRNAKLVLLGDVGAGKSSLVLRFVKGQFVEFQESTIGAAFFSQTLAVNDETVKFEIWDTAGQERYHSLAPMYYRGAAAAIVVYDITNAASFTRAKKWVQELQAQGNSNTIVALAGNKADLLDTRQVSADEAKAYAQENGLFFMETSAKIATNVNDVFYEIAKKLLQGQQVQNPQGGMVLNQRPPERMVSSSSCYA

SEQ ID NO: 8801 - protein, 239 aa, Zea mays
  misc_feature (210)..(210): Xaa can be any naturally occurring amino acid
  misc_feature (214)..(215): Xaa can be any naturally occurring amino acid
  misc_feature (221)..(221): Xaa can be any naturally occurring amino acid
GGEDGGVVGRGVEGEQAAQHAAEAVPVAQHFQNHLHHAVAEVRARFRRLLLHRHAQAVRLRLRLLAPLLLLLLLLLGRLLCLGRVQSVLSASVRSVACVAGDVDGGFGGGGGGGGDTGGADRGDGDRDPQPGGVEHPDRGDLHAGAGKEVASGTMPDPGWIAASGSTALEIPAKVPYDFLVSLVRDVGRDWDIDYELQVGLTVDLPIVGXFTIXXLSTSGXVQLPTLRTWSDLARLPSV

SEQ ID NO: 8802 - protein, 112 aa, Zea mays
MHHWNEQRKTRSFYDMGLENAGRHGSKTNYPRCPPSRRRRKSPSSPARQMAGGRVAHATLKGPSVVKEIFIGLTLGLIAGGMWKMHHWNEQRKTRSFYDMLDKGQISVVVEE

SEQ ID NO: 8803 - protein, 63 aa, Zea mays
  misc_feature (22)..(22): Xaa can be any naturally occurring amino acid
MAGGRVAHATLKGPSVVKEFGXGLTLGLIAGGMWKMHHWNEQRKTRSFYDMLDKGQISVVVEE

SEQ ID NO: 8804 - protein, 413 aa, Zea mays
  misc_feature (394)..(394): Xaa can be any naturally occurring amino acid
ESKLREALEEASEDGSLAKSRDVALLDGGDGGAEEGSVGRSRSLARLHAQRDFLRATALAAERAFQSPDALPVLEEALAKFLVMYPNYASASDVDRLRADEYPHLDKVCLDYCGFGLFSYLQSCNPADSSAAFTLSEITANLSNHALYGAAEKGTAEHDIKNRIMDYLNIPESEYCLVFTVSRGSAFRLLAECYPFGTNKRLLTMFDHESQSVNWMTQVARDKGAKAYSAWFKWPTLKICTTELRKLISTKKRRRKDSATGLFVFPVQSRVTGAKYSYQWMALAQQNHWHVLLDAGALGPKDMDSLGLSLFRPDFIITSFYRVFGADPTGFGCLLIKKSVMACLQSPSGGTGAGLVRIVPVFPQYLSDSVDGFDGVLDGLEDDNIIPIEEGSAXNSHHASQLPAFSGAYSSAQ

SEQ ID NO: 8805 - protein, 527 aa, Zea mays
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEASSTLLPINFDGLAKALTPGATIFVGQYLFTGSETTSVWLEVSEVKGDDVVCIIKNTATLAGSLFTLHCSQIHIDLPTLSDEDKDVIKKWGAPNKIDFLSLSYTRHAEDVRQAREFLSKLGDLSQTQIFAKIENVEGLNHFDEILAEADGIILSRGNLGIDLPPEKVFLFQKSALHKCNMAGKPAVVTRVVDSMTDNLRPTRAEATDVANAVLDGSDAILLGAETLRGLYPVETISTVGRICAEAEKVFNQDLYYKRTVKYVGEPMTHLESIASSAVRAAIKVKASVIICFTSSGRAARLIAKYRPSMPVLSVVIPRLKTNQLKWSFTGAFEARQSLIVRGLFPMLADPRHPAESTSATNESVLKVALDHGKASGVIKSHDRVVVCQKVGDSSVVKIIELDD

SEQ ID NO: 8806 - protein, 382 aa, Zea mays
  misc_feature (142)..(142): Xaa can be any naturally occurring amino acid
  misc_feature (203)..(203): Xaa can be any naturally occurring amino acid
  misc_feature (289)..(289): Xaa can be any naturally occurring amino acid
  misc_feature (315)..(316): Xaa can be any naturally occurring amino acid
  misc_feature (359)..(359): Xaa can be any naturally occurring amino acid
  misc_feature (372)..(372): Xaa can be any naturally occurring amino acid
MATVSLTPQAVFSTESGGALASATILRFPPNFVRQLSTKARRNCSNIGVAQIVAAAWSDCPAASAAAEVSAIPNAKVAQPSAVVLAERNLLGSDASLAVHAGERLGRRIATDAITTPVVNTSAYWFNNSQELIDFKGITNAXSRSIAFVVAVANTVCLQTLFFVLQYQLDWLPAKGFNSTLCKFCYIPMFIMLHLVRGAVCVXMTVIRPADMDALQNALDNNNVSLFFTETPTNPFLRCIDIEHVSNMCHSKGALLCIDSTFASPINQKALTLGADLVIHSATKYIAGXNDVIGGCVSGRDELVSKVRIYHHVVXXGVLNPNAAYLILRGMKTLHLRVQCQNDTALRMAQFLEEHPKIXARVYYPGLPSHPXHHIAKSQMTG

SEQ ID NO: 8807 - protein, 128 aa, Zea mays
MALTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLCLDM

SEQ ID NO: 8808 - protein, 392 aa, Zea mays
MAPAPALTATSVLKRSHLPGVHSLAGRRQPGRDRVSVLSPAIPPPRVSWQQGSGVVAKRLLWASASGSFEKDNIGEDVVLPSQIAVENKVDLLKILKSANSIIPHIVLGSTILALVYPPSFTWFTTRYYAPALGFLMFAVGVNSSANDFIEAIKRPDAIAAGYIGQLSLSPSALGAGIMLVSCVSGAQLSNYATFLTDPHMAPLSICMTSLSTATAVFVTPTLSYFLIGQKLPVDVKGMMSSIIQIVVAPIAAGLLLNRFLPRLCAAIQPFLPSMSVFVTALCVGSPLAINIKAVLSPFGLTIVLLLFAFHTSSFVAGYHLAGTWFSKSDDVKALQRTISFETGMQSSLLALALANKFFPDPLVGVPPAISVVLMSLMGFALVMVWSKKREA

SEQ ID NO: 8809 - protein, 410 aa, Zea mays
  misc_feature (307)..(307): Xaa can be any naturally occurring amino acid
  misc_feature (325)..(326): Xaa can be any naturally occurring amino acid
  misc_feature (391)..(391): Xaa can be any naturally occurring amino acid
MAPAPALTATSVLKRSHLPGVHSLACRRQPGADRVSVLSPAIPPPRVSWQQGSGVVAKRLLWASASGSFEKDNIGEDAVLPSQIAVENKVDFLKILKSANSIIPHIVLGSTILALVYPPSFTWFTTRYYAPALGFLMFAVGVNSSAKDFIEAIKRPDAIAAGYIGQFVIKPLFGFLFGTLAVAVLNLPAALGAGIMLVSCVSGAQLSNYATFLTDPHMAPLSIVMTSLSTATAVFVTPTLSYFLIGQKLPVDVKGMMSSIVQIVVAPIAAGLLLNRFLPRLCAAFQPFLPSMSVLVTALCVGSPLAXLNIKAVLSPFGLTIVLLXXAFPTSSFVAGYHLAGTWFRKSDDVKALQRTISFETGMQSSLLALALANKFFPDPLVGVPPAISVXLMSLMGFALVMVWSKKREA

SEQ ID NO: 8810 - protein, 353 aa, Zea mays
MAPAPALTATSVLKRSHLPGVHSLACRRQPGADRVSVLSPAIPPPRVSWQQGSGVVAKRLLWASASGSFEKDNIGEDAVLPSQIAVENKVDFLKILKSANSIIPHIVLGSTILALVYPPSFTWFTTRYYAPALGFLMFAVGVNSSAKDFIEAIKRPDAIAAGYIGQRWHNVGFMPTAVFVTPTLSYFLIGQKLPVDVKGMMSSIVQIVVAPIAAGLLLNRFLPRLCAAIQPFLPSMSVFVTALCVGSPLAINIKAVLSPFGLTIVLLLFAFHTSSFVAGYHLAGTWFSKSDDVKALQRTISFETGMQSSLLALALANKFFPDPLVGVPPAISVVLMSLMGFALVMVWSKKREA

SEQ ID NO: 8811 - protein, 173 aa, Zea mays
MTVTWTLPLLCRFRRHLSLVAAAGMAGVTATGMAGVPATFSSATAQIGGFLSKKPYAPPLWATHLSPMPCHTFSLGHFPTPIHKWNLPNLPEGTEVWIKRDDLSGMQLSGNKVRKLEFLMADAVAQGADCVITVGGIQSNHCRATAVAAKYLNLDCYLILRTSKGSILCFLGM

SEQ ID NO: 8812 - protein, 191 aa, Zea mays
  misc_feature (139)..(139): Xaa can be any naturally occurring amino acid
MQRGDPLVVGRIIGDVVDPFVRRVPLRVAYAAREVSNGCELRPSAIADQPRVEVGGPDMRTFYTLVMVDPDAPSPSDPNLREYLHCMLQHTYCQDLVYILHLVRLVTDIPATTGVSFGTEVVCYESPRPVLGIHRVVFXLFQQLGRQTVYAPGWRQNFSTRDFAGLYNLGLPVAAVYFNCQRESGTGGRRM

SEQ ID NO: 8813 - protein, 293 aa, Zea mays
  misc_feature (263)..(263): Xaa can be any naturally occurring amino acid
  misc_feature (280)..(280): Xaa can be any naturally occurring amino acid
LLPPISPLPQSYSYLPTHPPRPSLQPPEEQGEMSSGMGKVVCVTGASGYIASWLVKLLLHRGYTVRATVRDTADPKKTLHLQALDGAKDRLHLFKASLLEEGSFDAAVAGCDCVFHTASPFYHNVKDPKAELLDPAVNGTLNVLRSCKKASIKRVIITSSMAAVAYNGKPRTPDVVVDETWFSSAEVCEKNEQWYVLSKTLAEEAAWKFANDNGFEIITINPAMVIGPLLQPTLNTSAEAILKFINGSSSTYPNFSFGWVNGXDGALSHILAYEVPSANXRYCMVERVLTLGD

SEQ ID NO: 8814 - protein, 575 aa, Zea mays
HASATVRFHESIAQLEQALCDFPYDKLDISDEAREQVELVHAQLKRAKERVDMPDDEFYNELCSLYNKSHDPSAELDILGRLSEKLHLTTIADLTQESLALHEMVASGGGNDPGEHIEKMSMLLKKIKDFVQTQNPETGPLVTAKPMGSNGKPRPVNVPDEFRCPISLELMKDPVIVATGQTYERALIEKWLASGHHTCPSTQQRMPNTTLTPNYVLRSLITQWCEANGIDPPKRPTQQPDRPTSSCSSSERASIDALLSKLCSADPEEQRSAAAELRLLAKRNANNRICIAEAGAIPLLLSLLSSSDLQTQEHAVTALLNLSIHEDNKASIILSGAVPGIVHVLKNGSMEARENAAATLFSLSVVDEYKVTIGGTGAIPALVVLLSEGRQRGKKDAAAALFNLCIYQGNKGRAIRAGLVPLVMGLVTNPTGALLDEAMAILSILSSHPEGKAAIGAAEPVPVLVEMIAGGSPRNRENAAAVMLHLSASVRQSAHLARAQECGIMAPLRELALNGTGRGKRKAVQLLERMSRFLVQQQEDAVDPRVQELEEIERQLAAFGPGVTEADVLQQLGAL

SEQ ID NO: 8815 - protein, 269 aa, Zea mays
  misc_feature (220)..(220): Xaa can be any naturally occurring amino acid
  misc_feature (253)..(253): Xaa can be any naturally occurring amino acid
MSVRSLLAQPIPSLFAPAPAPSRARRNRRTSRRRFLAATKLTMDGTSFDLTEHEGSNLSPFLLKHFNEWDDRKTRGLFHHDISSCETKVLPGVHNFVATLIEGRDQKKRPTEFTMNQVLQPFVSEKFNFTKVSPLEVIFRFNDTEKDPAQYFDGVPDTVSASSSAILINVSPIGYCHVLLTPKIQDCLPQRIDQESFLIAMYVARGAKTPFFRVGYNSLXGFATINHLHFQAYYLKVQYPVEKAITEKLKTLXNSVSIFHLVDYQSMAL

SEQ ID NO: 8816 - protein, 705 aa, Zea mays
  misc_feature (456)..(456): Xaa can be any naturally occurring amino acid
NSRVDPRVRILGVVTPTMAIVLLALLLFPSAYAQPWSVCGNTGNYTAASTYQDNLSQLAASLPKKASSNTSPLFATGTAGAVPDLVYALALCRGDINASACKDCVTIGFEDAQQLCAFNKEATVYYDSCLVSFSNEDFLSTTVNGNENEVTVLMDAQNFTESADYIRLLLFTLLNDTSESAINSIRRFTTARMDISSLPTIYCAVQCTPDLTADECAACLQDFPQVTLQYLDGQRGGRLLGVRCNMRYEIYKFYQGDPMLRIISLASAVPTIGKTPPGTPVTVYPQPPPAAPPAPQMITTPIAAQEETGRKGKLWIIGIAIPLVAILLCSTFTFLWLRRPKKGVLSSQDRAGANRIEENALVWTIEQKSSEFTLFDLSELLEATKSFAEENRLGQGGFGPVYKGQLSDGQEIAVKRLASHSGQGFTEFRNEVELIAKLQHTNLVRLLGCCIQAEEXILVYEYLPNKSLDFFIFDERQSSLLNWYKRRAIIEGVAQGLLYLHKHSRLRVVHRDLKASNILLDQDMDPKISDFGLARICSSNDAEGNTKRVVGTYGYMSPEYASEGIYSVKSDVFSFGVLLLEILSAKRNSGFHQYGDFLNLLGYTWHLWEIGRWLDLVEASISKEMHEAEARRYINIALMCVQENADDRPTMSDVVAALNSESVVLPEPKHPAYFNLRVSKSVESAVVVEACSLNEMTITQDPQGR

SEQ ID NO: 8817 - protein, 510 aa, Zea mays
  misc_feature (448)..(448): Xaa can be any naturally occurring amino acid
MMIARRLLRPNAPAQASSLLKHVMTGTASLQGYADSLLDATVRHFGSAPSAQPEENGFKGHGMLAPFTAGWQSNDLHPLIIERSEGSYVYDINGNKYLDSLAGLWCTALGGSEPRLVKAATEQLNKLPFYHSFWNRTTKPSLDLAQEILSMFTAREMGKVFFTNSGSEANDSQVKLVWYYNNALGRPNKKKFIARSKAYHGSTLISASLTGLPALHQKFDLPAPFVLHTDCPHYWRYHLPGETEEDFATRLATNLENLILKEGPETIAAFIAEPVMGAGGVIPPPKTYFDKVQAVVKKYDILFIADEVITAFGTLGTMFGCDYYNIKPDLVSLAKALSNAYVPIGATLVSPEISDVIHSQSNKLGSFAHGFTYSGHPVACAVAIEALKLYRERDIPGHVKQIAPKFQDGIRALADSPIIGEIRGLGMIMGTEFTNNKSPTDLFPAEWXVGAIFGEECQKRGMLVRVAGDAIMMSPTLIMTPGEVDELVRIYGEALKATEERVAALQSKKN

SEQ ID NO: 8818 - protein, 530 aa, Zea mays
  misc_feature (52)..(52): Xaa can be any naturally occurring amino acid
  misc_feature (69)..(69): Xaa can be any naturally occurring amino acid
  misc_feature (186)..(186): Xaa can be any naturally occurring amino acid
  misc_feature (196)..(196): Xaa can be any naturally occurring amino acid
MKALRRSSTSSSPSSSSSPTAASSPPSSSWIHIRSLLVAAASSSSSSSPAAXRPRGGGVWCRQRPAANXKRALSREQWESVFSANGKLRDGGRKFLKKVRSGGIEPSIRAEVWPFLLGVYDLNSSEEERNSVKIKKRKEYEKLRRQCQQILNGYKGNGLKAITELNSDECSSLDGIAEGSESRAHXMKLTNQTTFXDVVECMEEDADELAYAYPCKAESESSDSESSDEDDPGGISVSGDENCDPDTKFTMSNSFKADFFRSSRTSEDFATWQRIIRLDAIRSNSEWILFSRNQSEVPKERALQSAASVGLKDYEHLEPSMIYHAARLVGLLEAYAVYDPEIGYCQGMSDLLSPIIAVMEDDDEAFWCFVGFMRKARHNFRLDEVGIRRQLKIVSQIIKRKDSHLYRHLQKLQAEDCFFVYRMVVVLFRRELTFEQTVCLWEVMWADQAAIRAGIGRSTWGRIRLRAPPTDDLLLYAIAACVLQRRKLIIEKYSSMDEILRECNSMAGQLDVWRLLDDAHDLVVNLHDKI

SEQ ID NO: 8819 - protein, 513 aa, Zea mays
RRWRRSSTSSSPSSSSSPTAASSPPSSSWIHIRSLLVAAASSSSSSSSSPHSDRGGIKSPWSRRKRKRALSREQWESLFSANGKLRDGGKKFLKKVRSGGIEPSIRSEVWPFLLGVYDLNSSEEERNSVKIKKRKEYEKLRRQCQQILNGYKGNSLKAITEVNNEVCSSLEGTADGSESPCFEDANAIRAPVSLEELKPEQNEVDQPENIPLMTLEGCPVSGEENCDPDPKFIRSTSFKADLFRSSRTPEDFATWQRIIRLDAIRSNSEWIMFSGNQAEVPKERALQSAASVGLKDYDHLEPSMIYHAARLVGLLEAYAVYDPEIGYCQGMSDLLSPIIAVMEEDDEAFWCFVGFMRKARHNFRLDEVGIRRQLKIVSQIIKRKDSHLYRHLQKLQAEDCFFVYRMVVVLFRRELTFEQTVCLWEVMWADQAAIRAGIGRSTWGRIRLRAPPTDDLLLYAIAACVLQRRKLIIEKYSSMDEILRECNSMAGQLDVWRLLDDAHDLVVNLHDKI

SEQ ID NO: 8820 - protein, 534 aa, Zea mays
MALQAAYEYLQQAVGHGAWSSTQTLTLLLIAVPTVLLLLASLAKSTSSSGRGKPPLPPSPPGTLPIVGHLHHIGPQTHISLQELVAKYGHNGFLFLRAGAVPTLIVSSPSAAEAVMRTHDHIFASRPWSMASHILRYNTCDVAFSPLGEYWQQTRKLMNTHLLSNKKVYSFRHGREEEVCLVVDNLREAAAKSPSTAVDMSEVLAAYTNDVVSRSVLGSTHRKKGRNTLFREMTMTNVDLLVGFNLEYYIPRWPLTDLLFRLVCWKVTRHLKRWDALLEEVIHEHVEMRKLSGDKEKESDDFIDIFLSRYEEYGFTMDNVKSLLMNVFEAAIETSYLVLESAMAELMNHRRVMKKLQAEVRAYGAEKKLDMIREDDLSSLPYLKASMKEALRLHPPGPLLLPHYSTADCQIDGYHIPANTRVLVNGWAIGRDPAVWEKPEEFMPERFMRDGWDKSNSYSGQDFRYLPFGSGRRICPGANFALATMEIMLANLMYHFDWEVPNEKEDGGGKVSMDETFGLMLRRNEPLYLVPRAV

SEQ ID NO: 8821 - protein, 214 aa, Zea mays
  misc_feature (13)..(13): Xaa can be any naturally occurring amino acid
SPCSSSSSTTAAXAPRLPRRTASARPLRFLSCSTSAPPLFAAVASMDSPPQGYRTNVGICLADPSLTKIFSASRIDIPSAWQMPQGGIDAGEEPRAAAFRELREETGVTSAEIVAEAPVWLTYDFPPDVRTKLNARWGTDWKGQAQKWFLFRLTGNDDEINLNGDGSEKPEFGEWTWMTPKEVIEKAVDFKKPVYEEALKHFAPYLQSDPAASS

SEQ ID NO: 8822 - protein, 78 aa, Zea mays
KSLTICLQGGIDAGEEPRAAAFRELREETGVTSAEIVAEAPVWLTYDFPPDVRTKLNARWGTDWKGQAQKWLAPLNFF

SEQ ID NO: 8823 - protein, 135 aa, Zea mays
  misc_feature (119)..(119): Xaa can be any naturally occurring amino acid
VRLQSLGAIAACFLCSESFDLTEHEGSNLSPFLLKLFNEWDDRKTRGLFHHDISSCETKVLPGVHNFVATLIEGRDQKKRPTEFTMNQVLQPFVSEKFNFTKVSPLEVIFRFNDTEKDXAQYFDGVPDTVQLLLV

SEQ ID NO: 8824 - protein, 330 aa, Zea mays
  misc_feature (67)..(67): Xaa can be any naturally occurring amino acid
MGRTEAADGAESGGLGVGETVRELREAYEGGRTRSLAWRQAQLRGLLRLLEEKEVEALQALHTDLRXRHAEASRDEVGVLIKSANGALQQLGKWMAPEKVRVPLIAWPATAQVVPEPLGVVLVFSCWNVPLGLSLEPLIGAIAAGNAVALKPSELSPCTARFLGDNIGRYMDSSAVKVVQGGPDVGVQLMEHRWDKVLFTGSPRIARAVMAAASRHLTPVALELGGKCPCIFDAMGSARDLQISVNRMIAGKWSSCAGQACIAIDYVLVEERFAPILIKVLKSTLKRFFPEADHMARIVNERHFERLSNLLKDRSVAPSVLHGGSMDSKN

SEQ ID NO: 8825 - protein, 218 aa, Zea mays
MSAAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAASIISTEQGEELRKQIGAVAYIECSSKTQRNVKAVFDTAIKVVLQPPRRREVTRKKMKARSNQSLRRYLCGSGCFTS

SEQ ID NO: 8826 - protein, 143 aa, Zea mays
MAPISGATAVLVMAVGAACASPDGTKRQTPLRSLLLVLTPQSEREGHPEEPVVLIGVSLPPFPRGENNLEKMAPISGATAVLVMAVVATLAAAANALAPAPAPATSDGTSVDQGIAYVLMLVALVLTYLIHPLDASSAYKQLF

SEQ ID NO: 8827 - protein, 179 aa, Zea mays
  misc_feature (68)..(68): Xaa can be any naturally occurring amino acid
  misc_feature (149)..(149): Xaa can be any naturally occurring amino acid
  misc_feature (170)..(170): Xaa can be any naturally occurring amino acid
MMEPGAPYFGAMGSSASGAGGGFYQPFNSNLAGAGSSTGIQSFPCVRLRGLPFDCNDIDVCKFFVGLXIVDCLLVNKNGRFTGEAFVVFPTAMQAEFALHRDRQNMGRRYVEVFRCKKHEYYCAIASEVNQGGYFEPEYRRSPPPPRPXKPSEDKGSMEYTEVLKLRGLXYSATTEDII

SEQ ID NO: 8828 - protein, 428 aa, Zea mays
  misc_feature (244)..(244): Xaa can be any naturally occurring amino acid
  misc_feature (394)..(394): Xaa can be any naturally occurring amino acid
MSTTKVKRRVGKYELGRTIGEGTFAKVRFARDTVTGEAVAIKILDKEKVLKHKMVEQIKREISTMKLIKHPNVVRIYEVMGSKTKIYIVLEFATGGELFDTIVNHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEFTFPPWTSFPAKRXITIPEILEDEWFKKGYKRPEFDEQYDTTLDDVDAVFNDSEEHHVTEKKEEEPVALNAFELISMSAGLNLGNLFDSEQEFKRETRFTSKCPPKEIVRKIEEAAKPLGFDVQKKNYKLRLEKVKAGRKGNLNVATEILQVAPSLHMVEVRKXKGDTLEFHKFYKNLSKTLKDVVWKSDDLQTQHAS

SEQ ID NO: 8829 - protein, 600 aa, Zea mays
  misc_feature (403)..(403): Xaa can be any naturally occurring amino acid
  misc_feature (434)..(434): Xaa can be any naturally occurring amino acid
MASVAGSGGGASAGAGGLKTYFKTPEGRHKLQYEKTHSPAVVHYNHNGKTVAQMTVAYLKEKPAGQGSTPSTPSAGSGMRSAAARLLGTGNGSRTLSFGSNGTSRAVSGSSRMGGGIGVSTSASGSQGMANYDGKGSYIIFNTADTLFISDLNSHDKDPIKSIHFSSSNPLCHAFDPEAKDGHDLLIGVFSGDVYSMSLRHQLQDPGKKPVSYQHFVNKDKDKDKDPSQGGAASSQCTCVAWVPEREGIFVVSHADGNLYVYDKFKDGNTDWTFPTVKDQSQVLISHAKSSKGNPIARWHICQGAINGISFSPDGAYLATVGRDGYLRVFDFTKEQLIFGGKSYYGALLCCSWSADGKYLLSGGEDDLVQVWSMDDRKIVAWGEGHNSWVILSLQLFLAIITXAFLIETCILSQINLRLYRLAQFLLIRIGPNXFAIIQVSAVSFDPCWSQPNSDETEENVMYRFGSVGQDTQLLLWDLALDEIAVPLRHPSGGSPTFSSGSPSAHWDNACPPTGVLQPSPRMRDVPKLSPLVAHRVHVDPLSGLEFTSESIVTICREGLIKIWARPIHSENNQQPDSSEQVIGSATAKDKMLTSSNKAE

SEQ ID NO: 8830 - protein, 491 aa, Zea mays
KLQKELAVSLLYCGVEVKFPQEFSQERNLVTPGNNLEEAILLLLMLTRKLFLREIQWDPDLVNHLVYALSLSGHYEVLASHLEMLLPGTYTRSERWYILALCYSAAGMDDSALNIIRNGFSVLERKGKPHVPSLLLGAKLCCKNPKHASEGIKFANKAMKSFRSRDLHFISTTKHFLGVCYGPFSRSSTSYLDKSRLQDNALRLLQDAATTAKYNPEIMYSLAWENAMQRKLNAAVESATECLEMVMGGSVSAWKLLILVLSAQQNLQEAEAVADFAMDEAEKNDQLDILRLKAQIQASRGQFKSAVETFRVLLAAIQVKKEVWKLTTCNEVKCLQKLEMDAWLDLASIYSKLEAWHDSNICLDKAISIDFYYPKCWHVRGLLLEDQFLHKEALMALSFALSIDPDYVPGMVCMAGILRNIGGDSLSIARTYLRNALRLEPTNHRAWLSLGLVLKAEGSLQEAADCFQAAYELRELSPIQDFSEQLPIMLH

SEQ ID NO: 8831 - protein, 487 aa, Zea mays
RPPAQGRRLPVVNPTTEAHIGEIPAGTAEDVDAAVAAARAALKRNRGRDWARAPGAVRAKYLRAIAAKVIERKQELAKLEALDCGKPYDEAAWDMDDVAGCFEYFADQAEALDKRQNSPVSLPMETFKCHLRREPIGVVGLITPWNYPLLMATWKVAPALAAGCAAVLKPSELASVTCLELADICKEVGLPPGVLNIVTGLGPDAGAPLSAHPDVDKVAFTGSFETGKKIMAAAAPMVKPVTLELGGKSPIVVFDDVDIDKAVEWTLFGCFWTNGQICSATSRLLVHTKIAKKFNERMVAWAKNIKVSDPLEEGCRLGPVVSEGQYEKIKKFILNAKSEGATILTGGVRPAHLEKGFFIEPTIITDITTSMEIWREEVFGPVLCVKEFSTEDEAIELANDTQYGLAGAVISGDRERCQRLSEEIDAGIIWVNCSQPCFCQAPWGGNKRSGFGRELGEGGIDNYLSVKQVTEYISDEPWGWYRSPSKL

SEQ ID NO: 8832 - protein, 168 aa, Zea mays
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 8833 - protein, 251 aa, Zea mays
  misc_feature (176)..(176): Xaa can be any naturally occurring amino acid
  misc_feature (249)..(249): Xaa can be any naturally occurring amino acid
MDRLVLFSRRRRRWILLAAAGAAAAVGAYKIYHHPAVAERRHRLVRLAAALAAIADAATSSADAAALVVSDLADFVRSDADEVPRSVKQLAKLAASPEVSATVSTLSEAVTSGMLRGAGSSSSGPGSGGTVALSDRFVDKLFSDSGERLASAVAGSFARHLVLAYYSAPSPQGGGXSSSPTVWVNVVATGKCRKAISTWVEVFVGTAVREFIDKTIHINTYEQIFEGLTNPKHDAKVKELLVSVCNSAXEI

SEQ ID NO: 8834 - protein, 559 aa, Zea mays
ANAVLQCLMCTKPLMIYLLLRLHSKDCNTIISNSCPHPLLEILMCTLYFFLFDLSYYFIGCSKNWCLMCELEQYASTLRESGGPLSPSRILSNLRNIGCRLGGGTQEDAHEFLRHLVMSMQAACLDGLGGEKHVEPSLQETTLIQQMFGGRLKSKVKCLRCYHESERYENIMDLTLEIHGWVESLQDALTQFTAPEDLDGDNMYKCGRCSAYVKARKQLSVHEVPNILTVVLKRFQSGKYGKINKCVTFPDMLDMVPFVTGSGDNPPLYFLYAVVVHVDTENASFSGHYISYVKDMQGTWLRIDDSEVQVVSVNQVMSEGAYMLFYMRSFPRPPRIYIEKGLPVTSAKRHTSKSSKGSKHDRKQTELLFPANDQAYGVYDFRPDGEGYAQDQHAELRSRAFHHADDAFADSVSADFSEATSSEWSLFTSSDESSFTTESTRDSFSVVDYGDNAGLDPISSIFGPSYAPEHGAPGSFVSRTRFSPSSPQTRYFSESTGFVSDSSMPAHPHGIVHRGRYPDSRACASSAEPLASAAHQRSGYGRYPLSRDGFVQTSGFCQM

SEQ ID NO: 8835 - protein, 176 aa, Zea mays
MVGKKRGIISPLDHLAGLLEVRVVRGVDLAIRDLRSSDPYVVLRIGKAQKVKTRVVKKSINPEWNEKLTLSIEDPAVPIRLEVFDKDTFVDDAMGNAEVDIRPLVEIVKMKLQGVADKTVVKKLVPNRQNCLAEESSIYISEGKVKQDLVVRLRNVECGEIELQLQWVHLPGSKGV

SEQ ID NO: 8836 - protein, 176 aa, Zea mays
MVGKKRGVISPLDHLAGLLEVRVVRGVDLAIRDLRSSDPYVVLRIGKAQKVKTRVVKKSINPEWNEELTLSIEDPAVPIRLEVFDKDTFVDDTMGNAEVDIRPLVEIVKMKLQGVADKTVVKKLVPNRQNCLAEESSIYISEGKVKQDLVVRLRNVECGEIELQLQWVHLPGSKGV

SEQ ID NO: 8837 - protein, 524 aa, Zea mays
  misc_feature (131)..(131): Xaa can be any naturally occurring amino acid
  misc_feature (138)..(138): Xaa can be any naturally occurring amino acid
  misc_feature (212)..(212): Xaa can be any naturally occurring amino acid
  misc_feature (222)..(222): Xaa can be any naturally occurring amino acid
  misc_feature (398)..(398): Xaa can be any naturally occurring amino acid
METASFLSVSQPAMETASFLSVALALAALVPVSLLLVNRLLYGKLPPGPRRRPVVGNLFDVQPVRCRCYQEWARRYGPIMTVWLGTSPTVVVSTSELAKEVLKTHDQQLADRCRDRSTESFSRGGQDLIWXDYGPHYXKVRKLCNLELFTQRRLEALRPIREDEVTAMVESVYKAVTAPGKPLVVKNHLSMVAFNNITRLAFGKRFVDAAGXLDEQGREFQXSSHNGIKIGASLSIAQHIPWLRWLAPVDEQAFKAHGERRDRLTVKIMEEHARALKQRGAQQHFVDALFTLRDKYDLSDDTVIGLLWDMITAGTDTTVISVEWAMAELLRNPRVQEKLQEELDRVVGRDRVLSETDFPNLPYLQAVVKESLRLHPPTPLMLPHRASASVKIAGYDIXPKGANVVVNVWAVARDPEVWDSPLEFRPERFLGENIDIKGADFRVLPFGAGRRVCPGAQLGINLVASMIGHMLHHFTWTLPSGTCPEDVSMMESPGLVTFMATPLQAVATPRLDKEELYRRVPSDV

SEQ ID NO: 8838 - protein, 443 aa, Zea mays
METASFLSVALALAALVPVSLLLVNRLLYGKLPPGPRRRPVVGNLFDVQPVRCRCYQEWARRYGPIMTVWLGTSPTVVVSTSELAKEVLKTHDQQLADRCRDRSTESFSRGGQDLIWADYGPHYIKVRKLCNLELFTQRRLEALRPIREDEVTAMVESVYKAVTAPGKPLVVKNHLSMVAFNNITRLAFGKRFVDATGELDEQGREFKGIVHNGIKIGASLSIAQHIPWLRWLAPVDEQAFKAHGERRDRLTVKIMEEHARALKQRGAQQHFVDALFTLRDKYDLSDDTVIGLLWDMITAGTDTTVISVEWAMAELLCKAANGMVSWWTSSRDPKVSTGPLEYRPERFLEETIDIKGSDFRVLPFGAGRRVCPGAQLGINLVASMIGHLLHHFEWSLPEGTRPEDVNMMESPGLVTFMGTPLQAVVKPRLEKEELYNRVPVEM

SEQ ID NO: 8839 - protein, 637 aa, Zea mays
MKFMKLGSKPDAFQTDGGGGDARYVLSDLPSDIVVHVDDARFYLHKFPLLSKSGLLQRLIVEASQNGSDEVAIQDVPGGAKTFEICAKFCYGMVVTLNAYNVVAARCAAEYLGMTEDVEKSNLVFKIEVFLSSGIFRSWKDSIIALQTTDALLPWSEELKLVGRCVDSVAAKATVSASNVVWSYTYNRKSASSDEIVEARRSSQAVPKDWWVEDLCELDVDLYRRVMVAVKSRGRIPSDAIGEALKAYAARWLPECCDALVDDAYSGAYKHLLETIVWLLPSDKGSSGISCRFFLKLLKFTVLVGAGELLKEELMDRTVLQLHKASVSDLLIPSRPPAQTVYDVQLVQTLIGRYMSHAGVSQGGIFLNDLDQEMFETNVDGESLLALCKLVDRYLAEVASDPNLSVSSFVDLATSMPETARPTHDGLYTAIDVYLKLHPGLPKMEKRKISNLMDVRKLSKGACIHAAQNDRLPLRVVVQVLFFEQLRAAGAAAAAGTPSASVARCIARLAEQEEEEERWNDGRALPEPPTPGALKRQLGSLKLQGDHHQGAGDDGRRLVARSNSVANQSSRMSLSSRSRRIFDRLWVGGAKLPGEAAAAGKGSSDTSGSSQSPRSSAKPPESKSSSSSSRNRRYSVS

SEQ ID NO: 8840 - protein, 63 aa, Zea mays
MAGGRVAHATLKGPSVVKEIFIGLTLGLIAGGMWKMHHWNEQRKTRSFYDMLDKGQIVVVVEE

SEQ ID NO: 8841 - protein, 170 aa, Zea mays
MAPTVMMASSATAVAPFQGLKSAASLPVARRSTRSLGNVSNGGRIRCMQVWPAYGNKKFETLSYLPPLSTDDLLKQVDYLLRNGWIPCLEFSKLGFVYRENSTSPCYYDGRYWTMWKLPMFGCNDATQVYKELQEAIKSYPDAFHRVIGFDNIKQTQCVSFIAYKPPGSD

SEQ ID NO: 8842 - protein, 170 aa, Zea mays
MAPTVMMASSATAVAPFQGLKSAASLPVARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 8843 - protein, 171 aa, Zea mays
  misc_feature (37)..(37): Xaa can be any naturally occurring amino acid
MAATAMMASSDTAGAAFQGLKCTVSLPIVRRSFRSLXGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 8844 - protein, 97 aa, Zea mays
NSRVKKKLWQKGIDPNTHKPLAEVTATKQVQLADVDQTIDPNEPTYCICHQISYGDMIACDNENCGGGEWFHYTCVGLTPETRFKGKWFCPTCRNLQ

SEQ ID NO: 8845 - protein, 201 aa, Zea mays
MWYINGANHLCSDHIREKDGIWAVLAWLSIIAFKNKDNLGGDKLVTVEDIVRQHWATYGRHYYTRYDYENVDAGAAKELMANLVSMQSSLSDVNKLVKEIRSDVSEVVAADEFEYKDPVDGSVSKHQGIRYLFGDGSRLVFRLSGTGSVGATIRVYIEQYERDSSKTGRDSQDALAPLVDVALKLSKMQEYTGRSAPTVIT

SEQ ID NO: 8846 - protein, 213 aa, Zea mays
MANTAKGKVCVTGASGFIASWLVKRLLESGYHVLGTVRDPASGKAWTYSDLKHVGATWQEEMLDSAINGTMNVLRSCKKNPSLKRVVLTSSSSTVRIKDEADLPPNVLLDESSWSSIEFCESLQIWYAVAKILAEKAAWEFAGEHRIDLVTVLPTFVVGPTLSPELGPTASDVLGLFQGETGKFTTYGRMGYVHIDDVARCHMLAYQAAGARG

SEQ ID NO: 8847 - protein, 169 aa, Zea mays
MNNIMGVKIQKTRYYVLVTSTGNVKIGDFSVSQVFEDDDDMLWRSPGTPVFTAPECCQGSAYHGRASDTWAVGVTLYCMVSGHYPFLGDTLQETYDKIANDPVQIPGDMNPQLADLLLRLLCKDPGDRITLQAAAEHPWVAGDEGPVPEFICRCGFGRRKRNDVREEVQ

SEQ ID NO: 8848 - protein, 240 aa, Zea mays
MDSTLFIIGVIGNIISVLVFISPIKTFWRIVRGGTTEEFEPAPYVLTLLNALLWLYYGLTKPDGFLVATVNGFGAVMEAIYVVLFIVYAANHATRVKTAKLAAALDIGGFGVVFAATTFAISEFELRIMVIGMICACLNVLMYGSPLASMKTVITTKSVEFMPFFLSFFLFLNGGVWATYAVLDRDIFLGIPNGIGFVLGTIQLIVYAIYMNSKASQCSKETASSPLLMASDRGEASSHV

SEQ ID NO: 8849 - protein, 522 aa, Zea mays
  misc_feature (179)..(179): Xaa can be any naturally occurring amino acid
MAPKKRKADPAESADAAEAAAGNHRQEPAPSEPKPRATIYFPITDDPPEPAAEEDEEDGAGDDEDDVEDIGKLLEPLSREQLVALLRTAAETSPATMAAVRRAVEADPASRKLFVHGLGWGASAEDLRSAFSCFGELEDCRVISDKQSGRSKGYGFVLFRSRRSALRALSRPQLQIGGXRLAFCHLAASGPAPPASQSQNPSSNTNTNANSNSNTTTNASGSSSSQPDNMPRKIFVGNVHADVDVDRLYNYFAQFGEIEEGPFGFDKNTGKPKGFALFVYKSVESARRALEEPMKNFDGKTLNVQKAIDGRTKGSSGTNTNANSNPTTASVAAAAAAAQMTAPATAAISPYDASAYGATAVPDMSFAQQAAMLGFGAQQQAFAQPNAMLAMIAAMQNPAALGMTPAMFAAMNPAFAAAALGAGGQQAQTAGLTGFGAQGFGTQAFGAGGAAFPNAAGVQAATAAYQGGGAPPGFQGPPGFQVGQATTQTSTAVAAAGYQAGAAGQGQVPGAQIGGTGFQGGY

SEQ ID NO: 8850 - protein, 178 aa, Zea mays
VGLAAVQLAVAAGCVVSATCGTQSIERVMGVGAEQAIDYTAEDTEAAIKGKFDAVLDTIGVPETERIGINVLRRGGHYMTLQGEAAALADRYGLAVGLPAATAVLLKKQMQYRYSHGIEYWWTYMRADAEGLHEIQRLSGAGKLQIPVEKTFPISHVREAHAAKEKKLAPGKVVLEFD

SEQ ID NO: 8851 - protein, 306 aa, Zea mays
MWWRAVRRRWVATARPASSAAAGAEKSCRAVVVPRFGGPEVLEVRQGMPVPDLKPQEVLVRARAVSINPLDLRMRCGYGRSIFEPLLPLIIGRDISGEVAATGTLASSFSIGQEVFGSLHPTALRGTYADYAILSLDELTLKPSTLSHVEASAIPFAALTAWRALHGTARISEGQRVLVIGGGGAVGLAAVQLAVAAGCVVSATCGTQSIERVMGVGAEQAIDYTAEDTEAAIKGKFDAVLDTIGVPETERIGINVLRRGGHYMTLQGEAAALADRYGLAVGLPAATAVLLKKQMQYRYSHGIEYL

SEQ ID NO: 8852 - protein, 53 aa, Zea mays
GRVGGRVGAFVIWSTRVCTRLLGELASSGDEHRGLIAYACWLVYMLFSLLVIF

SEQ ID NO: 8853 - protein, 132 aa, Zea mays
MAKEFPVPPVVFTPSTPTHRRHPPPGMGVSPPPAFAPPRPSTSSAANPLPFMSFDVSAAAASSSSAPPLFLYFVFSMLSGGRRGDLDLYRCVSLVGYCMLPMVIFSAVSLFLPRGGGFIFGVGMAFVIWSTR

SEQ ID NO: 8854 - protein, 202 aa, Zea mays
MKERPSDAKSRVEDIWKKMNSGFPNKMPKPAMTKLSTTEKQKKNKPTNNWMTVLGLSPSKAHSVDQGSKNGLQQTQHEMSEDAKKLAAKALAAAKNAAAVASGRGKVEITEVRDFAGKDIEIKKLVDANSKEAIEKARAGGAAPSAVDNILEQIRKKQKLSVLDKTKKDWGEYKEENRGLGEELDAYKKSSNQYLDKQSFLQ

SEQ ID NO: 8855 - protein, 276 aa, Zea mays
PFLFLNSSSTRRTTKRAAPIPHHLLGPEQQILEATGETFSRQLWGPWAQNGSHSGGGGGGGGGVNPSNGGTGAALRHDPGLAREWSTEEQTILDELLVKYASDLPVVRYAKVAMKLPEKTVRDVALRCRWMNKKESAKRKKEDHNSSKKSTDKKEKVSDSSSKPPVHMVGRPNVPPYPLPVLPMDDDEISSKAIGGPTGEILETNAHVLGQISSNLSNMQIQDNISLLCQTRDNILRVLKEINDAPDIMKQMPPLPVKINEELVNSLLPRPTVPMQ

SEQ ID NO: 8856 - protein, 505 aa, Zea mays
  misc_feature (242)..(242): Xaa can be any naturally occurring amino acid
VAAPVPSNGAFPKMPAFDYTPPPYNGPRAEIFRKRAQFLSPSLFHFYDRPLDIVEGKMQYLFDEDGRRYLDAFGGIATVCCGHWHPDVVEAIVNQAKRIQHSTVLYLNHAMKDFEGKMQYLFDEDVRRYLDAFGGIATVCCGHCHPDVVEAIVNQAKRIQHSTVLYLNHAIADFAEALASKMPGDLKVVFFTNSGTEANELALMIARLYTGCNDIISLRNGYHGNAAGTMGATAQSNWKFNXHHALDPDPFRGAFGSDGEKYARDVQEIIEFGTTGRVGGFISEAIQGVGGIVELAPGYLPVAYSMVRKAGGLCIADEVQAGVARTGSHFWGFEGHGVIPDIVTMAKGIGNGIPIGAVVTTPEIAQVLTRKSYFNRSTFDGNPVSTAGGHAVLKVLEKEKLQENAFVVGSYLKEQLNNLKDKHEIIGDVRGKGFLLGVELVTDREKKTPAKAEISRVMNHMKDMGVLVGKGGFYGNVFRITPPLCFTKEDSDFFIEVMDIALSKL

SEQ ID NO: 8857 - protein, 477 aa, Zea mays
MQRLASSRRLLQAALAPARANSSLSAAAVAAPAPANGAFPKMPAFDYTPPPYDGPRAEEIFRKRAQFLSPSLFHFYDRPLNIVEGKMQYLFDEDGRRYLDAFGGIATVCCGHCHPDVVEAIVNQAKRIQHSTVLYLNHAIADFAEALASKMPGDLKVVFFTNSGTEANELALMIARLYTGCNDIISLRNGYHGNAAGTMGATAQSNWKFNVVQTGVHHALNPDPFRGAFGSDGEKYARDVQEIIEFGTTGRVGGFISEAIQGVGGIVELAPGYLPVAYSMVRKAGGLCIADEVQAGVARTGSHFWGFEGHGVIPDIVTMAKGIGNGIPIGAVVTTPEIAQVLTRRSYFNTFGGNPVSTAGGHAVLKVLEKEKLQENAFVVGSYLKEQLNNLKDKHEIIGDVRGKGFLLGVELVTDHEKKTPAKAEISRVMNHMKDMGVLVGKGGFYGNVFRITPPLCFTKEDSDFFIEVMDIALSKL

SEQ ID NO: 8858 - protein, 479 aa, Zea mays
  misc_feature (200)..(200): Xaa can be any naturally occurring amino acid
  misc_feature (322)..(322): Xaa can be any naturally occurring amino acid
MQRLASSRRLLQAALAPARANSSLSAAAVAAPAPANGAFPKMPAFDYTPPPYDGPRAEEIFRKRAQFLSPSLFHFYDRPLNIVEGKMQYLFDEDGRRYLDAFGGIATVCCGHCHPDVVEAIVNQAKRIQHSTVLYLNHAIADFAEALASKMPGDLKVVFFTNSGTEANELALMIARLYTGCNDIISLRNGYHGNAAGTMXGATAQSNWKFNVVQTGVHHALNPDPFRGAFGSDGEKYARDVQEIIEFGTTGRVGGFISEAIQGVGGIVELAPGYLPVAYSMVRKAGGLCIADEVQAGVARTGSHFWGFEGHGVIPDIVTMAXKGIGNGIPIGAVVTTPEIAQVLTRRSYFNTFGGNPVSTAGGHAVLKVLEKEKLQENAFVVGSYLKEQLNNLKDKHEIIGDVRGKGFLLGVELVTDHEKKTPAKAEISRVMNHMKDMGVLVGKGGFYGNVFRITPPLCFTKEDSDFFIEVMDIALSKL

SEQ ID NO: 8859 - protein, 480 aa, Zea mays
  misc_feature (180)..(180): Xaa can be any naturally occurring amino acid
  misc_feature (208)..(208): Xaa can be any naturally occurring amino acid
MQRLASSRRLLQAALAPARANSSLSAAAVAAPAPANGAFPKMPAFDYTPPPYDGPRAEEIFRKRAQFLSPSLFHFYDRPLDIVEGKMQYLFDEDGRRYLDAFGGIATVCCGHWHPDVVEAIVNQAKRIQHSTVLYLNHAIADFAEALASKMPGDLKVVFFTNSGTEANELALMIARLYTXGCNDIISLRNGYHGNAAGTMGATAQSNXKFNVVQTGVHHALNPDPFRGAFGSDGEKYARDVQEIIEFGTTGRVGGFISEAIQGVGGIVELAPGYLPVAYSMVRKAGGLCIADEVQAGVARTGSHFWGFEGHGVIPDIVTMAKGIGNGIPIGAVVTTPEIAQVLTRRSYFNRSTFAGNPVSTAGGHAVLKVLEKEKLQENAFVVGSYLKEQLNNLKDKHEIIGDVRGKGFLLGVELVTDREKKTPAKAEISRVMNHMKDMGVLVGKGGFYGNVFRITPPLCFTKEDSDFFIEVMDIALSKL

SEQ ID NO: 8860 - protein, 84 aa, Zea mays
  misc_feature (46)..(46): Xaa can be any naturally occurring amino acid
  misc_feature (57)..(57): Xaa can be any naturally occurring amino acid
QLFEGQVSYDGERTFCCVKGPARCNTWGNCIDSTLSAETVFPVEVXKLKAHQFKPTXQVTLDPYKHDHACLVGGYRMPKKQKAI

SEQ ID NO: 8861 - protein, 61 aa, Zea mays
  misc_feature (34)..(34): Xaa can be any naturally occurring amino acid
MTTRGNCIDSTLSAETVFAVEVGEVQSTSIQVCXQVTLEPYEHDHACVVGGYRMPKKQKAT

SEQ ID NO: 8862 - protein, 558 aa, Zea mays
  misc_feature (156)..(156): Xaa can be any naturally occurring amino acid
  misc_feature (232)..(232): Xaa can be any naturally occurring amino acid
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLLLKGVSERGAXKKIRVHILTDGRDVLDGSSVGFVETLENDLLELRGKGIDAQIASGGGRMYVTMDRYENDWDVVKRGWDAQVLGEAXPYKFKSALEAVKTLRAQPKANDQYLPPFVIVDDSGKAVGPVLDGDAVVTINFRADRMVMLAKALEYADFNNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILDAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 8863 - protein, 178 aa, Zea mays
SSSCLGKGKSRSKRFRWRWRARGRFLTTRSSPREAGGCRRAGRIFAQGAKLVDQALASGKIYDGDGFNYIKESFENGTLHLIGLLSDGGVHSRLDQLQLLLKGVSERGAKKIRVHILTDGRDVLDGSSVGFVETLENDLLELRGKGIDAQIASGGGRMYVTMDRYENDWDVVKRGWDA

SEQ ID NO: 8864 - protein, 90 aa, Zea mays
  misc_feature (36)..(36): Xaa can be any naturally occurring amino acid
ALCTLREVFEGVHRRVGFNVELKFDDDLFYTEERLXHPKIRLKLSSSTPTTAIIFSSFQPDAAQSSELKTYLCSSDNEDECSDRSNRWRG

SEQ ID NO: 8865 - protein, 160 aa, Zea mays
  misc_feature (114)..(114): Xaa can be any naturally occurring amino acid
  misc_feature (124)..(124): Xaa can be any naturally occurring amino acid
MSKMAEEKAAAVGGLGGAGAADAAQQQQLAAGEAAAARVRPVETLLRAAPLGLCVAAMTVMLRNQQSNEYGAVAYSDLGGFKYLVYANGLCAAYSLVSRVLPCRGRGPATVARXSWVVSLLQQXSPYLILGGGAQGGGNLFNPPNTGTRGGPREETLGVF

SEQ ID NO: 8866 - protein, 257 aa, Zea mays
RVIFQVGWAFYCRGASNKRLFSKEHVTVAPVITVRGLRTAFGDHVVHDNLDLTVFPGEILVLVGGSGTGKTVLLRQIIGLDRPAAGTIRVLGSTLSELTPSERRRLSYRWGMLFQAGALFSALSVYDNVALPLRELRTVPEDLVHDVVMCRLAMVGLSAQDADKRPSDLSGGMIKRVALARALSLDPELVFLDEPTAGLDPLRSDEFVDLVRSLHRQLGFTVVMVTHDLDTLLALATRVAVLADKRVIVCDTVPEVL

SEQ ID NO: 8867 - protein, 124 aa, Zea mays
  misc_feature (11)..(11): Xaa can be any naturally occurring amino acid
  misc_feature (18)..(18): Xaa can be any naturally occurring amino acid
  misc_feature (40)..(41): Xaa can be any naturally occurring amino acid
MAYSMLSSAAXCYLPGSXHMVAPFTGLKSSSAFPVTGRAXXDLTLLVSNGEKVNWMEGGPQLGKKNFETLFLTFRDLYPKFKLGGGEGEKLFSPKKGGVPLGGEEIPRGGEHPFFFFGPRGETQ

SEQ ID NO: 8868 - protein, 325 aa, Zea mays
  misc_feature (263)..(263): Xaa can be any naturally occurring amino acid
  misc_feature (291)..(291): Xaa can be any naturally occurring amino acid
  misc_feature (319)..(319): Xaa can be any naturally occurring amino acid
SPTRPSAITTFPSTAQIVPEPLGVVLVISAWNYPFLLSIEPVIGAIAAGNAVVLKPSELAPATSSLFAKLLPEYVDSSCIKVVEGGVTETGALLQQKWDKIFYTGNGNVARVVLAAAAKHLTPVALELGGKCPVIVDSNVDLRVAAKRIAVGKWGCNNGQACIAPDYIITTKAFVTELVDSLKRVLERFYGEDPLQSADLSRIVSISHFERLAKLIEDKEVATKIQLGGQTDQEQLKIAPTVLVDVPLDTELMTGEIFGPMLXIITVDKIEESITHINAGAKPLAAYLFTXDQKLQQDFVSNVSAGGMLVNDVALHLTXHILPFG

SEQ ID NO: 8869 - protein, 167 aa, Zea mays
MASSGSGGGSPGSPCGACKFLRRKCAAECVFAPHFCAEDGAAQFAAIHKVFGASNAAKLLQQVAPADRSEAAATVTYEAQARLRDPIYGCVAHIFALQQQVASLQMQVLQAKAQVAQTMAAAGPQGGSSPLLQRWPLEPESLSTQSSGCYSDMYCGFGDQEEGSYTR

SEQ ID NO: 8870 - protein, 158 aa, Zea mays
  misc_feature (125)..(125): Xaa can be any naturally occurring amino acid
MPSSTFSGTVSSPKLSVAVDTGNPFLNLTVDGFLKIGAVGVTKSLVEDTYKAIDKGSVSKSTLEHALKKMCKEGVYWGSVAGVYVGTEYGIERIRGTRDWKNAMLAGAATGAVISAATNKGKDKXVIDAHYGWALLQAARPGSLNNHYLLTGVSIPSF

SEQ ID NO: 8871 - protein, 96 aa, Zea mays
  misc_feature (30)..(30): Xaa can be any naturally occurring amino acid
  misc_feature (41)..(42): Xaa can be any naturally occurring amino acid
  misc_feature (48)..(48): Xaa can be any naturally occurring amino acid
  misc_feature (51)..(51): Xaa can be any naturally occurring amino acid
  misc_feature (55)..(56): Xaa can be any naturally occurring amino acid
  misc_feature (59)..(59): Xaa can be any naturally occurring amino acid
  misc_feature (62)..(62): Xaa can be any naturally occurring amino acid
  misc_feature (67)..(67): Xaa can be any naturally occurring amino acid
  misc_feature (75)..(75): Xaa can be any naturally occurring amino acid
  misc_feature (83)..(83): Xaa can be any naturally occurring amino acid
  misc_feature (87)..(87): Xaa can be any naturally occurring amino acid
KNPSHVTLSACTHERITRRLRAERPRPVGXIRARMEHYLYXXEKKHVXAGXAIFXXVFXVPXHFMTXGAKHLSHXDYLEKATXARSXRLSFWTICH

SEQ ID NO: 8872 - protein, 224 aa, Zea mays
MASSMLSSAAVVTSPAQATMVAPFTGLKSSAAFPVTRKANNDITSIASNGGRVSCMKVWPPVGKKKFETLSYLPDLTEVELGKEVDYFLRNKWIPCVEFELYHGFGYREHGSTPEYYDGSYWTMWKSPPCWKDWTLLRGLKGSPKMGKTENPNRFSYGKNSGFEKTTPQGSGGSFFFPPKKTTPNFPRGGFIFFCKKPPSKKKTPRRVFFLLSTGAGGVFFSHR

SEQ ID NO: 8873 - protein, 181 aa, Zea mays
MAYSMLSSAAVVTSPAQATMVAPFTGLKSSSAFPVTRKANNDITSIVSNGGRVSCMQVWPPIGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 8874 - protein, 204 aa, Zea mays
MASSMLSSAAVATSPAQATMVAPFTGLKSSAAFPVTRKSNTDITSIASNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGCLISFQKQPKKNPNPFPFPMAGFT

SEQ ID NO: 8875 - protein, 188 aa, Zea mays
  misc_feature (82)..(82): Xaa can be any naturally occurring amino acid
  misc_feature (104)..(104): Xaa can be any naturally occurring amino acid
  misc_feature (118)..(118): Xaa can be any naturally occurring amino acid
  misc_feature (132)..(132): Xaa can be any naturally occurring amino acid
  misc_feature (149)..(149): Xaa can be any naturally occurring amino acid
MASSMLSSAAVVTSPAQATMVAPFTGLKSSAAFPVTRKANNDITSIASNGGRVSCMKVWPPVGKKKFETLSYLPDLTEVELXKEVDYLLRNKWIPCVEFELEQXDFVYREHGSTPGYXIDGRYWTMWKLPLXFGCTDSAPRGLKEVQEXKTEYPNAFIRDSSIEQTGPGSKGASFSSPTNHKGFPGGV

SEQ ID NO: 8876 - protein, 199 aa, Zea mays
  misc_feature (62)..(62): Xaa can be any naturally occurring amino acid
  misc_feature (74)..(74): Xaa can be any naturally occurring amino acid
  misc_feature (80)..(81): Xaa can be any naturally occurring amino acid
MAYSMLSSAAVVTSPAQATMVAPFTGLKSSSAFPVTRKANNDITSIVSNGGRVSCMKVWPPXGKRKFETLSYLXPDLTEXXNWVRKVDYLSPATGGFLGGESRVGATGFGYRGSTGKHPPETTKGRYWEKGETFPLGRKGPHLWLKGVKEAPKGEKGEPPNRLSTGILGFQNTPGEAGGSCFFPPKKTTNFSGGLKLPL

SEQ ID NO: 8877 - protein, 141 aa, Zea mays
  misc_feature (120)..(120): Xaa can be any naturally occurring amino acid
  misc_feature (131)..(131): Xaa can be any naturally occurring amino acid
MASSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGTTPGYYDGXRYGTMWKLPLXFGGTDSASRV

SEQ ID NO: 8878 - protein, 198 aa, Zea mays
  misc_feature (83)..(83): Xaa can be any naturally occurring amino acid
MASSMLSSAAVVTSPAQATMGAPFTGLKSSAAFPVTRKANNDITSIASNGGRVSCMKVCPPAAKKKFETLSYLPDLTELELGXGEVDYLLRNKWIPCVEIRCWKHGILCNREHGSTPRNTTRARYWTMWEAFPLFRMALNSWLQGVERKTPKKGRNREVTPKTLPLHQGILRDFNTTTRPRPQGDSSFQSPQTSPHKL

SEQ ID NO: 8879 - protein, 181 aa, Zea mays
MASSMLSSAAVVTSPAQATMVAPFTGLKSSAAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 8880 - protein, 175 aa, Zea mays
MGKKRGIISPLDHLAGLLEVRVVRGVDLAIRDLRSSDPYVVLRIGKAQKVKTRVVKKSINPEWNEKLTLSIEDPAVPIRLEVFDKDTFVDDAMGNAEVDIRPLVEIVKMKLQGVADKTVVKKLVPNRQNCLAEESSIYISEGKVKQDLVVRLRNVECGEIELQLQWVHLPGSKGV

SEQ ID NO: 8881 - protein, 221 aa, Zea mays
  misc_feature (3)..(3): Xaa can be any naturally occurring amino acid
  misc_feature (10)..(11): Xaa can be any naturally occurring amino acid
  misc_feature (14)..(14): Xaa can be any naturally occurring amino acid
  misc_feature (24)..(24): Xaa can be any naturally occurring amino acid
MAXDDQDDDXXYSXYDEAQDGRKXPEIVCRHLDHVNMLGLSKTTLRLRYLINWLVTSLLQLRLPDSGDGEGAAAAAATPLVYIYGPKIKYDRGAAVAFNVKDCGSGTSLINPETVQKLAEKEGLSLGVGFLSHIRLTDSQRHGAADVGLSSSSSPAAASGRREKKSTRKNAVVGTEVVTASLGFLTNFEDVYRLWAFVAKFLDSSFLEQERLSSIPEDAER

SEQ ID NO: 8882 - protein, 95 aa, Zea mays
  misc_feature (26)..(26): Xaa can be any naturally occurring amino acid
  misc_feature (34)..(34): Xaa can be any naturally occurring amino acid
  misc_feature (40)..(40): Xaa can be any naturally occurring amino acid
  misc_feature (80)..(80): Xaa can be any naturally occurring amino acid
MFATNRRRTGGGDRPDQWKEGASTPXEGGGRKIXENKLSXKKSRWTPYGNTKCIICKQQVHQDGKYCHTCAYSKGVCAMXGKQVLDTKLYKQSNV

SEQ ID NO: 8883 - protein, 418 aa, Zea mays
MSCLCWFKRRSRKGRSSSSGKRGASSTATVSVSGPATATTTTTTTASAESTSRSDDSGAVRPVSKSAGSSQSQRSISSLYEERGHGQLRVFDYDELQGATAEFGRAQKLGEGGFGSVYKGFIRAADGKGDRVPVAVKKLNQRGMQGHKQWLAEVQFLGVLEHPNLVKLLGYCAVDSERGAQRLLVYEFMPNKSLEDHLFRRANPPLPWNRRLQVILGAAEGLAYLHEGEVQVIYRDFKASNVLLDNEFKPKLSDFGLAREGPTEGKTHVSTAVVGTHGYAAPDYMETGHLTVKSDVWSFGVVLYEILTGRRSLERNSPAAEQKLLEWVAQFPPDSRNFRMIMDPRLRGEYSVKAAREIAKLADSCLLKNAKERPTMSEVVEVLGRAVQAHAEPDSGAPGPGAKGKKTDAATPSRRRRD

SEQ ID NO: 8884 - protein, 438 aa, Zea mays
  misc_feature (342)..(342): Xaa can be any naturally occurring amino acid
MDIEADGRFGNKRVHNRLGPGSGGAPPSTNGKVCNYWRAGRCNRFPCPFLHSELPEAAPPKRPTGPGGNVWRNPNTGGRGGGHHNRWGKGPGGGSGIASHKPPERPCKYFLAGTECSYGERCRYPHSYCISDSIAMLTLLKGHEQGVTGIALPAGSDKLYSGSKDGTVRMWDCQTGQCAGVITMGREVGCMIIEGPWLFVGIPDAVKVWNMQTAAEMSLTGPTGQVYALAVASELLFAATQAGRILAWRFSAATNCFEPAASLDGHKLAVVSLIVGGMRLYSASMDKTIRVWDLATLQCIQTLSDHTDVVMSVLCWDQFLLSCSLDQTIKVIRHLHHHFVEXWAATESGNLEVTYTHKEDQGALALSGMPDAQSKPVLLCSLNDNTVRLYDLPSFSDRGRLFSKKEIRAIQMGPGGLFFTGDGTGELKVWQWVDLAQT

SEQ ID NO: 8885 - protein, 375 aa, Zea mays
  misc_feature (66)..(66): Xaa can be any naturally occurring amino acid
  misc_feature (74)..(74): Xaa can be any naturally occurring amino acid
MLEHHKKKHRSLESRGADFDAERRLYSHAFKKSSSLLSRLMKHKFGWVFNKPVDPTLGLHDYFTIXKHPMDLGXTIRGRLSRGQYRNPKEFAEDVRLTFHNAMTYNPKGQDVHFMAEQLSGIFEAQWPEIEAEVNYLASCPPLPKKFPPPPIDLHFLERSDSMRHHMALDTNSRPISHTPTYTRTPSMKKPRAKDPNKRDMTIDEKRKLSENLQNLPPVKLDAVVQVIKNKNLSVKQHDDEIEVEIDSMDAETLWELDRFVSNYKKNLSKQKRKAERAMLARQDAELRAQHPIQQPQPTPVPQEPFGEKSPKQVVKDSLEGEQLPASAPEQNGENRQNASSSSNSSSSSSGSGSSSSGSDSDSSSSDGSDAGNSS

SEQ ID NO: 8886 - protein, 166 aa, Zea mays
  misc_feature (46)..(46): Xaa can be any naturally occurring amino acid
  misc_feature (55)..(55): Xaa can be any naturally occurring amino acid
  misc_feature (97)..(97): Xaa can be any naturally occurring amino acid
  misc_feature (118)..(118): Xaa can be any naturally occurring amino acid
MLVYTDLLTGDELLSDSFPYKEIENGILWESEGKWTTKGCVEVNIXANPSAEEGXEDEGVDDSVEKVVDIVDTFRLQEQPTYDKRGFIAYIKKYIKXLLTPNLTRGQEEKFKKGIEGXATSSFLPSSKDFQFFVWGGHGPMTALFVFANYQGGGSKPTFFELSHWV

SEQ ID NO: 8887 - protein, 153 aa, Zea mays
MLALPWRSEVRRAPQNAGACVVAKPQGQSECAFDSLVLQLGFRGFLGAEREAAAAMAAAGEEIAVKEPLDLIRLSLDERIYVKLRSDRELRGKLHAYDQHLNMILGDVEEVVTTVEIDDETYEEIVRTTKRTIPFLFVRGDGVILVSPPLRTA

SEQ ID NO: 8888 - protein, 301 aa, Zea mays
  misc_feature (277)..(277): Xaa can be any naturally occurring amino acid
MAMPVALVLAALLLSAAAPALAHTPSCPDGWQISPDRLKCFMHISSSLSWDGSEALCRNFSGHLAALSSVQELNFARSLCGAASSGCWVGGRRHNTTGSVGGWKWSDNSSSWNETAFPGEPLHPNCTGARCGLAASDDMCTLVTSKHTALTGKKCAESHGLICMMNHEDRCYHDHCHKEYFIVLIVVSGLILSTTLAVVVWLLVYKRSKKRKRSREASGASATALVPPLWKVFNSEELRSITKNFSEGNRLPGNAKTGGTYSGTLPDGSKLAIKKIXKRSSLQRKKDFYSEINKVAKLYHP

SEQ ID NO: 8889 - protein, 290 aa, Zea mays
  misc_feature (178)..(178): Xaa can be any naturally occurring amino acid
  misc_feature (215)..(215): Xaa can be any naturally occurring amino acid
  misc_feature (220)..(220): Xaa can be any naturally occurring amino acid
  misc_feature (227)..(227): Xaa can be any naturally occurring amino acid
  misc_feature (234)..(234): Xaa can be any naturally occurring amino acid
  misc_feature (243)..(243): Xaa can be any naturally occurring amino acid
FLPPGCRPPPPPPTLRSDNQEMSKEELRRQHQAELARQKNEETARRLAGVGTGSGDGRGPARASNELVAYKNVNDVPFVRDLVIQVDQKNEAVLLPIYGSMVPFHVSTVKSVTSHQDNRTCTIRIFFNVPGMPFSNDSKFNSQGAIYLKEITFRSKDPRHNSEVVQHIKTLRRQGGFXGSQRELKGPILVTQEKLQIGSNRMKMMRLSDVWIRPXAFGGXGRNLTGXLEAHFNXGFRYSTSRXSDETCRTSWFGNIKACPFFPPCQRTEKDLLSFPFPILDTPLFLGLRK

SEQ ID NO: 8890 - protein, 167 aa, Zea mays
MEYGQQGQRGHGATGHVDQYGNPVGGVEHGTGGMRHGTGTGGMGQLGEHGGAGMGGGQFQPAREEHKTGGILHRSGSSSSSSSEDDGMGGRRKKGIKEKIKEKLPGGHKDDQHATATTGGAYGQQGHTGSAYGQQGHTGGAYATGTEGTGEKKGIMDKIKEKLPGQH

SEQ ID NO: 8891 - protein, 410 aa, Zea mays
  misc_feature (2)..(3): Xaa can be any naturally occurring amino acid
LXXGAIAGIAIGSVFGVLLLLALLFFLCRKRSSAPRSAAAAAEKGRELGMGPMDVEPKGQNGSAGGHNGVAAAVAVPTAAAAAAVATAAAKTGGSTGSKKLIFFGPMAAAPPFDLEDLLRASAEVLGKGAFGTAYKAVMENGSAVAVKRLKDVDLPEPEFRERIAAIGAVQHELVVPLRAYYFSKDEKLLVYDYMSMGSLSALLHGNRASGRTPLDWETRSAVALAAARGVAHIHSTGPTASHGNIKSSNVLLTKNYEARVSDHGLPTLVGPSFSPTRVSGYRAPEVTDIRRVSQKADVYSFGVLLLELLTGKAPTHAVVNEEGLDLPRWVQSVVREEWTAEVFDQELLRYQNVEEEMVQLLQLAIDCSAQHPDRRPAMSEVATRIDEIRRSSLGDRQVADSAEGDEPSL

SEQ ID NO: 8892 - protein, 173 aa, Zea mays
  misc_feature (144)..(144): Xaa can be any naturally occurring amino acid
MADQQRSGHNTSDSRRKSAAGRRTSQHTTTSSLSSGGGAMAAAATTGTGTVSPCGACKFLRRKCVSGCIFAPHFGSDQGAARFAAVHKVFGASNVSKLLHHIPVNRRHDAVVTISYEAQARLSDPVYGCVSTILALQQQVASLXQAELSLVQSQLINSRSPKWATVMQPKPQL

SEQ ID NO: 8893 - protein, 831 aa, Zea mays
MAAEYAWLPLIPPNLQPFNGNSQFAYGVNFASGGAGALVGTFSGLVINLRTQLNNFKKVEEMLRSKLGDAEGKRVISRAVYLFHIGLNDYQYPFTTNSSLFQSISNEKYVDYVVGNMTDVFKEVYNLGGRKFGILNTGPYDCAPASLVIDQTKIRSCFQPVTELINMHNEKLLNGLRRLNHELSGFKYALHDYHTSLSERMNDPSKYGFLSKPFTKQENTVIQTCVVSCYGLAYSGGFGSYLIAMDERTYKLIGSDYPGNNPEDVINPGLWWMTGFLFVVSFLGLFCLVPLRKVMILDYKLTYPSGTATAMLINSFHNNTGAELAGKQVKCLGKYLSLSLVWSCFKWFFSGIGGACGFDHFPTLGLTLFKNTFYFDFSPTFIGCGMICPHLVNCSVLLGAIISWGFLWPFISQHAGDWYPADLKANDFKGLYGYKVFIAISIILGDGLYNLIKIIVVTVKEICNKSSRQHNLPVFTDILDKSKTSVLMREKKKRDIIFLKDRIPLEFAVSGYVGLAAISTAIIPLIFPPLKWYFVLCSYLVAPGLAFCNSYGAGLTDMSMPSTYGKTGLFIVASIVGNNGGVIAGLAACGIMMSIVSTAADLMQDFKTGYLTLSSAKSMFVTQLLGTAMGCIIAPLTFWLFWTAFDIGDPDGLYKAPYAVIYREMAILGVEGFAKLPKHCLALCCGFFIAALIVNLIRDMTPPKISKLIPLPMAMAGPFYIGAYFAIDMFVGTVIMLVWERMNKKDADDYSGAVASAPEPVTYVCGDCGQENTLKSGDVIQCRECGYRILYKKRTRRDVVNLFPANLFDGLFSCSCSIRSSLRTTTPEGGS

SEQ ID NO: 8894 - protein, 126 aa, Zea mays
YKVIYDLIDDLRKAMEGLLEPAEEEVPIGSAKVRAVFSSGSGKVAGCMITTGKVVQDCNVRVLRKGKEVYVGSLDSLRRVKETVKEVGAGLECGIGVDDFDEWEEGDIIEAFNTVNKLNGELKLLC

SEQ ID NO: 8895 - protein, 522 aa, Zea mays
  misc_feature (321)..(321): Xaa can be any naturally occurring amino acid
HCYFCLQTTLLDYIRKSKLVISDLEPAGPGIGAYQVLLPVDGNHQACVFLDTPGHEAFGAMRARGARVTDICIVVVAADDGVRPQTSEAIAHARAAGVPIIIAINKIDKEGANAERVMQELSQIGIMPEMWGGDTPMIEISALTGDNVDELLETVMLVAELQELKANPHRNAKGTVIEACLDKAKGPLATLVVQNGTLNKADIIVCGEAYGKIRALYDDCGKLVDKAGPSNAVQVIGLNNVPLAGDEFEVVDNLDVARERANGRAEALRIERISAKAGEGKVTLSAIAASVSSAKQVGIDTHELNVILKVDFQGSIEAIRXQAIQTLPQENVSLRFLLQGPGDVSVSDVDLAVASEGIIFGFNVRAPGSVKNYAKKKGVEIRMYKVIYDLIDDLRKAMEGLLEPAEEEVPIGSAKVRAVFSSGSGKVAGCMITTGKVVQDCNVRVLRKGKEVYVGSLDSLRRVKETVKEVGAGLECGIGVDDFDEWEEGDIIEAFNTVNKARTLEEASATVTAALKDAGVQL

SEQ ID NO: 8896 - protein, 500 aa, Zea mays
  misc_feature (239)..(239): Xaa can be any naturally occurring amino acid
MGSSSSHQRSKTRSRNRKPLGIQLLERVRGSPISFRSCQALVLVLTFLSYASYHATRKTTSVVKSVLDPKTKTNLGTSSAHYWPPSHLFYLHNLKDADNSSSSGGGWAPFNAAEDGTALLGEIDLAFLGAYAAGMFFAGHLGDRVDLRVLLTVGMVGTGLFTAAFGAGYWLDVHSFYYFLAVQMVAGLFQSSGWPSVVAVVGNWFGKSKRGLIMGVWNAHTSVGNISGSLIAAAMLRRXDLCLEDDEKKPSDMDAPLLERERRRADVEEMAVGFIEAWRIPGVAPFALCLFFCKLVAYTFLYWLPFYISHTAIGGEYLSDSAAGVLSTLFDVGGVLGGVLAGHISDRLNARAITAASFTYCAIPALFLYRAYGSMSMAWNIALMFVTGMLVNGPYALITTAVSADLGTHSSLNGNSRALATVTAIIDGTGSIGAAVGPLLTGYISARSWSAVFTMLMASALVAGLLLSRLVAAEVVAKMESRRTPAPADSDLPVSSMDEP

SEQ ID NO: 8897 - protein, 503 aa, Zea mays
MLMSHSQQMANSRKPPGLRLLGGAGSLRTYQTLVLVLTFLAYTCFHMTRKIPSIVKSALDPQTKVGFSHWGRLHASRNALTTGWLPFNTADGSALLGEIDVAFLAAYSVGMFFAGHIGDRMDLRVFLTVGMAGTAVFTTLFGAGYWLNVHSFYYFLVIQMVSGLFQSVGWPSVVAVVGNWFGKSKRGLIMGIWNAHTSVGNIAGSLLAAFLLKFGWGWSFAVPSLIMALVGLMVYVFLPVSPEAMEIDSDGGELNCEKDAVKEPLLEPGQEVKHSAVGFLEAWRIPGVAPFALCLFFSKLVAYTFLYWLPFYISHTRIGGEYLSDAMAGSLSTIFDVGGVLGGVLAGHISDRLNARAITAASFTYCAIPALFLYRTYGSMSMAWNVSLMFVTGMFVNGPYALITTAVSADLGTHSSLNGNSRALATVTAIIDGTGSVGAAIGPLVTGYVSSRSWSAVFTMLMAAALLAGLLLSKLVCAELQGKTHSSVSKDAGGEHGAYSDEV

SEQ ID NO: 8898 - protein, 152 aa, Zea mays
  misc_feature (18)..(18): Xaa can be any naturally occurring amino acid
  misc_feature (27)..(27): Xaa can be any naturally occurring amino acid
  misc_feature (63)..(63): Xaa can be any naturally occurring amino acid
  misc_feature (93)..(93): Xaa can be any naturally occurring amino acid
  misc_feature (109)..(109): Xaa can be any naturally occurring amino acid
PSRECPLVVSNYHQDAYXPRETCIRNXLVECCLTASKLPLYMFKLTPNKVSQEDAASSSYLSXILLSEWEDRMTRRLFRYDATDCETKVIPGXFGIVAQLTERRHLKNXPTVLRVDRVIQPLDPDNISFTEVAQALGSLQIEKRAGDDTYLL

SEQ ID NO: 8899 - protein, 88 aa, Zea mays
TTRSRDLEYLFGKYGRIREVELKRDYAFIEFSEHRDADEARYQLDGRDVDGSRIVVEFAKGVPRGSGGSREYMGRGPPPGIGPPRLYD

SEQ ID NO: 8900 - protein, 93 aa, Zea mays
  misc_feature (56)..(56): Xaa can be any naturally occurring amino acid
RERSLVIWSGRPGNCKSATMEAMAAVFGVTVQFIDQELLRFIAGGKLHCTIYRGAXGLSIPRCDARNAFYQATMKQGDLLLNRLQKLARVIDL

SEQ ID NO: 8901 - protein, 147 aa, Zea mays
  misc_feature (27)..(27): Xaa can be any naturally occurring amino acid
  misc_feature (42)..(42): Xaa can be any naturally occurring amino acid
  misc_feature (59)..(59): Xaa can be any naturally occurring amino acid
  misc_feature (77)..(77): Xaa can be any naturally occurring amino acid
  misc_feature (118)..(118): Xaa can be any naturally occurring amino acid
MRAAEIDSERRPGRSSDEWHADLLASXSKPALCFKDLFFPCXTFLKIASIAKDRPITFXKACHYNMAYSLIMSCCCXTICVRKKLCPKLDLSGGFFYDFLFHFLCWFCALGQKWPEIXISGAYNEKTKVSPPAFPYIEPLTTVLPFG

SEQ ID NO: 8902 - protein, 116 aa, Zea mays
MAARCSSLSSPSLSVHGPLRRNKPSKRLAPCLPSSPRPGAAALRARAAKLPPGVEAPRVQPKLSEPFLGFTQTAEIWNSRACMIGLIGTFIVELVLNKGILQMIGVEVGKGLDLPL

SEQ ID NO: 8903 - protein, 115 aa, Zea mays
MAARCSLSSPSLSVHGPLRRNKPSKRLAPCLPSAPRPGAAALRARAAKLPPGVEAPRVQPKLSEPFLGFTQTAEIWNSRACMIGLIGTFIVELVLNKGILQMIGVEVGKGLDLPL

SEQ ID NO: 8904 - protein, 479 aa, Zea mays
METYTTDDALTLMGFGKFQALVLAYAGMGWVAEAMEVMLLSFLGPVVREEWNVSPQDESLLSSVVFAGMLIGACAWGFISDRYGRKTVLLLSTLLTSGLGLLSALSINYLCLLVLRFFVGIGVGSGHVFSSWFLEFVPAGNRGTWMVIFSFFWTIGTVLEASLAWAVLSALSWRWLLALSSLPCFLLLLFFRITPESPRYLCAQNRMTDARFVLERMAIANQAALPMGVLTYHQETKTECITHVSEDEHLIPVREKEHTDRNAISSKSGAVAVLHKLLSHNLLKSTLLLWFVYYASSFAYYGITLLTSQLSDVNRSCKSDLVFEVHQNNGNLYKDTFITSLAEIPGLILSALLVDRFGRKATMSCLMFACCAFLGPLVLHQNELLTTTLLFGARACGTGATTTLCLYAPEVYPTYVRSTGVGIATAIGKIGGVICPLVAVGMLRSCHQMEAVLVFELVLFLAGVSCILFPVETKGREMD

SEQ ID NO: 8905 - protein, 319 aa, Zea mays
MEPVRKSVCVTGAGGFVASELVKLLLSRGQYAVRGTVRDPGASKNAHLKVLEGAEERLQLLKADLMDYNSIASAVAGCEGVFHVASPVLSHRPSNPEVEVIAPAVIGTTNVLKACYEAKVRRVVVVSSCGAVYANPIYPKGKVFDEDCWSDEDYCRKKEDWYLVSKTLSEREALAFAAKTGLDVVTVCPSLVFGPLMQPTVNLSSEMILKYFKDLETVENVLSNMVDIRDVADALLLTYEKPEASGRYICSSHAIKISDMINILKTMYPSYPYPKNFVEDDVNSVYSSEKLQKLGWSFKPIEESLRDTVESYKAFGILN

SEQ ID NO: 8906 - protein, 320 aa, Zea mays
MEAVGKSVCVTGAGGFIASWLVKLLLCRGQYKVRGTVRDPGASKNAHLKVLEGAGERLQLVKADLLDYSSVASAIAGCEGVFHVASPVPSGRSSNPEVEVIGPAVTGTTNVLKACYEAKVGRVVVVSSCAAVYANPNYPKGKVFDEDCWSDEAYCRKNEDWYFVSKTLAEREAFAYAAKTGLDVVTICPSLVFGPLMQPTVNSSSKIILKYFTGDRETVENILRNMVDVRDVADALLLAYEKPEASGRYICSSHAIKVADMINILKTLYPSYPYPKNFVEDDDNSVYSSEKLQKLGWSFKPIEESLRDTVESYKAFGILN

SEQ ID NO: 8907 - protein, 378 aa, Zea mays
MATLNPFELLGADDNDDPTQLIAAAAAAAQKAETKKSAVAPAGKAAQPAATTKFPTKPAPPSQTVRDARGGGSSARGGFGRGERGRGRGGRGYGQNRGFSGDNGNDFQGGYGGGGYGDGAVTGGSEGERERETRPPYRGGGRRGGYRNVEFADDSERPPRRNYERHSGTGHGYEMKRDGAGRGNWGTATDELIAQDAEDSPKMEEAAPVAEKQGEQNDAPAADENKDNKDATANEEEEKEEDKEMTLEEFEKIREEKRKALLALKAEERKVEVDKDLQSLQPLSNKKENDEVFIKLGSDKDKKKENAERDERAKKSVSINEFLKPAEGERYYGGRGRGRGRGDRGGFRGGYGGGYSRGPAAAAPSIEDQAQFPSLGGK

SEQ ID NO: 8908 - protein, 392 aa, Zea mays
  misc_feature (198)..(198): Xaa can be any naturally occurring amino acid
  misc_feature (209)..(209): Xaa can be any naturally occurring amino acid
  misc_feature (230)..(230): Xaa can be any naturally occurring amino acid
PEQDFYRFLCNLRSIQFTASKMVAKEAIPLLTPHRIGRFELSHRVVLAPLTRCRSYANVPQPHAAAYYSQRATKGGLLIAEATGVSATAQGYPETPGIWTQQQVDAWKPIVDAVHRKGALFFCQIWHVGRVSTNDFQPDGQAPISSTDKQITPDAESGMVYSKPRQLQTDEIPLIVDDFRRAARDAVEAGFDGVEIHXAHGYLLEQFMXDSSNDRTDEYGGSLENRCRFXAVEVIDAVVREVGARRVGIRLSPFVDFVDCVDSDPVALGHYMVQQLNRHSGLLYCHMVEPRITAHGRRQIPHGLLPFRKAFHGTFIAAGGYDREEGNKVVAEGYADLVAYGKLFLANPDLPRRFELDVALNKYDRSTFYTQDPIVGYTDYPFFEQEDGKNEE

SEQ ID NO: 8909 - protein, 177 aa, Zea mays
MDSGSDSDGAPEELTAVQGVEKHEEISQVEKDSAIRVTREGKERRKRWAQRRTSSKPDKKAPKEVEDESTKQSEETDTMPGMLPTSVIEIIAAREKQTFASDSEEENVKQKVQKRNKRTKTAGPETILLKDVRSTQHVKNALDFLEQRKKQVPRSNAVLKNASKALRLLSSRGNFLS

SEQ ID NO: 8910 - protein, 406 aa, Zea mays
MEAAPRRQQQEEEGCPCGGPEAADHFERLHDAVLLDVLNRIGDVKALGRCALVSRRFHALVPLVDSVFVRVDCVIPDDPPSSSSAGAAPGSPPHQAPAPTACGRGALARVARALLGGVARPIHALGQILSSAAATVSRRSEPLPASPPPAPVADVSHHSPSEVLRSFRELRRLHIELPTGELGIDDGVLLKWKADFGSTLGSCVILGASSVSSKPPAGSAQAETAAADSTPAAPDTGRETEEPGSLPDSLYTNGGLKLRVVWTISSLIAASARHYLLHPIICNHGTLESLDLTDADGQGVLTMDKRQLQELRVRPVSPSGSSHRTLMPALSMRLHYAPLIELPGGTLLKGATLVAIRPSEDALREGQGVAGPAGTCWISEAFEEPYRTAAKVLLKRRAYCLEMNSF

SEQ ID NO: 8911 - protein, 443 aa, Zea mays
  misc_feature (307)..(307): Xaa can be any naturally occurring amino acid
MGLRESLLGCFGAGGGDQQEQGHEPAAARPAASRRPGGKPTLRRLSTANLRSLSLQDLSRKLETTKLHAFTLDELRAATRNFSAANFLGEGGFGPVYKGFVDGRLRPGLQPQHVAVKYLDSDGVQGHREWLAEVVYLGMLSHPHLVKLVGFCNQDDHRMLVYEYMPRQSLENHLFKNLLASLPWSTRLKIAVGAAKGLAFLHEAETPVIYRDFKASNILLDSDYTAKLSDFGLAKEGPQGDATHVTTRVMGTHGYAAPEYILTGHLTARSDVYSFGVVLLELLTGRRSVDKSRRGREQSLVDWARPXLRRAGRLRRFMDPGLEMQYSARAAEKAAGVAHQCLQSVPKARPTMRDVVDALEPLLALDDDVPMGPFVFTVGGAAAEAEAAPAQAGVAGDDNADAEAAGRQGKRHVMSAVHAESPLRSRYASAVKRPESPPTLSRA

SEQ ID NO: 8912 - protein, 161 aa, Zea mays; identical to SEQ ID NO: 777

SEQ ID NO: 8913 - protein, 124 aa, Zea mays
  misc_feature (16)..(16): Xaa can be any naturally occurring amino acid
  misc_feature (20)..(20): Xaa can be any naturally occurring amino acid
  misc_feature (34)..(34): Xaa can be any naturally occurring amino acid
  misc_feature (45)..(46): Xaa can be any naturally occurring amino acid
  misc_feature (52)..(52): Xaa can be any naturally occurring amino acid
  misc_feature (62)..(62): Xaa can be any naturally occurring amino acid
  misc_feature (64)..(65): Xaa can be any naturally occurring amino acid
  misc_feature (70)..(70): Xaa can be any naturally occurring amino acid
  misc_feature (74)..(74): Xaa can be any naturally occurring amino acid
  misc_feature (76)..(76): Xaa can be any naturally occurring amino acid
MEKSNDHDKASHGGSXGGCXREKWEETSLGIRTXETMLRLAPVGXXVAALVXMLKDSENNGXRXXFLYSXLTGXKXLGGPQGICRTYQAGHLRGSLKWSGVVPFLSPNTGGSLSWYLGLKRGPL

SEQ ID NO: 8914 - protein, 302 aa, Zea mays
MDLVSSDLAALGAVELVRVSASIPRAAPRTFALLTACLVFPLSFAVLAHSLFTHPILLRIRGAAHSGFAPWLGLFAYQFMYLIVLFTFSLLSTAAAVFTVASLYAGKPASVSSSLSALRPILPRLLRTFLWVSLLMLAYHLAFALAVLLLVVLVFLGIHVYISALWHLASVVSVLEPLCGLAAMAKSRQLLQGRTGTAATLVVSYFAVCGATSLLFRAAVVKGRTEEGSFGLALPGRLLVGAVLVCVLVSVNLLGLLVQSVFYYACKAFHSQQIDRTALYEHLGGYLGEYVPLKSNIQMENL

SEQ ID NO: 8915 - protein, 216 aa, Zea mays
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKGFAERENAFFMETSALEAMNVEGAFTEVLTQIYHVVSKKALDIGDDPAAPPRGQTISVGGKDDVSAVKKSACCSS

SEQ ID NO: 8916 - protein, 85 aa, Zea mays
  misc_feature (7)..(7): Xaa can be any naturally occurring amino acid
  misc_feature (9)..(9): Xaa can be any naturally occurring amino acid
  misc_feature (15)..(15): Xaa can be any naturally occurring amino acid
  misc_feature (17)..(18): Xaa can be any naturally occurring amino acid
  misc_feature (21)..(21): Xaa can be any naturally occurring amino acid
  misc_feature (25)..(26): Xaa can be any naturally occurring amino acid
  misc_feature (28)..(30): Xaa can be any naturally occurring amino acid
  misc_feature (32)..(32): Xaa can be any naturally occurring amino acid
  misc_feature (37)..(37): Xaa can be any naturally occurring amino acid
  misc_feature (39)..(39): Xaa can be any naturally occurring amino acid
  misc_feature (47)..(47): Xaa can be any naturally occurring amino acid
  misc_feature (70)..(72): Xaa can be any naturally occurring amino acid
  misc_feature (74)..(75): Xaa can be any naturally occurring amino acid
LEEEVVXAXSMLSSXAXXVPXRSQXXMXXXFXGLKSXAXFPVTRKAXNDITSIASNGGRASCMKVCPPVXXXKXXIFLPAPPLPS

SEQ ID NO: 8917 - protein, 199 aa, Zea mays
  misc_feature (72)..(72): Xaa can be any naturally occurring amino acid
  misc_feature (74)..(75): Xaa can be any naturally occurring amino acid
  misc_feature (77)..(78): Xaa can be any naturally occurring amino acid
  misc_feature (86)..(87): Xaa can be any naturally occurring amino acid
  misc_feature (101)..(102): Xaa can be any naturally occurring amino acid
MASSMLSSAAVVTSPAQATMVAPFTGLKSSAAFPVTRKANNDITSIASNGGRVSCMKVWPPVGKKKFETLSXYXXDXXEVEWVKEXXYLLPHKWIPLCEFXXEHGFVYREHGNTPEYYNARTGHGGTSLGPMTDFAQGLKEAKRAKGKPNPFLGTSIPKNRKAGDNFYPKNPKFPGGKFERNPKKTPPIYSQGGFFPRG

SEQ ID NO: 8918 - protein, 767 aa, Zea mays
MALTLSTTKTFTNINCSNNTSNITTFKPLKLPLFWPWQKVKMGPLSVSPMGFGTWAWGNQLLWGYQTSMDDQLQQAFELALENGINLFDTADSYGTGRLNGQSERLLGKFIKESQGLKGKQNEVVVATKFAAYPWRLTSGQFVNACRASLDRLQIDQLGIGQLHWSTASYAPLQELVLWDGLVQMYEKGLVRAVGVSNYGPQQLVKIHDYLKTRGVPLCSAQVQFSLLSMGKEQLEIKSICDELGIRLISYSPLGLGMLTGKYSSSKLPTGPRSLLFRQILPGLEPLLLALSEIAKKRGKTMPQVAINWCICKGTVPIPGIKSFRRAEEDDRVINHSERDLRGVDPSIRAEVWLFLLGVYDLNSTSEEREAVKTQKRKEYEKLQRRCQMLLKCGNGSTDNLEELPSDEANSQCVRFVDDYKITGPMTSQDVVSALNTDSSDTDSCEDNEDVLLLSSFAHSDEKKPEEDNSNNNSEENSSLLVAAASEVQVEVAVHEDFSTWQRIIRLDALRADSEWANYSPYSTAITESKARRLAESVGLKDYDHLESCRLYHAARLVAILEAYAMYDPEIGYCQGMSDLLSPILAVISEDHEAFWCFVGFMKKARHNFRLDEAGIQRQLSIVSKIIKNKDSQLYKHLENLQAEDCSFVYRMVLVMFRRELSFEQTLCLWEVMWADQAAIRAGVGKSPWSRIRQQAPPTDDLLLYAIAALVLRRKLIIQKYSSMDEIVEECNSMAGQLNVWKLLDDAHHLVVTLHDKIETLSQSQSI

SEQ ID NO: 8919 - protein, 408 aa, Zea mays
MSRPTGACLHAWRLGMATCTIPAAAAPRAHVGRHLPGIRQAARPALLLPSFSSSSSTTLLCHRLPPILPLVLQLLRVRANHAMAASAGTVYEADAEAVVRRITPALDRARHKGQAGKIAVIGGCREYTGAPYFAAISALKVGADLSHVFCTKDAATVIKSYSPELIVHPILEESYSVRVDERASVSSKILTEVAKWMERFDCIVVGPGLGRDPFLLECVSNIMRHARQANIPTVVDGDGLFLVNNNLNLVEGNPLAILTPNVYEYKRLVQKVLNCDVDEETASEQLIALCQKIGDVTIMQKGKADVISDGKTVTQVSTFGSPRRCGGQGDILSGSVAVFASWARHFVLTNEEPTEKRVNPMTLGCIAASLLLRKAASHAFEKNKRSTVTSDIIEFLGKSLEDICPAEH

SEQ ID NO: 8920 - protein, 414 aa, Zea mays
FREKQIVQYCVPAARAGGVRRRRDPAVAGGWRQGGGARRSGGASGVQLLAGCVRGFGSFRRQGHEGAAAIQHLVLPVVLLLADGRVLPAVLIVDPHPVAPRRRRVLVLILVVLRAGCVGERVCGGRLPRVRPRVRVFPRVRNSISNNSDGETFISADDLRINLWNLEISNQSFNIVDVKPANMEDLTEVITCAEFHPTHCNTLAYSSSKGTIRLIDLRQSALCDNHAKLFEEHEAPGSRSFFTEIIASVSDIKFARDGRHILSRDYMTLKLWDLNMDSGPVATFQVHEYLRPKLCDLYENDSIFDKFECCLSGDGLHVATGSYSNLFRVFGCSPESVEASTLEASRNPMRRQVVDPARPARTLTGAVRRGGENTSVDASGNSCDLSTKLLHLAWHPTENSIACAAANSLYMYYA

SEQ ID NO: 8921 - protein, 160 aa, Zea mays
  misc_feature (61)..(61): Xaa can be any naturally occurring amino acid
MDSTGTGAGGKGKKGAAGRKVGGPRKKSVSRSVKAGLQFPVGRIGRYLKKGRYAQRVGTGXAPVYLAVVLEYLAVEVLELAGNAARDNKKTRIIPRHVLLAIRNDKELGKLLGGVTIAPGGVLPNINPVLLPKKTAEKASSVGSKEAKSPKKAAKSPKKA

SEQ ID NO: 8922 - protein, 256 aa, Zea mays
  misc_feature (129)..(129): Xaa can be any naturally occurring amino acid
MAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIXELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 8923 - protein, 389 aa, Zea mays
MALPGPAATRAAVRLCRIAASASSYLPSAAADGRRELELPFALVAERGMVVGGHRGMGMNAVGAPPGARFGAARERENTLLSFGRAAAHAAVAFVEFDVQVTKDGCPIIFHDDFILTQGTGAVYERRVTDLLLEDFLSYGPQKESCKVSKPLLRRAGDGRVLNWTTEDDDSLCTLQEAFQRVSPRLGFNIELKFDDSIMYHRKDLQCALKAVLQVVFEHARNRPVFFSSFHPDAAQMMRELQSLYPVLFLTEGGTSKHHDPRRNSFDDAVRVCLEYDLHGIVSEARGVLKNPSAVARAQESNLALLTYGQLNNVWEAVYIQYLMGVHGVIVDRVEEISDAVAGFGLGKPGLGRGGAGVDGAKTHQAQAFSQQQLGFLLRLIPELIEQRH

SEQ ID NO: 8924 - protein, 186 aa, Zea mays
  misc_feature (36)..(36): Xaa can be any naturally occurring amino acid
  misc_feature (173)..(173): Xaa can be any naturally occurring amino acid
  misc_feature (180)..(180): Xaa can be any naturally occurring amino acid
MSLTIPTNLVLNPRSNKSLTQSLPKSTARFVCSDDXSATQQQSMKAFSTAVALSSILLSAPMPAVADISGLTPCKESKQFAKREKQQIKKLQSSLKLYAPESAPALALNAQIEKTKRRFDNYGKYGLLCGADGLPHLIVNGDQRHWGEFITPGLLFIYIAGWIGWVGRSYLIXISDEKKXAMNEII

SEQ ID NO: 8925 - protein, 720 aa, Zea mays
IRHEAARPPRLPVLLLVLLAAHVVSTSAHAEPPLPSPYNTSAHGEPPLPSTYNPSMCSESFRCGGVEIRYPFYLANATADYSGNYYSCGYTDLSVSCELEVEGPSTTWTPTIRLGGDNYTVKNIYYDYHTISLADRDVLGGGGCPVVRHNVSFDETWLHNASAFDNLTFFFGCHWGPRDTLPEFAGNNISCAGFSTPTVSGGSFVFKPEDLDEQEEQELASHCDEVFSVPVGSDALRATDTFSLTGYGYGDLLRQGFELEWNRTSEDQCGQCEGSGSGSGSGSGGWCAYSQKREFLGCLCSGGKVGNPFCKPSKSKRKARILAGALGGGAAALLVGAAIFLFVIMRKRKQKKKVINSSSKLLKYSGSGGTPRSRVGDMESGSIEDPPTHHFTYEELEEATNRFDESRELGDGGFGTVYKGYLRDGRVVAVKRLYNNGYRRVEQFQNEAAILSGLRHPNLVMFYGCTSSHSRELLLVYEFVANGTVADHLHGQRAPERALSWPLRLSVAVESAAALTYLHAIEPPVVHRDVKTTNILLDADYHVKVADFGLSRLFPLDVTHVSTAPQGTPGYVDPEYHQCYQLTDKSDVYSFGVVLVELISSKPAVDITRHRSEINLASMAISKIQKCQLEELVDLGLGYDTDPATRKMMTMVAELAFRCLQQNGEMRPPIKEVLEVLRNIQGECLTSGKDGDKSKDGPFSPTTVHAPWDSRSTTPNTSRD

SEQ ID NO: 8926 - protein, 271 aa, Zea mays
  misc_feature (65)..(65): Xaa can be any naturally occurring amino acid
  misc_feature (217)..(217): Xaa can be any naturally occurring amino acid
GRGGRGGRTPRGGRGGGGRGGRGGGMKGGSKAVVVAHKHKNEPARSSKAYALCTKNMVPGESVYXEKRVSVQNEDGTKVEYRVWNPFRSKLAAAVLGGVDNIWIAPGTRVLYLGAASGTTVSHVSDIVGPDGLVYAVEFSHRSGRDLVNMAKKRTNVIPIIEDARHPARYRMLVGMVDVIFSDVAQPDQARILALNASYFLKNGGHFVISIKANCIXDSTLPAEAVFAAEVEKLKADQFKPAEQVTLEPYERDHACVVGGYRVPKKQKATS

SEQ ID NO: 8927 - protein, 220 aa, Zea mays
MATVSLTPQAVFSTESGGALASATILRFPPNFVRQLSTKARRNCSNIGVAQIVAAAWSDCPAAAAASAAAEVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVPAGGHIVTTTDCYRKTRIYMENELPKRGIS

SEQ ID NO: 8928 - protein, 170 aa, Zea mays
  misc_feature (19)..(19): Xaa can be any naturally occurring amino acid
  misc_feature (66)..(66): Xaa can be any naturally occurring amino acid
MAPTVMMASSATAVAPFQXLKSAASLPVARRSTRSLGNVSNGGRIRCMQVWPAYGNKKFETLSYLXPLSTDDLLKQVDYLLRNGWIPCLEFSKLGFVYRENSTSPCYYDGRYWTMWKLPMFGCTDATQVYKELQEAIAAYPDAFHRVIGFDNVRQTQCVSFIAYKPPGSE

SEQ ID NO: 8929 - protein, 491 aa, Zea mays
  misc_feature (96)..(96): Xaa can be any naturally occurring amino acid
NLQPGGRGATGPATHPGEESSEDPNDADGEAVTAEQRFLGSPAPGPGCWHLNSSMRSKKIFGLSISLVLINLASILERADENLLPAVYKEVFLLFXYDRPAVLAIGTAFWALSTGAVGVSQYFGQVAFWRAINGVGLAIVIPALQSFIADSYKDGTRGAGFGLLSLIGSVGGIGGSVLATIVAGGDYYGFPGWRLAFISVAFVSFLIGLLVYLYTVDPRKLSPSHFGGGEDNERLHLVSNGILPPHSIWKDSWIAAKSVMKVRTFQIIVLQGIVGSLPWAAVVFFTMWFELIGFDNSSSAALNSFFAIGCASGSFLGGVIADVLSRYYPDSARVMCAQFSAFMGIPFSWILLTVIPQSVDYWSAYAVTLFLMGITISWCATCANNPMFAEVVPPRHRTMIYAFDRAFEGSFGSLAAPAVGLVTEKIYGYNAKAVDLSHGSVDGAYALSRGLLTMMIVPFALCLMFYTPLYTVFKRDRENARLASIKEQELT

SEQ ID NO: 8930 - protein, 733 aa, Zea mays
  misc_feature (235)..(235): Xaa can be any naturally occurring amino acid
  misc_feature (328)..(328): Xaa can be any naturally occurring amino acid
PSLLLLLPRIQPPPARRRRESPISPTPRSPRKRGQGTRIPQLPAISGTAMEVAAAAAGKPLTPEEEALRRSTDCVYFLASPLTCKKGNECDFRHSEGARMNPRDCWYWLNGSCLNPKCAFRHPPIDGLFGAPTSGLPPVSAHYGAYNLGKQMVPCYYFQKGNCLKGDRCPFYHGPQTASNDLAEQAAKVSSFPLEPSQAQNNEEAVAPNNSTQQEARMTENRTSIHVSKSGVGAXGATPADVASNALKPGTNFEQAPSNTLAAKKSSTTEDHPMHYQNQVPVEIDPVKDWNQNFEVSPTDYLPQDSREADDILGESSPGFDVLVDNDXNVDVAEDFARDMYPVEDYEYVTSDFDARAHHESEQFNDGMGVNGRIGQYDGYERKRRRSSSERNLDRHYHPDGRFLHRELDRGEIDGSDLRHQLRRRRINGPSTTISPERANGDRHGRDEPYRERAHGGHHTYRDRYQGPRGSNLSSRLQARIKLPRRSPDRVDTRFEDERDRRRFRDRFSPMRRMDFHGGRHQEAGHNQERGHRKLSELVSTVRHADGLSARRDVVGSTHFAARRNLGEPRKANGLVESEASLDFEGPKPLSVILQRKREAAQGNNYEKFAEVTVTKTGSLDETEKKSCVNVTRFADCKSGSGDEEYKEQDHILVDAHRQSSDHGDKFEAGYAAEVDAEGKQEADDYDQREGESDDYETFEGHDYKSEDENVYQDDEDFDDNDDFARKVGVLLP

SEQ ID NO: 8931 - protein, 160 aa, Zea mays
MEKIDDHLKPSHSVSAGAATEKWEEVSTGIRTAETMLRLAPVGLCVAALVIMLKDSQTNEYGEVSYSNLTAFRYLVHANGICAGYSLLSAAIAAMPGSSSTMPRVWTFFCLDQILTYVVLAAGAVSTEVLYLAYKGDDAITWSDACSSFGSFCHKATASV

SEQ ID NO: 8932 - protein, 470 aa, Zea mays
MEADSGKLFVGGISWETDEDRLRAYFGRFGEVTEAVIMRDRNTGRARGFGFVVFADSGIAERVTLDKHMIDGRMVEAKKAVPRDDQSIASKNNSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPIARSPAGGQNYAMSRVHNFLNGFNQGYNPNPLGGYGMRVDARYGLLAGARNGFSSFGPGYGMGMSVEGGMRGYFGASSGFVNSSNGRQIGSYFNGSSNRLGSPIGYVGLNDDSGSILSSMSRNVWGNGNLNYIGNHTNMNSFPQPGSGGGISGDEISWGSLTSAHGMGNISSLGSGNLGRGTGDNNFGLPSGNYVRSNSTGTIGEPFSASANAYESNNPGAYGSSSIYGDSTWRFNSSEVDMPPFGHDLGNDDPDIKSEISASYMGNYTVNNNQTSRGITS

SEQ ID NO: 8933 - protein, 159 aa, Zea mays
MAENLAPEKRHTFVHNAGQKVFEWDQTLEEVNMYIELPKGVPTKLFHCTIQASHVEVGIRGNPPYLNHDLMHPVKTDSSFWTIEDAEMHITLQKREKGKTWSSPIQGQGILDPYAADQEQKRLMLQRFQEENPGFDFSQAQFSGTCPDPRTFMGGIRSE

SEQ ID NO: 8934 - protein, 198 aa, Zea mays
MTTLTRADWEQRAKDLKIEGRAYINGEYTAAVSGDTFECLSPVDGRLLATVASCDVADAQRAVENARATFNSGAWSRLAPAKRKATMIRFAGLLKANAEELALLETLDMGKPISDSLNIDVPGAAQALSWSGEAIDKIYDEVAATPHDQLGLVTREPVGVVAAIVPWNFPLMMACWKLGPALSTGNSVILKPSEKSPL

SEQ ID NO: 8935 - protein, 60 aa, Zea mays
TAFVPFITANDRDLATTAKARRILDVCGLDVIELGVPDFDPLAECPVIQLRLFAYTVCLM

SEQ ID NO: 8936 - protein, 278 aa, Zea mays
MSSSDPDDAPDGGEDSPLFRRSGGPSSGGTVGDVPVSQSLIKAASNVCFSLFVLAVLVVTVVAVTYQPPDPWLQSSAAITTSLSRVLPNSTFLVPDDSLLPTGEDFNSSTAVPAPVRDDDDAAAAVSAASAAAAGNRTCDPDAPLNCSDPRVLAAVKAFNARAFFRKSIVFLSYEAPVSGPKPGQCDVAWRFRNRREKSWRRYRDYRRFSLASGDGCALDIVSVGKFRSGTNAARRPYPKGSKSKRPRVSPPPVDAEINDTIPVVGSEAEFKKVHQCS

SEQ ID NO: 8937 - protein, 244 aa, Zea mays
MISPDAARNVVGIIGNVISFGLFLSPVLTFWRIYKAKDVEEFKPDPYLATLLNCMLWVSYGIPVVHPNSILVVTINGIGLVIEAVYLTIFFLYSDSQKRVSAFAILAVEILFMVAVVLGVILGAHTHEKRSMIVGILCVIFGSMMYASPLTIMSRVIKTKSVEYMPFLLSLVSFLNGCCWTAYALIRFDLCVTIPNALGAFFGLVQLILYFCYYKSTPKKEKNVELPTVSSNVGGGNVTVSVER

SEQ ID NO: 8938 - protein, 167 aa, Zea mays
  misc_feature (145)..(145): Xaa can be any naturally occurring amino acid
MYNNMGPQPGMAMPQANPQPNPFGNAFSGPGSGLIRSGLGAYGEKIFGSSSEYVQSNITRYFSDPQYYFQVNDQYVRNKLKIVLLPFLHRGHWTRISEPVGGRLSYKPPIYDINAPDLYIPLMAFGTYVVLAGLSLGLYGEVFSXKALNWLFVKGMVGWFLRVMLLK

SEQ ID NO: 8939 - protein, 64 aa, Zea mays
  misc_feature (45)..(45): Xaa can be any naturally occurring amino acid
MAGGRVAHATLKGPSVVKEIFIGLTLGLIAGGMWKMHHWNEQRKXTRSFYDMLDKGQIVVVVEE

SEQ ID NO: 8940 - protein, 166 aa, Zea mays
  misc_feature (41)..(41): Xaa can be any naturally occurring amino acid
  misc_feature (86)..(86): Xaa can be any naturally occurring amino acid
  misc_feature (107)..(107): Xaa can be any naturally occurring amino acid
AKQNAKLDPKLWPDLEDVQTVDLMRDLLRRLKCSQKPDKRXLIFLTTPGLWKGTQYPIVKDEFCLCHLSTGDMFRAPVACKTPLGXVQPQEAMDKDALVTDALLVSXLAEASIISQCNKGCIVDGFPPTVDLADKPDLMVKQNVTVYDKALNFAMDGNVVKESITR

SEQ ID NO: 8941 - protein, 219 aa, Zea mays
  misc_feature (24)..(24): Xaa can be any naturally occurring amino acid
  misc_feature (33)..(33): Xaa can be any naturally occurring amino acid
  misc_feature (113)..(113): Xaa can be any naturally occurring amino acid
  misc_feature (149)..(149): Xaa can be any naturally occurring amino acid
SIRRLSLVRRRDPKGLCPSILPHXGGAVLETIXEAGTRVAQGDHLIPLFSPECGKCKLFLSGKTNLCQAIRATQGKGRIPDGTSRFSYKGQLIFHYMGTSTFSEYTVLPEISXAKIPKEAPLEKVCLLGCGVTTGIGAEINTAKVKPGXSVAIFGLGGIGLSAVIGAVKAKAGRIIAIDINPAKFEIAKQLGATDCINPKDYDRPIQDVIVDLTDGGKG

SEQ ID NO: 8942 - protein, 277 aa, Zea mays
  misc_feature (31)..(31): Xaa can be any naturally occurring amino acid
MSMFYTAGLTFLTRWRNRMIKSRAAVAFEAXRNPLEIVEVDVAMPKAGEVLLRVVASGVCHTDAYTLSGADPEGIFPSILGHEGGAVVEAIGEGVTSVAVGDHVIPLYTPECGKCKFCLSGKTNLCQAIRATQGKGLMPDGTSRFSYKGQPIFHYMGTSTFSEYTVLPEISVAKIPKEAPLEKVCLLGCGVTTGIGAVINTAKVKPGDTVAIFGLGGIGLSAVIGAVKAKAGRIIAIDINPAKFEIAKQLGATDCINPKDYDRPIQDVIVDLTDGGV

SEQ ID NO: 8943 - protein, 381 aa, Zea mays
MDLKTGLNSPVIADHLPTLALPAAVMTFTTPTSFPSPGLCLNTTKKIPLPGKIEEVRAAGWLDLMKASSPTRKRQIKDVICDAQSDLDLQYCNWTVNYPSALISFEAISDLAGSKRLALFLDYDGTLSPIVDNPENALMSDEMRAAVRHAASLFPTAIISGRSRDKVFDFVKLNELYYAGSHGMDIMGPVRKTTDSNGVECIRSTDVHGKEVNLFQPASEFLPMITEVYEKLGESVKDIDGARMEDNKFCVSVHYRNVAEDDYKKVFHRVTAVLEGYPCLRLTHGRKVFEVRPVIDWNKGKAVEFLLESLGLSESEDVLPIYVGDDRTDEDAFKVLKASNRGFGILVSSIPKESDAFYSLRDPAEVMEFLRMLAAWKEQST

SEQ ID NO: 8944 - protein, 142 aa, Zea mays
LLHPGLAFPGADRAGMDELEMEEEVRPEFPCPYCYEDHDVGSLCAHLEEEHPFEPQAAACPVCSEMVTKDMVNHITTQHGYLFKNRRRLRRFIIPGSQALSLLSRDLREAHLQVLLGGGGQRSSDNSSSLTCLLRDGYEGYG

SEQ ID NO: 8945 - protein, 647 aa, Zea mays
  misc_feature (351)..(351): Xaa can be any naturally occurring amino acid
  misc_feature (376)..(376): Xaa can be any naturally occurring amino acid
MASISGAAAPPSSAVCRLRLRRHLLLRPSHLRLRAPHSIADLSRSSNSAPSPARPALGSGPENGSGGVRAVEKDPIKLWERYVEWLYQHKELGIFVDVSRMGFTEEFLRQMEPRMQQAFVDMRELEKGAIANPDEGRMVGHYWLRDPALAPNSFLRNKIETALDRILAFSQDVISGKILSPSGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLVGAALMDEETRNTVVSHYXITRTTCSDGMIIYIVSCQTCLSFYXQVKANPAALLALCWYWASEGIGKKDMVVLPYKDSLLLLSRYLQQLVMESLGKEFDLDGNRVNQGLTVYGNKGSTDQHAYIQQLREGVHNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAICENPTEPLTLDEIADRCHCPEDIEMIYKIIQHMAANDRALIAEGSCGSPRSVKVYLGECSVDEDMQAA

SEQ ID NO: 8946 - protein, 550 aa, Zea mays
MAAHATLPFSCSSTLQTLTRTLSSRGAHQLRGGFLRLPSLAALPRLAHPYRRHVSASAAAAPNGASVEGEYDYDLFTIGAGSGGVRASRFASALYGSRVAICEMPFATIASDELGGLGGTCVLRGCVPKKLLVYASKYSHEFEESRGFGWTYETDPKHDWSTLIANKNTELQRLVGIYRNILNNAGVTLIEGRGKIVDPHTVSVNGKLYTAKHILVSVGGRPSMPDIPGIEHVIDSDAALDLPSKPEKIAIVGGGYIALEFAGIFNGLKSEVHVFIRQKKVLRGFDEEVRDFVAEQMSLRGITFHTEQSPQAITKSNDGLLSLKTNKENFGGFSHVMFATGRRPNSKNLGLEAVGVEMDKNGAIVVDEYSRTSVDSIWAVGDVTNRVNLTPVALMEGGAFAKTVFGNEPTKPDYRAIPSAVFSQPPIGQVGLTEEQAIEEYGDVDVFVANFRPLKATLSGLPDRVLMKILVCATSNKVVGVHMCGDDAPEIIQGIAIAVKAGLTKQDFDATIGIHPTSAEEFVTMRSPTRKIRKSSTDQVESKDEVVSKQ

SEQ ID NO: 8947 - protein, 156 aa, Zea mays
  misc_feature (92)..(92): Xaa can be any naturally occurring amino acid
MSIPQAKMELRPLGNTGLKVSSIGFGASPLGSVFGPVAEVDAVATVREAFRQGINFFDTSPYYGGTLSEKMLGKGLKALQVPRSDYIVATKXGRYEEGFDFSTERVTKSIDESLERLQLDYVDILHCHDIEFGSLDQIVSETIPALQKLKQEGKTR

SEQ ID NO: 8948 - protein, 672 aa, Zea mays
ARTEIQITKCFFLSRPQIITLSASANKLSKITDQAEEYARLIMEELDPGNLGYIELYNLEMLLLQAPSQSVRIGTTNSRNLSQMLSQSLRPTAEPNPLRRWYRRAQYFLEDNWRRVWVMLLWLCICAGLFAWKFIQYRQRYVFEVMGYCVCVAKGGAETLKFNMALILLPVCRNTITWIRNRTAGVGRVVPFDDNLNFHKVVAVGIAVGAGLHIISHLTCDFPRLLHATDAEYAPLGQYFGVPRPPNYWWFVRGTEGWTGLVMLVLMAVAFTLATPWFRRGRIALPGPLRRLTGFNAFWYSHHCFVVVYALLIVHGHYLYLTHKWYKKSTWMYLAVPMVLYACERLTRALRSSVRPVRILKVAVYPGNVLSLHFSKPQGFRYKSGQYIFVNCAAVSPFQWHPFSITSAPQDDYVSVHIRTLGDWTRELKNVFSRVCRPPTEGKSGLLRAEYDRDGSAVANPSFPKVLIDGPYGAPAQDYKQYDIVLLVGLGIGATPMISIIKDIINNMRQLDGGGGGDLEASDASASSSSMASFRTRRAYFYWVTREQGSFEWFRGVMDEVAETDRKGVIELHNYCTSVYEEGDARSALIAMLQSLNHAKHGVDVVSGTRVKTHFARPNWRNVYKRIALNHQNQRVGVFYCGAPVLTKELRELAQDFSRKTNTKFEFHKENF

SEQ ID NO: 8949 - protein, 138 aa, Zea mays
  misc_feature (34)..(34): Xaa can be any naturally occurring amino acid
  misc_feature (40)..(40): Xaa can be any naturally occurring amino acid
MMVDPTNGIGNQGKHYYSMWQTLFEIDTKYVPVXDALLKXPTPCSNPTIVLKKTLSCSYPNLPFNEALRKESEKLQAELQRSQSNMDLDSCEAIQHLLGVTKTEESTVTAERNKLFGSGQYEEALPKNEMALQIAAEL

SEQ ID NO: 8950 - protein, 210 aa, Zea mays
MLNCHFPPSSASGTHCLRSACGKILPHSPNMRGAEEERSGTATDAGGEEEKQERSVGLMAGLMDKAKGFVVEKVMQIPKPEAALDHVSFRSISREGVELHSHVDISNPYSHRIPICEITYTFKSAGKVIASGTMPDPGWIAASGSTKLDLPVKVPYDFIVSLMKDLGRDWDIDYMMEVGLTVDLPAIGAFTIPLTTEGEIKLPTFRDLLF

SEQ ID NO: 8951 - protein, 181 aa, Zea mays
MSTTEDERSGAAAEAGGGEEERRERSVGLMAGLVDRAKGFVVEKVAQIPKPEAALDRVSFQSISREGVELHSHVDVSNPYSHRIPICEITYTFKSAGKVIASGMMPDPGWIAASGSTKLELPVKVPYDFILTLMKDLGGDWDIDYLLEVGLTIDLPVIGAFTIPLTTEGEIKLPTFRDLLF

SEQ ID NO: 8952 - protein, 586 aa, Zea mays
MGSYAYKYCMCFTRKFRSPDAQPPPDVRAAHLSFASDAHALRRFVAGVQGESPADVDRILAMLSGGHSHGIARLVTRSPAASTPTLEDFFAFLFSPDLNPPIAHQVHQDMSAPFSHYFVFTGHNSYLTGNQLNSDSSDVPIVKALQRGVRVIELDMWPNPSKDNVDILHGGTLTAPVEMIKCLKSIKEYAFCASNYPLVITLEDHLTSDLQAKVATMLTETFGDLLFVPNPDPMKEFPSPASLMKRIIISTKPPQEYKEFLKAENNRSGSGNIAELPDQGSLRRIDSNADESDGKDELDEQDEEDSDEDDPKFQQDTACEYRKLITIQAGKPKGHLRDALKVDPDKVRRLSLSETQLAKATISHGAEVIRFTQKNILRVYPKGTRVNSSNYDPMNAWTHGAQMVAFNMQGHDKALRLMQGFFRANGGCGYVKKPDFLLRTGPNGEVFDPKASLPVKKTLKVKVYMGDGWRMDFSKTHFDAFSPPDFYTRVGIAGVKADSVMKKTRVIEDQWVPMWDEEFTFLLTVPELALLRVEVQEYDMSEKHDFGGQTVLPVWELKQGIRAVPLHDRKGVRYKSVRLLMRFDFV

SEQ ID NO: 8953 - protein, 666 aa, Zea mays
  misc_feature (603)..(603): Xaa can be any naturally occurring amino acid
MRSPSPPPWRLRRIRFSFPMLLLVASLAGADDLASDARALVAFRDAVGRRLAWNASDVAGACSWTGVTCEHGRVAVLRLPGATLSGTVPAGTLGNLTALHTLSLRLNGLSGALPADLSSAAALRNVFLNGNRLSGGFPQAILALPGLVRLSLGGNDLSGPIPVELDNLTHLRVLLLENNRFSGEISDVKLPPLQQFNVSFNQLNGSIPASLRSQPRSAFLGTGLCGGPLGPCPGEVPPSPAPAGQTPSPTPVPSGRGGGGGGGGGTNGGSGVENGHKGKKLSGGAIAGIVIGSALGAALLLFLLVCLCRRSGGIRTRSLEMPPSSPAPAGGRKPPEMTSAAAVAPLTTIGHPNAPIVQSTSGKKLVFFGSSAAVASFKLEDLLRASAEVLGKGTFGTTYKAVLESGATLAVKRLKDVTLSEPEFRERISEIGELQHEFIVPLRAYYYSKDEKLLVYDFMPKGSLSAVLHGNITSGKTPLNWDLRSSIALAAARGVEYIHSTSSTASHGNIKSSNVLLGESYQAHVSDNGLTALVGPSSSPSRATGYRAPEVIDPRRVSQKADVYSFGVLLLELVTGKAPSQAALNDEGVDLPRWVQSVSRSEXMAQLVLLAMDCTAQVPEARPSMAHVVMRIEEIKKSSVTPNIEQVGDQSSKAESEAAPTNPFAT

SEQ ID NO: 8954 - protein, 211 aa, Zea mays
  misc_feature (193)..(193): Xaa can be any naturally occurring amino acid
MDQEAKDSRPSRSPSEPNLFLQWGSRKRLRCVKTRDDGSPSPSPSQGLRRAIPRATRPLLGADIATFRSPRRPSTLNRRKSDLLVNEYKHTMALSPEKDKYYTTRGSPFPFEGNGFDFGTITEDKGTTSLPRFFIALSNKEKEEDFMAMKGSKLPQRPKKRPKLMQKCLLMVSPGAWLSDLSHERYEVREKKXLKRRARGLKALSMASDSE

SEQ ID NO: 8955 - protein, 432 aa, Zea mays
  misc_feature (142)..(142): Xaa can be any naturally occurring amino acid
  misc_feature (229)..(229): Xaa can be any naturally occurring amino acid
  misc_feature (259)..(259): Xaa can be any naturally occurring amino acid
  misc_feature (270)..(270): Xaa can be any naturally occurring amino acid
GYLEAGRADLSFQDRSWTLANGTGVIDIQHPCRSNVAVRKELHKPASDRSCIHLEFDISGTGLVYETGDHVGVYAENSVQTVEEVERLLDLSPDTFFSIHADAEDGSPRKGGGSLAPPFPSPCTLRTALLRYADLLNPPKKXSHASDPAEAERLRFLASPSGKDEYSQWITASQRSLLEVMAAFPSAKPPLGVFFAAIAPRLQPRYYSISSSPKMAPSRIHVTCALVYXPSPTGRIHQGVCSTWMKNTIPLEYSEECSXAPIFVRQSNFXIPAERSESGSPWTTGRNGPRTWLAPFRGFLQERLALKQSGAELGTSILFFGCRNRNMDYIYEDELQTFLEEGALSELIVAFSREGPTKEYVQHKMVEKATEIWNIISHGGYLYVCGDAKGMARDVHRMLHTVVQEQGSLDSSKTESYVKSLQMEGRYLRDVW

SEQ ID NO: 8956 - protein, 229 aa, Zea mays
  misc_feature (202)..(202): Xaa can be any naturally occurring amino acid
MALRHLVTGQNNCAPDGASSSNPLNALANAFLGQSSKAQSIKELPGSVSVPSTSGFSAPAPLSNIPGSENEFKQDQRPFVQSFRPPGVPELGGIEAHFPDFEQIYNNAGTTFQPPLDGPPQRVLSGVLHSFLTSGPAGVPFQPLPVPAALGLSESDKQCIRDRSCIMARHIFSDQPEEYIQAQVNTLLHSLDIDNRMRGPMXGQYPELQEYWNQSPSSMGPALMHNTAG

SEQ ID NO: 8957 - protein, 270 aa, Zea mays
MGAMYNNYRNPPGTHMPPQNSQPVQFDNPLYGASSGLIRSGIGVYGEKFLGSSSEFMQSNINRYFSNPQYYFHVNDQYVRNKLKVILFPFFHRGHWTRISEPVGGRLSYKPPIYDINAPDLYIPFMAFGSFIILSGFTLGFMGKFTPEAINLQFTRALIGWGFQLTVLKGLLYSMGGGEVPLLDLVAYGGYLFAGLSLAVVARLMWAYSYYVMMPWMSLCMGVFLVRTMKRVLFTEMRSSERHSSRQHYFLLFMAIVQFPLFFWLGSIGV

SEQ ID NO: 8958 - protein, 181 aa, Zea mays
  misc_feature (101)..(101): Xaa can be any naturally occurring amino acid
MASVRLSSATMTSSLAHATMVAPFIGLKSSAAFPVTCKANTEITSITSNGGRINCMKVWPPVGKKKFETLSYLPGLTDVEIAQEIDYLIRNKWTPCIEFEXEHGFVYREHGNIPGYYDGRYWTMWNLPLFGCTDPPQVLKEVQQCKREYPNAFIRIIGSDNNRQAQCISFIPHKPPSFTDA

SEQ ID NO: 8959 - protein, 90 aa, Zea mays
MVLLMSVNPGFGGQKFIPGTLNKLREARALIDASGRDIRLEIDGGVNVNNIREIAAAGADTFVAGSAIFNAPDYQEVIAKMRAELALARP

SEQ ID NO: 8960 - protein, 177 aa, Zea mays
AGPYDTFIFYTVLTSIISLDRVSLKQKVVDAPEILAVISKVPHLSEFLNSLYNCQYKSFFVAFSGLTEQIKLDRYLQPHFRYYMREVRTVVYSQFLESYKSVTMEAMASAFGVTVDFIDQELSRFIAAGKLHCKIDKVAGVLETNRPDERNAFYQSTIKQGDFLLNRIQKLSRVIDL

SEQ ID NO: 8961 - protein, 160 aa, Zea mays
MAFRRNCGLELLVASLTLTFALIQLVEANSDGDALYALRQSLTDPDHVLQSWDQNLVNPCTWFHVSCNQDSRVTRVDLGNSNLSGHLAPVLGKLEHLQYLELYKNNIQGTIPSELGNLKSLISLDLYNNNLTGNIPTSLGKLKSLVFLRLNDNRLTGSIP

SEQ ID NO: 8962 - protein, 341 aa, Zea mays
  misc_feature (267)..(267): Xaa can be any naturally occurring amino acid
KKALHSTVQLPILSSRVPSLQPKQSTTQPPPEEHEEMGSGTGKVVCVTGGSGYIASWLVKFLLQRGYTVRATVRDTADPKKTLHLQALDGAKDRLHLFKASLLEEGSFDAAVAGCDCVFHTASPFYHNVKDPKAELLDPAVDGTLNVLRSCKKASIKRVIVTSSMAAVAYNGKPRTPDVVVDETWFSSAEVCEKNKQWYVLSKTLAEEAAWKYANDNGLEIITINPTMVIGPLLQPTLNTSTEAILKFINGLSSTYANFCFGWINVXDVALAHILAYEVPSANGRYCMVERVIHHSDLVKIIHEMYPGFPVPDKCADDAAFAPIYQGSKDKIRKLGMELTP

SEQ ID NO: 8963 - protein, 78 aa, Zea mays
MGKTAGNRDWAQIYAIYGIEQWQTLVFLLFHAFVFSLLSVLFLIYFDQICFFLDSFFLSGAARLAAGFTGAVTALSAV

SEQ ID NO: 8964 - protein, 104 aa, Zea mays
  misc_feature (20)..(20): Xaa can be any naturally occurring amino acid
  misc_feature (39)..(39): Xaa can be any naturally occurring amino acid
  misc_feature (67)..(67): Xaa can be any naturally occurring amino acid
AAQEDGQEVGLISALDHDKXSGNHRATGDRGARAVLFQXTELADNGWPIELESEEYLVSRHPEFRYXTELHSHEPELDYLQSLDIEEKMNTIKWCQTTSNALYL

SEQ ID NO: 8965 - protein, 121 aa, Zea mays
  misc_feature (36)..(36): Xaa can be any naturally occurring amino acid
GFALSAGGRDGQPLDPRAGVLRPASSRTEKYNKPTXCFAEEDGALVNSGRWLQWHWKGSEPPGEAKSDIEIMSLIFTRLRKMYQEEGGKYPDPIVNLSWPYSNPQSPTAEELAKEYSGKVQ

SEQ ID NO: 8966 - protein, 203 aa, Zea mays
MSTEREVVCVTGASGCIGSWLVHLLLLRGYSVHATVKNLQDEKETKHLEALEGAATRLHLFEMDLLKYDTVSAAVNGCAGVFHLASPCIVDAVQDPQKQLLDPAVKGTLNVLTAAKEAGVKRVVVTSSVSAITPSPNWPADKIKNEECWADEDFCKQNGLWYPLSKTLAEKAAWEFAEEKGLDVVVVNPGTVMGPVIPPSINA

SEQ ID NO: 8967 - protein, 267 aa, Zea mays
MATLSSCSRLSSGTGAAAIHRQPARAGAVLVVTCRRSSSATVRAAAAATAAAPAAVELQNKGVSLPTWAEFELGRAPVYWKTSSGLPPSPGEGLTLFYNPAATKMAPNEVFGVAFNGGFNQPIMCGGEPRQMTLQERGKADPPIYTIRIRVPQHAVSLIFSFTNGAEWDGPYTLKFRVPKPWQNKPLSFFNEGLADELNREGACDLAIYPDENIAITSCAMDGYLDEGGDRCKLDIVSGCTDPSSDMFDPLATVDDGSCPLESDSEE

SEQ ID NO: 8968 - protein, 646 aa, Zea mays
MPLAAAAAAVAACPSPIGLTRSLCRIEAHPRRRRRFRLEANSSASTSAPAPTAADEGGGAGLCPVVRFDMADFTVADRVSVGLHGRSDEMIFEATVCDPSSELYGSTVVLRQLKSLQAKRRGRRALEVLKKLARRQMMYHSYALQVHGYIAPCNAVEEEDVPLVLVHGYHGSHSLRHWLQLSDWIPTLEATLALDEEQVRRVGDDSVGGPAVTRQLRLIRILMRDLLIGVNYLHSHGLAHTELRIENVHVSPIDKHVKVGILGNAADFQDNDLSSSTIASNNDRRKMMIAFDMRCVGFIMAKMVLRELMDPSTFFKFKSFLTKGNDPSCLREFLLPTLYQNSPSGNIGLQMLDRQWGAGWNLLALLLATKPEERISCVDALRHPFLCGPKWRINPSANLIRWGLGSTAVRMAEDYIYGRHQRRRLSYFVELMEVLNPSLRTQNWLHLLPGRWRLLYCTGRHIGLTLRQPSPRVLISAVYLTVSSESVDQVFSLTSDVGFRIMPEPNWPHDKSGSEGVLSVTASARIAAGRIYINEHDSKEDMVTSSMRYLHGNKWRKFSQIKELPSSLPAVNIAMDEIHVSISCTSTMTVNSAQKALKEIRTQTPPEMFDLSKIVCGTYIDARLMILRGVNGSALLFTRANPMIDA

SEQ ID NO: 8969 - protein, 252 aa, Zea mays
MGAAPSSDDSSRAGDGRAVASSAASGTGSNSHQAQSKRAPPPHKFHEIVAQEATTAGGGGGTAAAAELEDQACSTGVYLAGKTKKYWVDEKTRCNCFVLFARALSITWGDDPRYWIWRPVRETNDAEIVEAASLQNVCWLEVHGRLELSHLTPGCSYDVAFQVMLTEPAYGWSVPVNLRLRFPDGTVQARKEKLQGMPTEQWLELRAGEVKAPAQPGGAGRSGELEISMFEYDGGLWKKGLLIKGIKIVPKE

SEQ ID NO: 8970 - protein, 153 aa, Zea mays
  misc_feature (21)..(21): Xaa can be any naturally occurring amino acid
  misc_feature (23)..(23): Xaa can be any naturally occurring amino acid
  misc_feature (75)..(75): Xaa can be any naturally occurring amino acid
  misc_feature (78)..(78): Xaa can be any naturally occurring amino acid
  misc_feature (81)..(81): Xaa can be any naturally occurring amino acid
  misc_feature (94)..(94): Xaa can be any naturally occurring amino acid
  misc_feature (98)..(98): Xaa can be any naturally occurring amino acid
  misc_feature (105)..(105): Xaa can be any naturally occurring amino acid
  misc_feature (108)..(108): Xaa can be any naturally occurring amino acid
  misc_feature (118)..(118): Xaa can be any naturally occurring amino acid
MASSMLSSAAVVTSPAQATMXRXPFTGLKSSSAFPVTRKANNDITSIVSNGGRVSCMKVWPPVGKKKFETLSYPXLTXTEXELGKEVDYLLRHXWIPXCVEFELXHGXVYREHGSTPXYYDGRYWNNGGSFPLVRMALPLPGLKGSRGQNGVP

SEQ ID NO: 8971 - protein, 184 aa, Zea mays
  misc_feature (85)..(85): Xaa can be any naturally occurring amino acid
  misc_feature (90)..(90): Xaa can be any naturally occurring amino acid
  misc_feature (100)..(100): Xaa can be any naturally occurring amino acid
  misc_feature (129)..(129): Xaa can be any naturally occurring amino acid
  misc_feature (141)..(141): Xaa can be any naturally occurring amino acid
  misc_feature (148)..(148): Xaa can be any naturally occurring amino acid
  misc_feature (160)..(160): Xaa can be any naturally occurring amino acid
MASSMLSSATVVSSPAQAAMVAPFTGLKSSAAFPVTRKTDTDITSMASNGGRVNCMKVWPPVGKKKFETLSYLPDLTDVELSKEXVDYLXFRNKWIPCVXEFELEHGFVYREHGNPPGYYDGRYWNNVXNFPWFRCTDSAXQVLKEVXEGKKEYPKRFLXILGFQKKRQGPGFFFFPQKPPNFR

SEQ ID NO: 8972 - protein, 481 aa, Zea mays
MCVVIFIGTNGQTYFITASLVTSIQNFPKSRGPTVGILKGFMGLTSAILTQVYTVMHTPDHAALIFMVAVGPSLVAIGLMFVIRPVGGHRQIRPSDKNSFMFIYTVCLLLASYLVGAMLIQDFLQPSYDVVVFLTVILFVLLISPIAIPVIVSFMPEKAQHLMEDALLSEPLTGEASSSRQKEDQPEVILSEVEEEKSKETDSLPPSERRKRIAELQAKLVEAAARGGVRIKRRPHRGDNFTLMQALVKADFWLIWLSLLLGSGSGLTVIDNLGQMSQAIGYKNAHIFVSLVSIWNFLGRVGGGYFSEIIVRERTYPRHIALAVAQIVMAAGHFLFAMAWPGTMYIASLLVGLGYGAHWAIVPAAVSELFGVKHFGAMYNFLILANPAGSLIFSELIVSNLYEHEAEKQASQHQMSALLSPRLLRDTGFLADDALKCEGPACFFFSSLIMSVFCAVAAGLSLLVVQRTRQVYPRLYSSVRT

SEQ ID NO: 8973 - protein, 119 aa, Zea mays
MHDFCFTIPYGFAVLAGGVLGYLRRGSTASLAGGAGAGALLLLAGFVSLKAFEKRRNSYVALALETLCALALTFVMGQRFLETSKIMPAGVVAGLSAVMSAFYLFKIASGGNHIPPKKE

SEQ ID NO: 8974 - protein, 443 aa, Zea mays
MAAPSGGGGGGAGEGSSSAAAAATIGVHGVDQVAEAMWQMNLEEAMELGPYPERVGEPDCSYYMRTGMCRFGMTCKFNHPADRKLAVAAARMKGEYPQRIGQPECQYYLKTGTCKFGATCKFHHPREKAAMATRVQLNELGYPLRPNEKECAYYLRTGQCKFGSTCKFHHSQPSTMMVAVRGSVYSPGQSATSPGHHAYQGAVTSWPLSRSASFIASPRWPGHSSYAQVIVPPGLVQVPGWSPYTAQIGSSSSDDQQRTPGAAQYYTGSRQSGTPGIGDRGMFSSYQAGSVPVGLYAVQTENVFPERPDQPECQFYMKTGDCKFGSVCKFHHPRERIIPTPNCALSPLGLPLRPGEPICSFYNRYGMCKFGPNCKFHHPMGNPMYGHASSPTSEAQTSRRMLAHVPSHPEVSPDSGSGRSRRIVHSDSQQIPSVERITEREAS

SEQ ID NO: 8975 - protein, 186 aa, Zea mays
MWLRRKLQHLRLIVGTPCHFALFELQPSFRLDLEQLATRYRELARGVHPDRFADASEREQRLALEQSASLNEAYQTLKNPPKRARYLLAMGGRELPLEVTVQDPDFLMQQMQWREELEELQDEADLAGVAVFKRRLKVAQDELNESFAACWDDAAQREQAERLMRRMQFLDKLTYEVRQLEERLDD

SEQ ID NO: 8976 - protein, 73 aa, Zea mays
MIEVVLNDRLGKKVRVKCNEDDTIGDLKKLVAAQTGTRAEKIRIQKWYTIYKDHITLGDYEIHDGMGLELYYN

SEQ ID NO: 8977 - protein, 134 aa, Zea mays
  misc_feature (66)..(66): Xaa can be any naturally occurring amino acid
  misc_feature (77)..(77): Xaa can be any naturally occurring amino acid
MGGGGDLMAELLRRLKWSQKADKRLIFIGPPGAGKGTQSPIVKDEVWLGHLSTGDMVRAGGGSKIXLGLKGGGGVGXGTLVTDELVGGIIGEAMDKPKWQKGFILDGFPRTGAQAEKLDQMVKKRGTGIDKVLN

SEQ ID NO: 8978 - protein, 168 aa, Zea mays
  misc_feature (42)..(42): Xaa can be any naturally occurring amino acid
  misc_feature (72)..(72): Xaa can be any naturally occurring amino acid
  misc_feature (126)..(126): Xaa can be any naturally occurring amino acid
  misc_feature (144)..(144): Xaa can be any naturally occurring amino acid
MGMSLVNITNVAVLDNSSTFINPGQFGVSSECLVSIDGHLKXKLLYVGSVEDDISGHQLESGLVGPDNVGPXRCVLQTDPPDPSKLCEEYIFGASELLLHCTYMGQEFMTVECYLGHYYADVLLRXSLQRKVVIFGVQRTLVAXTKPQITKFHISIHLEAEYVGRDPA

SEQ ID NO: 8979 - protein, 659 aa, Zea mays
MRSMMMEREGRNEIEREVIDDLEETQNEGDDFKSIPPWKEQITFRGIVASLIIGIIYSVIVMKLNLTTGLVPNLNVSAALLAFVFLRSWTKLLTKAGIVTKPFTKQENTVVQTCAVACYSIAVGGGFGSYLLGLNRITYEQSGGTHTDGNYPEGTKEPGIGWMTAFLFFTCFVGLLALVPLRKIMIIDYKLTYPSGTATAVLINGFHTPKGNKMAKKQVFGFVKYFSFSFIWAFFQWFFSGGTECGFIQFPTFGLEALKNTFYFDFSMTYVGAGMICPHIVNISLLFGAVLSWGIMWPLIKGLKGDWFPSTLPENSMKSLNGYKVFISISLILGDGLYQFIKILFKTGINMYVKLNNRNSGKSNSEKDKQSIADLKRDEIFVRDSIPLWVAAVGYAAFSVVSIIAIPIMFPELKWYFIVVAYMLAPSLGFSNAYGAGLTDMNMAYNYAFDVGNQEGEYKAPYALVYRNMAILGVEGFSALPQHCLQLCYGFFAFAVAANLVRDRLPDKIGNWVPLPMAMAVPFLVGGYFAIDMCVGSLIVFAWNMRDRVKAGLMVYDVTPFMDDHPGGDEVLLSSTGKDATNDFEDVGHSDTARDMMDKYFIGEIDSSSVPATRTYVAPQQPAYNQDKTPEFIIKILQFLVPILILGLALVVRHYTKKD

SEQ ID NO: 8980 - protein, 635 aa, Zea mays
MGDRNHGRSLPLLLYLHLLLPILPFAMADIASEKQALLAFASAVYHGNKLNWSQNIPVCSWHGVTCSLDRSCILALRVPGAGLIGTIPADTLGRLVSLQVLSMRSNRLSGSLPNDVVSLPSLQAIFVQHNELSGDLPPFLSPNLNTLDLSYNSFTGQIPSGLQNLTKLSVLNLAENSLSGPIPDLKLPSLRQLNLSNNELNGSIPPFFQIFSNSSFLGNSGLCGPPLTECSFLSSPTPSQVPSPPKLPNHEKKAGNGLVIVAVAGSFVIFLLAAVMFTMCISKRKEKKDEAGYNGKVTDGGRVEKRKEDLSSGVQMAHKNKLVFLEGCSYNFDLEDLLRASAEVLGKGSYGTAYKAILEDGSTVVVKRLKDVVAGKKEFEQQMELIGRVGKHANIAPIRAYYYSKDEKLVVYEYIGRGSFSALLHGIKGVCEKTPLDWNTRMKIILGTARGLEHIHSEGGSRLAHGNIKSTNVLLDGDHNPYVSDYGLSSLTSLPITTSRAVAGYRAQETFESRKFTHKSDVYGFGVLLMETLTGKAPLQSQGQDDAVDLPRWVHSVVREEWTAEVFDVQLMKYPNIEDELVQMLRIAMACTAWSPDRRPTMAQVVRMVEELRHSASGSRALSVGSPKESSPLSA

SEQ ID NO: 8981 - protein, 362 aa, Zea mays
MGLDYYKILGVDKGATDDDLKKAYRKLAMKWHPDKNPNNKKEAENKFKQISEAYEVLSDPQKRAVYDQYGEEGLKGQVPPPGAGGAGPGGATFFSTGGDGPTVFRFNPRNAEDIFAEFFGGSSPFGGMGGGGMGGSGMGGGMPGMRSGGTRFSSSIFGDDIFGSAFGSGPDGHGMHAGGRAVKAPAIERKLPCSLEELYKGTTKKMKISREISDASGKTIPVEEILTIDVKPGWKKGTKITFPEKGNETPNTIPADLVFIIDEKPHPVFTRDGNDLVVTQKIPLAEALTGYTAHVTTLDGRSLTVPISSVIHPGYEEVVRGEGMPIPKDPSRKGNLRIKFDIKFPARLTADQKSGVKRLLGQ

SEQ ID NO: 8982 - protein, 79 aa, Zea mays
LLTACGQQCRMRFAGWYLKIAVGGAAIGAAMELFMIHTGFYEKVTVLESEKRAWESSPEAQAMREALNPWHKRDEQEKK

SEQ ID NO: 8983 - protein, 265 aa, Zea mays
  misc_feature (66)..(66): Xaa can be any naturally occurring amino acid
  misc_feature (180)..(180): Xaa can be any naturally occurring amino acid
MAPLGDGGAAAAAASNNLVVSFGEMLIDFVPDVAGLSLAESGGFVKAPGGAPANVACAIAKLGGAXLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRXFTKDFKGSVSGFKVDTVDTTGAGDAFVGSLLVNVAKDDSIFHNEEKLREALKFSNACGAICTTKKGAIPALPTVATAQDLIAKAN

SEQ ID NO: 8984 - protein, 354 aa, Zea mays
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAVPPRHCPPPPRPSSSTSSVSVH

SEQ ID NO: 8985 - protein, 238 aa, Zea mays
  misc_feature (13)..(13): Xaa can be any naturally occurring amino acid
MATAGKVIKCRAXRGVGGRQTAVHRGGGGSAAAGHGGAYQDPLHRALPHRRLLLGGQGANPGVPEDLRTRSGSIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQGTIV

SEQ ID NO: 8986 - protein, 522 aa, Zea mays
MFNKIIKRGNRKGARGDNAEAAARPAAPSSSSGSGGGGAGAAAPVTVNHASRATAPSPSSPTSPHVAPSALATNPAGAASPPLLEPLPLLRDVAAADRPGLFLRKLRIVAALFDLSDSLKHPREKEAKRQALLELVDYVQAPAQAAGANAPTRLPDHVQEALVAAISANIFRPLPPALHESAAAIDPGAAPDEEEEPYLDPSWPHLQLVYELLLRYVVSPDTDTKVAKRYVDHAFVLRLLDLFDSEDPREREYLKTVLHRIYGKFMVHRPFIRKAINNVFYRFIFETQRHNGIGELLEILGSIINGFALPMKEEHKLFLARALIPLHKPKSVAIYHQQLSYCIVQFVEKDYKLADTVIRGLLKYWPVTNCQKEVLFLGELEEVLEATQPAEFQRCMVPLFKQIGRCLNSSHFQVAERALFLWNNDHIVSLIAQNRVVIFPIIFEALERNIQSHWNQAVHGLTANVRKMFLDMDSELFEECQQQYMEKQAKAKEIQEQRESAWRQLEAVVAAKAAGDDMVLVN

SEQ ID NO: 8987 - protein, 670 aa, Zea mays
  misc_feature (354)..(354): Xaa can be any naturally occurring amino acid
  misc_feature (396)..(396): Xaa can be any naturally occurring amino acid
MGCVCGRPSSFEDGQCRATPPPAAKLSAAVRREEEARKQQLQLQQHARAGSGREEALERRRAMMAMAAACQVRSPVPRAVEAEQVAVGWPPWLVAVAPEAVRGWVPRRAESFEKLDKIGQGTYSNVYRARDLEKEKIVALKKVRFDNLEPESVKFMAREILILRRLDHPNVIKLEGLVTSRMSCSLYLVFEYMEHDLAGLASFRGVKFTESQVKCYMQQLLRGLEHCHSRHILHRDIKGSNLLIDNRGILKIADFGLASFFDPEQRQPLTSRVVTLWYRPPELLLGATNYGVAVDLWSAGCILAELYAGKPIMPGRTEVEQLHKIFKLCGSPSEDYWRKSKLPHATIFKPQHPXYARRVAETFKEFPAPTLALVDVLLSVDPADRHTAMPAFDFFXTNHSHTLFRQGVTGGKQHKHDPERRTRESRAVPAPDANAELVSSLQKRQAQANTRSRSEMFNPCKEDSASGFRIEPPRPTPVTESSEDPQRAYPTRIFHSGPLVNQSQPSKAGGGKNGEPQVPGVVNHPVVLSTRSGPRADDSGRTMVAQAEAFAHGRRLSESINEHFSNSGKYDQVFPKKDDRNIRADGAIGYGSKGSKIHHSGPLTCPSGSNVDEMLKENDRQIQEVFRRTRVEKSRARRDHGHHQGGIRPGDFGAIPVFPSSRSSYQAVQQ

SEQ ID NO: 8988 - protein, 67 aa, Zea mays
  misc_feature (59)..(59): Xaa can be any naturally occurring amino acid
TGKALANAGPGSLFISYTFIGAIVFIVMSGLGEMAAWLPLSAGFTGYATRYCHPSLGFXASPARRPD

SEQ ID NO: 8989 - protein, 237 aa, Zea mays
  misc_feature (72)..(72): Xaa can be any naturally occurring amino acid
  misc_feature (106)..(106): Xaa can be any naturally occurring amino acid
MGANGHPPLASTRAHNGSHSGGSGGGGGGGGGANPSNGGTAAALRHDPGLAREWLTEEHAILDELLVKSATXQKGRHAQVVSFRGRVDAMKLPEKIVRDVALRCRXMNKKESAKRKKEDHNSSKKSKDKKEKVSDSSSKPPGHMGGRPNVPPYPLPVLPMDDDEISSKAIGGPTGEILETNAHVLGQISSNLSNMQDNISLLCQTRDNILRVLKEYVLNCYCVYIKIFLKSYIRLIR

SEQ ID NO: 8990 - protein, 149 aa, Zea mays
HHWPTYGPHYSPRYDYENVDAGAAKELMATLVSIQSSLSDVNKLIKEIRFDVSEVVPAAEFESKDPVDGFVSNPQGIRSLLGEGSRLVFRFSGTGFVGPPIRVSIDQYEKDSSKPGRDSQEPLAPLVDVALKLSKMQEYIGRFPPPVIT

SEQ ID NO: 8991 - protein, 565 aa, Zea mays
MASVAGSGGGASAGAGGLKTYFKTPEGRHKLQYEKTHSPAVVHYNHNGKTVAQMTVAYLKEKPAGQGSTPSTPSAGSGMRSAAARLLGTGNGSRTLSFGSNGTSRAVSGSSRMGGGIGVSTSASGSQGMANYDGKGSYIIFNTADTLFISDLNSHDKDPIKSIHFSSSNPLCHAFDPEAKDGHDLLIGVFSGDVYSMSLRHQLQDPGKKPVSYQHFVNKDKDKDKDPSQGGAASSQCTCVAWVPEREGIFVVSHADGNLYVYDKFKDGNTDWTFPTVKDQSQVLISHAKSSKGNPIARWHICQGAINDISFSPDGAYLATVGRDGYLRVFDFTKEQLIFGGKSYYGALLCCSWSADGKYLLSGGEDDLVQVWSMDDRKIVAWGEGHNSWVSAVSFDPYWSPPNSDETEENVMYRFGSIGQDTQLLLWDLALEEIAVPLRHPSGGSPTFSSGSPSAQWDNACPPTGVLQPSPRMRDVPKLSPLVAHRVHVDPLSGLEFTSESILTICREGLIKIWARPIHSESNQQPDSSEQVIGNATAKDKMLTSSNKAGAFSSSFKQPPSVLFT

SEQ ID NO: 8992 - protein, 232 aa, Zea mays
HAYAAAALYLAVKPPSLVLVLVHHSRPAPSSALRLPRRTASAWLPRFPSCSTSAPPPFAAVASMDAPPQGYRTNVGICLADPSLTKIFSASRIDIPSAWQMPQGGIDAGEEPRAAAFRELREETGVTSAEIVAEAPVWLTYDFPTDVRTKLNARWGTDWKGQAQKWFLFRLTGNDDEINLNGDGSEKPEFGEWTWMTPQEVIEKAVDFKKPVYEEALKHFAPYLQSDPAASS

SEQ ID NO: 8993 - protein, 168 aa, Zea mays
MEVEACYNYGFLPADRGRHQPPPPPHATLPHAAEDAGELWEYFPCPFCYIEVEVPFICNHLQEEHCFDTRNAVCPICANNLGKDMAAHSRLQHTHLLKRRKPYRPSSCPAAATSPATYQVNSYYEEAEPQQHYSRPYKDPAPDPLLSQFICSVDAVPGDDNAQKDDQR

SEQ ID NO: 8994 - protein, 241 aa, Zea mays
MKKYKKKKKKKKKKTKKKKKKKKKKKNRLAVGHPVPHPPDSSPLLAEAKTQLPDLANYPNLGTLAVAAAMAKEPPFSLPPGVFNPSTPAHRRHPIPGPGASPPPAFAPPRPSTSSAANPLPFMSFDIPAQSNSTPPIFTGPIGGSSASFKDEPPLLEELGINTRQIWRKTLSILHPLRSADPSLHADADLSGPFLFLLSFGLFQLLGGKFHFGIVLGGVTVASLFLYFVFSMLSGGRRGDL

SEQ ID NO: 8995 - protein, 185 aa, Zea mays
LARVFSPLLEHARARGCSRGGDERGNITNVAVLDNPTAFINPFQFEISYECLVPLDDDLEWKLIYVGSAEDENYDQQLESVLVGPVNVGTYRFVLQEFMRVGYYVNNDYGDEQLREEPPAKVLIDRVQRNILADKPRVTKFPINFHPEPSTGTGRQQQQQEPQTASPEKHAGSGEGNGSKPEADQ

SEQ ID NO: 8996 - protein, 203 aa, Zea mays
MAANAGNKIRNAKLVLLGDVGAGKSSLVLRFVKGQFVEFQESTIGAAFFSQTLAVNDETVKFEIWDTAGQERYHSLAPMYYRGAAAAIVVYDITNPASFTRAKKWVQELQAQGNQNTIVALAGNKADMLDARQVPAEEAKAYAQENGLFFMETSAKTAINVNDIFYEIAKKLLQGQQAPSPQAGMVLNQRPNERTVSSSSCCS

SEQ ID NO: 8997 - protein, 217 aa, Zea mays
  misc_feature (134)..(134): Xaa can be any naturally occurring amino acid
MAYRADDDYDYLFKVVLIGDSGVGKSNLLSRFTRNEFSLESKSTIGVEFATRSIHVEDKVVKAQIWDTAGQERYRAITSAYYRGAVGALVVYDVTRHVTFENVERWMRELRDHTDANIVMMLVGNKADLRHLRXAVPTEDAKAFAERQNAFFMETSALEAMNVEDAFTEVLAQIYRVVSKEALDIGDDPAAPPRGQTISVGGKDDVSAVKKSACCSS

SEQ ID NO: 8998 - protein, 216 aa, Zea mays
MAYRADDDYDYLFKVVLIGDSGVGKSNLLSRFTRNEFSLESKSTIGVEFATRSIHVEDKVVKAQIWDTAGQERYRAITSAYYRGAVGALVVYDVTRHVTFENVERWMRELRDHTDANIVMMLVGNKADLRHLRAVPTEDAKAFAERQNAFFMETSALEAMNVEDAFTEVLAQIYRVVSKKALDIGDDPAAPPRGHTINVGGKDDVSAVKKSACCSS

SEQ ID NO: 8999 - protein, 183 aa, Zea mays
  misc_feature (38)..(38): Xaa can be any naturally occurring amino acid
  misc_feature (62)..(62): Xaa can be any naturally occurring amino acid
  misc_feature (66)..(66): Xaa can be any naturally occurring amino acid
  misc_feature (94)..(94): Xaa can be any naturally occurring amino acid
  misc_feature (104)..(104): Xaa can be any naturally occurring amino acid
  misc_feature (110)..(110): Xaa can be any naturally occurring amino acid
  misc_feature (112)..(112): Xaa can be any naturally occurring amino acid
  misc_feature (114)..(114): Xaa can be any naturally occurring amino acid
  misc_feature (122)..(122): Xaa can be any naturally occurring amino acid
  misc_feature (124)..(124): Xaa can be any naturally occurring amino acid
  misc_feature (130)..(130): Xaa can be any naturally occurring amino acid
  misc_feature (134)..(135): Xaa can be any naturally occurring amino acid
  misc_feature (138)..(138): Xaa can be any naturally occurring amino acid
  misc_feature (140)..(141): Xaa can be any naturally occurring amino acid
  misc_feature (144)..(144): Xaa can be any naturally occurring amino acid
MIALSFVRKGSYLVTVRQVLGHHANRIKLMSKVENQEXVVNFDEILRETDAFMVARGDLGMXIPVXKIFLAHNMMIYMCNIAGKPVVTATHMLXSIIISPMPTXAEALDXAXAXSDGTDCVXLXGESAAXAYPXXAVXIXXRFXIDGVCTMHDPPALIICLRLVSLFPLVPTRGLIIRRCFRV

SEQ ID NO: 9000 - protein, 72 aa, Zea mays
  misc_feature (44)..(44): Xaa can be any naturally occurring amino acid
  misc_feature (50)..(50): Xaa can be any naturally occurring amino acid
  misc_feature (63)..(63): Xaa can be any naturally occurring amino acid
VTIMGHVDHGKTTLLDYIRKSKLVACEAGGITQGIGAYQVLLPXRWKHQXCVFLDTPGHEAYXAMRARGARS

SEQ ID NO: 9001 - protein, 164 aa, Zea mays
  misc_feature (99)..(99): Xaa can be any naturally occurring amino acid
MGILRKKKHERKPSFKSVLTSILATQAATFLLLISGVSLAGTAAAFIATMPLFVVFSPILVPAGITTGLLTTGLAAAGGAGATAVTIILWLYKQATGKXPPAVLSKVLKKIIPGAAAAPAAAPAAAPAAAPAAAPAAAPAPKPAAAPAPKPAAPPALMKRKGWA

SEQ ID NO: 9002 - protein, 141 aa, Zea mays
  misc_feature (83)..(83): Xaa can be any naturally occurring amino acid
  misc_feature (98)..(98): Xaa can be any naturally occurring amino acid
MEMKLTIRRVPTVVSNYQEDADKPRAGCGRNCLGDCCLPASKLPLYAFKLSPAKGSQEDAASTKLLVDILLSEWEDRMTRGLXRYDVTACETKVIPAXWGLLHNFNEGRHLKNALLEFSCGPVCSQPFEPCQVNFPKSWPQ

SEQ ID NO: 9003 - protein, 147 aa, Zea mays
  misc_feature (70)..(70): Xaa can be any naturally occurring amino acid
  misc_feature (73)..(73): Xaa can be any naturally occurring amino acid
  misc_feature (87)..(87): Xaa can be any naturally occurring amino acid
  misc_feature (99)..(99): Xaa can be any naturally occurring amino acid
MEMKLTIRRVPTVVSNYQEDADKPRAGCGRNCLGDCCLPAFQLPLYAFKLSPAKGSQEDAASTQVLVDIXLRXGEDRMTRSLFRYDXLAGETRVIPGKXGLGAQLNGGRHLKKRPTGFPGGTGGLQPFDPCQVQFPKVGQGKGFLSF

SEQ ID NO: 9004 - protein, 151 aa, Zea mays
  misc_feature (102)..(102): Xaa can be any naturally occurring amino acid
  misc_feature (122)..(122): Xaa can be any naturally occurring amino acid
  misc_feature (141)..(141): Xaa can be any naturally occurring amino acid
MEMKLTIRRVPTVVSNYQEDADKPRAGCGRNCLGDCCLPASKLPLYAFKLTPAKGSQEDAASTKLLVDILLSEWEDRMTRGLFRYDVTACETKVIPGKPFGXFVAQLNEGRHLKNALLEFRXVTVCSQPFDPAKFIFTKVXQEEVLFQFEK

SEQ ID NO: 9005 - protein, 231 aa, Zea mays
  misc_feature (147)..(147): Xaa can be any naturally occurring amino acid
  misc_feature (158)..(158): Xaa can be any naturally occurring amino acid
PPPPPPTLRSDNQEMSKEELRRQHQAELARQKNEETARRLAGVGTGSGDGRGPARASNELVAYKNVNDVPFVRDLVIQVDQKNEAVLLPIYGSMVPFHVSTVKSVTSHQDNRTCTIRIFFNVPGMPFSNDSKFNSQGAIYLKEITFXRSKDPRHSSEXVVQQIKTLRRQVASRGAQDTLKAEMLILLWHTSRKLQNLARNQNARCTRLFLKAEKSPHCHLRGIYGTRKLPR

SEQ ID NO: 9006 - protein, 147 aa, Zea mays
  misc_feature (115)..(115): Xaa can be any naturally occurring amino acid
  misc_feature (126)..(126): Xaa can be any naturally occurring amino acid
WTRRRGSVAEKIAHIPKPEATLDGVTFKGLSRECITLHSSVNVSNPYDHRLPICEVTYTLRCAGKEVASGTMPDPGWIAASGSTALEIPAKVPYDFLVSLVRDVGRDWDIDYELXVGLTVDLPIVXNFTIPLCTSGEFKLPSLRDLF

SEQ ID NO: 9007 - protein, 212 aa, Zea mays
MAALTASIATSSAFAAKPRLARPPARLSVSCSASSGDNNTPSLSASIKTFSAALALSSVLLSSAATSPPPAAADIAGLTPCKESKAFAKREKQSVKKLNSSLKKYAPDSAPALAIQATIEKTKRRFENYGKFGLLCGSDGLPHLIVSGDQRHWGEFITPGVLFLYIAGWIGWVGRSYLIAVSGEKKPAMREIIIDLELAARIIPEGRSLARS

SEQ ID NO: 9008 - protein, 312 aa, Zea mays
MTMRRCQTGPGPVLAARSPGLGNVDNLHESSSLSRSWDLNRQIDDDRDVLIECRDVHKSFGEKQVLRGVSFKIRHGEAVGIIGPSGTGKSTILKVMAGLLAPDKGDVIICGKKRHGLVSDEDIEGLRIGLVFQSAALFDSLTVRENVGFLLYENSSLPEDRIGKLVTETLAAVGLKGVEDRMPSELSGGMKKRVALARSIIFDDTKDVVEPEVLLYDEPTAGLDPIASTVVEDLIRSVHMTGRDALGKPGKIASYVVVTHQHSTIRRAVDRLLFLHEGKVVWEGMTHEFTTSANPIVQQFASGSLDGPIKYF

SEQ ID NO: 9009 - protein, 560 aa, Zea mays
  misc_feature (98)..(98): Xaa can be any naturally occurring amino acid
MGSSGFSWTLPDHPKLPKGKPVAVVVLDGWGEANPDQYNCIHVAQTPVMDSLKNGAPEKWRLVKAHGTAVGLPSDDDMGNSEVGHNALGAGRIFAQGXAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVPGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPPEIDRTSGEFLVKNGIRTFACSEAVKFGHVTFFWNGNRSGYFDETKEEYVEVPSDSGITFNVAPKMKALQIAEKARDALLSGKFDQVRVNLPNGDMVGHTGDIEATVVACKAADEAVKIILDAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 9010 - protein, 498 aa, Zea mays
MSTCAADLAPLLGPAAANATDYLCGQFADTASAVDATYLLFSAYLVFAMQLGFAMLCAGSVRAKNTMNIMLTNVLDAAAGALFYYLFGFAFAFGTPSNGFIGKQFFGLKHLPRTGFDYDFFLYQWAFAIAAAGITSGSIAERTQFVAYLIYSAFLTGFVYPVVSHWFWSADGWAGASRTSGPLLFGSGVIDFAGSGVVHMVGGIAGLWGALIEGPRIGRFDHAGRSVALKGHSASLVVLGTFLLWFGWYGFNPGSFTTILKSYGPAGTVHGQWSAVGRTAVTTTLAGSVAALTTLFGKRLQTGHWNVVDVCNGLLGGFAAITAGCSVVEPWAAVICGFVSAWVLIGANALAARFRFDDPLEAAQLHGGCGAWGVLFTGLFARRKYVEEIYGAGRPYGLFMGGGGKLLAAQIIQILVIAGWVSCTMGPLFYALKKLGLLRISADDEMSGMDLTRHGGFAYVYHDEDPGDKAGVGGFMLKSAQNRVEPAAAVAAATSSQV

SEQ ID NO: 9011 - protein, 384 aa, Zea mays
MAAADASSLPPSAITCRAAVAWGPGQPLVMEEVEVAPPGPMEIRVKVVSTSVCRSDVTAWQSKAQLDLFPRVFGHEASGVVESVGEGVTEFQVGDHVLTVFIGECKSCKHCVSGKSNMCQKLGLERKGVMHSDQKTRFSVKGKPVYHYCAVSSFSEYTVVHSGCAVKVGLTVPMDRVCLLSCGVSAGLGAVWNVANVSKGSSVAIFGLGTVGLSVAQGAKLRGASKIIGVDTNPEKQEKGKSFGVTDFINPDELSEPVQQVIKRITDGGVDYSFECVGDSGVVSTALQSCSDGWGVTVTLGLPKGKLEVSTHYAFLLSGRTLKGSMFGGWKPKSDLPSLVDKYAAKEIQVDGLVTHDIPFNEINKALELMLENKCLRCVIHMPR

SEQ ID NO: 9012 - protein, 309 aa, Zea mays
YTISFWIGSGNKDAKSAASPTGAVSGSPILASPHPPLPRRRADSRSRGSDPEDRDEAIAAGLEADGSGLDSPGSDKRQSGDCPQRKGFPGNGGGPSLSSGSSVWSSSRSVSDAEEDTGGPEDESEVFDDWEMAADALYVDDSSCNQSSGPTPTLPQAPTTAEPSHAAKPEPIQSKTRAWAPDDIFRPQSLPSISKQTSFPASIGNRWQDMGMSAAQQGILSLPLSCPICCDDLDLTDSSFCPCPCGFHMCLFCHNRILVEDGRCPGCRKQYNTVSAAEGGGGGGSRATVGTGREMEKRLSRSCSMGPSY

SEQ ID NO: 9013 - protein, 140 aa, Zea mays
  misc_feature (105)..(105): Xaa can be any naturally occurring amino acid
MPTLQSPGDGRSATRASPFGHRASNSRAPAGGGRSPLRLGRSATASAGRGGGGNASGNCPKNKERVSWCSFFLLCVQVEAPRVQPKLSEPFLGFTQTAEIWNSRXCMIGLIGTFIVELVLNKGILQMIGVEVGKGLDLPL

SEQ ID NO: 9014 - protein, 377 aa, Zea mays
  misc_feature (354)..(354): Xaa can be any naturally occurring amino acid
  misc_feature (369)..(369): Xaa can be any naturally occurring amino acid
MARGLWLLSREVGRLRPLLVQGQARGISASTQEQLHVCVVGSGPAGFYTADRMLKGHDGAQVDIIDRLPTPFGLVRSGVAPDHPETKIVLNQFSRVAANGRCSFFGNVTLGRDISLSELRKTYHAVVLAYGAESDRSLGIPGEDLKGIHSAREFVWWYNGHPDMCDFCPDLKNTESAVVLGQGNVALDVARILLRCKAELATTDITDYALDALRGSTIRKVYLVGRRGPVQAACTAKELREILGLKNVRICIKAADLVTTPADEEEMRNSRIQRRVYELLSKTAHGGNNYNGQKELHFVFFRKPIRFIPAENGSTVGAVQLEKTVLKGDEVTGKQVAAGTGEFEDLKCGLVLKXIGYKSLPVQGLPFDXNRGVVPNL

SEQ ID NO: 9015 - protein, 152 aa, Zea mays
  misc_feature (137)..(137): Xaa can be any naturally occurring amino acid
LRPAVVAAASRLGFPRGMARWSGGDGYGAGRDRAPTEMAPLFPGCDYEHWLIVMDKPGGEGATMQQMIDCYIQTLAKVLGCEEEAKKKIYNVSCERYFGFGCEIDEETSNKLEGLPGVLFVLPDSYVDPEYKDYGEXPERQRRVEPVPQRAA

SEQ ID NO: 9016 - protein, 523 aa, Zea mays
MAGGGVAALGVKTERAAQYKGRMTLAVATTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNMMFQLATTLGIFTANLINYGTQNIKPWGWRLSLGLAAVPALLMTLGGLFLPETPNSLIERGRVEEGRRVLERIRGTADVDAEFTDMVEASELANTVEHPFRNILQPRNRPQLVMAVCMPAFQILTGINSILFYAPVLFQSMGFGGNASLYSSVLTGAVLFSSTLISIGIVDRLGRRKLLISGGIQMIVCQVIVAVILGVKFGAEKQLARSYSVAVVVVICLFVLAFGWSWGPLGWTVPSEIFPLETRSAGQSITVAVNLLFTFAIAQAFLSLLCAFKFGIFLFFAGWITVMTVFVYVFLPETKGVPIEEMVLLWRKHWFWKKVMPDMPLEDGWGAAEGHAAPASNNHKG

SEQ ID NO: 9017 - protein, 595 aa, Zea mays
MPLHLHLLSSPATAAKLAAGLRAAPLRRCHSLAPAPRHTDRVALASSLSAVARSAGPAVAAAQTKPSVSGKKQVLISLSDKTDLAYLGNGLQGLGYSIVSTGGTASSLEAAGVSVTKVEEITHFPEMLDGRVKTLHPSIHGGILARRDQEHHLKALKDHGIGTFDVVVVNLYPFYDKVTSGNISFEDGIENIDIGGPTMIRAAAKNHKDVLIVVDHNDYPALLEYLKGKRDDQQFPRMLAWKAMQHVASYDSAVSEWLWKQSNKGEMFPPSFTVPLELKSTLRYGENPHQSAAFYADKSLSLVGAGGIATAIQHHGKEMSYNNYLDADAAWNCVSEFDSPTCVVVKHTNPCGVASRKDILEAYRLAVRGDAVSAFGGIVAFNTTIDEDLAKEIREFRSPTDGETRMFYEIVVAPGYTEKGLEVLRGKSKALRILEAKRSGKGMLSLRQVSGGWLAQESDDLTPEEITFTTKSERSPQENELADAKFAWLCAKHVKSNAIVIAKNNCMLGMGSGQPNRRESVRIAFRKAGEEAKGAALASDAFFPFAWNDAVEEACQNGIGIIAQPGGSKKDEDAVACCNKYGVSLVLTGVRHFKH

SEQ ID NO: 9018 - protein, 126 aa, Zea mays
  misc_feature (67)..(67): Xaa can be any naturally occurring amino acid
  misc_feature (96)..(96): Xaa can be any naturally occurring amino acid
  misc_feature (117)..(117): Xaa can be any naturally occurring amino acid
MDRLVLFSRRRRRWILLTAAGAAAAVGAYKIYHHPVVAERRHRLVRLAAAVAAIADAATSSADAAGXVVSDLADFVRSDADEVPRSVKQLAKLAAXPEVSATVSTLSEAVTSGMFRXAGSSSSGPG

SEQ ID NO: 9019 - protein, 118 aa, Zea mays
CCPVNFEFQNYTIITSKCKGPKFPAGPCCAALKEFACPYYTYLNDESNDCASPMFSYINLYGKYPPGLFSSECKKGKMGLFCANVPRKDSSPANSGYRAQNSLLALITVLRGVAGLFY

SEQ ID NO: 9020 - protein, 172 aa, Zea mays
  misc_feature (110)..(110): Xaa can be any naturally occurring amino acid
MARKFFVGGNWKCNGTAEEVKKIVNTLNEAQVPSQDVVEVVVSPPYVFLPLVKSILRPDFHVAAQNCWVKKGGAFTGEASAEMLVNLDIPWVILGHSERRALLHESNEFXVGDKVAYALCSGLKEIALGGGKLLEQRGGRRPTMACCRLPPTKRYWLAPSGPNCPTRSPLAP

SEQ ID NO: 9021 - protein, 179 aa, Zea mays
  misc_feature (77)..(77): Xaa can be any naturally occurring amino acid
  misc_feature (178)..(178): Xaa can be any naturally occurring amino acid
MARKFFVGGNWKCNGTAEEVKKIVNTLNEAQVPSQDVVEVVVSPPYVFLPLVKSTLRSDFHVAAQNCWVKKGGAFTXGEVSAEMLVNLDIPWVILGHSERRALLNETNEFVGDKVAYALAQGLSVIACVGETLEQREAGSTMDVVAAQTKAIADRVSNWSKVVIAYEPVWAIGTRKVXS

SEQ ID NO: 9022 - protein, 212 aa, Zea mays
MSVTKFIKCVTVGDGAVGKTCMLICYTSNKFPTDYIPTVFDNFSANVSVDGSIVNLGLWDTAGQEDYSRLRPLSYRGADVFVLAFSLISRASYENVLKKWVPELRRFAPDVPVVLVGTKLDLRDHRAYLADHPGASTITTAQGEELRRQIGAAAYIECSSKTQQNVKSVFDTAIKVVLQPPRRREATPARRKNRRGSGCSIMNLMCGSTCAA

SEQ ID NO: 9023 - protein, 456 aa, Zea mays
MTKDEEFKLVKIQNHALKVNIHCDGCKHKVKKLLQKIEGVYSVAIDVDNHKVSVTGDVDSETLIRKLTRGGKHAELWSQHKGGSAQQKQQAQQQQQQKQGANPSKDGHSKSSNNNGGQKKDQGKQGGGGGVGGGLVQGLKAFKNQHGGNKQHHQLPELLSSEDDDGMFEDDVDGEFDDDYEEELRFLGDKMSQLGLHGGGNNNHHHHHNKNGNNVVAVNSNHSNGKKGNGCAAANRHQNNNQNQKNVNVVNMAAANGKMGGGGGVQNHKNANAINMAAAAAAAANAKMANGAQRNAGAMGGIGMLGLSHGLGAGGAAAPPPPGFQGYAGFNHPPYAGAAGYGGGLQQQQQQSNSLMASMQGYHHHHHPAATAAVVNNLRGLNGNMVMMHQHQPQPQPQAQMMYHSSPQISSPYTGYYNPYNYYYNHPHPGSAGYSASNGEVESMFSDENTKGCVVM

SEQ ID NO: 9024 - protein, 71 aa, Zea mays
QYKPKFDAGIAELKGAEKEPQKGSERIKKDLSEMGEMRKKISPMPADVFFEKSPELRKKFADEIRNDNWGY

SEQ ID NO: 9025 - protein, 158 aa, Zea mays
  misc_feature (78)..(78): Xaa can be any naturally occurring amino acid
MGLFTVTKKATTPFEGQKPGTSGLRKKVTVFQQPHYLQNFVQSTFNALPADQVKGATIVVSGDGRYFSKDAVQIITKXWVGQNSLMSTPAVSAVIRERIGADGSKATGAFILTASHNPGGPTEDFGIKYNMGNGGPAPESVTDKIFSNTTTISEYLIS

SEQ ID NO: 9026 - protein, 655 aa, Zea mays
  misc_feature (239)..(239): Xaa can be any naturally occurring amino acid
MIHPLVLSLPSPAIISRPRRHRHHTTTPSLPSHSRSLHHYRLLRVTPLVASCGDRRRIVRGASATMGLFTVTKKATTPFEGQKPGTSGLRKKVTVFQQPHYLQNFVQSTFNALPADQVKGATIVVSGDGRYFSKDAVQIITKMAAANGVRRVWVGQNSLMSTPAVSAVIRERIGADGSKATGAFILTASHNPGGPTEDFGIKYNMGNGGPAPESVTDKIFSNTTTISEYLISEDLPDVXIQCQPAKYFLCFFDSFSGPEGPFDVDVFDSSVNYIKLMKTIFDFEAIKKLLTSPKFTFCYDALHGVAGAYAKHIFVEELGADESSLLNCVPKEDFGGGHPDPNLTYAKELVERMGLGKSSSNVEPPEFGAAADGDADRNMILGKRFFVTPSDSVAIIAANAVQSIPYFASGLKGVARSMPTSAALDVVAKNLNLKFFEVPTGWKFFGNLMDAGMCSICGEESFGTGSDHIREKDGIWAVLAWLSIIAFKNKDNLGGDKLVTVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKTGRDSQEALAPLVDVALKLSKMQEYTGRSAPTVIT

SEQ ID NO: 9027 - protein, 205 aa, Zea mays
MLKQTRNTSNKKNAPNYSTGTRLLPHAGLAWLSIIAFKNKDNLGGDKLVTVEDIVRQHWATYGRHYYTRYDYENVDAGAAKELMANLVSMQSSLSDVNKLIKEIRSDVSEVVAADEFEYKDPVDGSVSKHQGIRYLFGDGSRLVFRLSGTGSVGATIRVYIEQYEKDSSKTGRDSQEALAPLVDVALKLSKMQEYTGRSAPTVIT

SEQ ID NO: 9028 - protein, 268 aa, Zea mays
  misc_feature (214)..(214): Xaa can be any naturally occurring amino acid
SGSPGLQVAGVGSAIAYAKLTSDAALDTPGLVAIAVCHGFALFVAVAIGANISGGHVNPAVTFGLAVGGQITVITGVFYWIAQLLGSTAACFLLKYVTGGLAVPTHSVAAGLGSIEGVVMEIIITFALVYTVYATAADPKKGSLGTIAPLAIGLIVGANILAAGPFSGGSMNPARSFGPAVAAGDFSGHWVYLGWTTSSGGGLGRLIYGNVFMXSSEQVPLASAEFLKETIDDSLDHVSGVTVTYASNFLVFDWKYGPPFPWQIFYPT

SEQ ID NO: 9029 - protein, 389 aa, Zea mays
  misc_feature (356)..(356): Xaa can be any naturally occurring amino acid
MARRRAALAALLVLLLLAACTAAAAAVTVSRKQRQRHHPGGASASAARSCDPFAAAGAWVEDGSYPLYDSARCPFVRDEFACARFGRPDTAYLRYRWRLDAPCAQPAFDGAALLRMWRGKTAMFVGDSLALNQYESLLCMLHAAAGPAARTTLSPPSGKIDPSSTVRFEVLQDYNVTVVYYLTHYLVDLVTEPHTGRRVLKLDAIDRARDWLAADVLVFDSWHWWPRTGATQPWDYMQVGDTVVKDMDRTQAFAKALHTWARWVDANLVQTDTKVFFQGISPSHYRGQDWGASPKKTCMGETRPLNATGPYPGGPIPQQAILRGVLAAMAKPVYLLDFTYLSQLRKDAHPTKLDAXRPGPRLTHWCVAGLPDTWNVLFYAALTAGQGHN

SEQ ID NO: 9030 - protein, 221 aa, Zea mays
LVQGLALASKTFPGVRLRGLPFDCNDIDICKFFVGLDIVDCLLVNKNGRFTGEAFVVFPTAMQTEFALHRNRQNMGRRYVEVFRCKKQEYYSAIANEVSQGGYFESEYRRSSPPPRPPKKPAEDKGSMEYTEVLKLRGLPYSATTEDIIKFFLEYELTEENVHIAIRSDGKATGEAFVEFPTAEVAKTAMCKDKMTIGTRYVELFPSTPEEASRARTRGRH

SEQ ID NO: 9031 - protein, 253 aa, Zea mays
MMGGWGVSDGYEGSKRTRMMMESNPYFAVNAGTGAGASTGIQNFPGVRLRGLPFDCNDIDICKFFVGLDIVDCLLVNKNGRFTGEAFVVFPTAMQTEFALHRNRQNMGRRYVEVFRCKKQEYYSAIANEVSQGGYFESECRRSSPPPRPPKKTAEDKGSMEYTEVLKLRGLPYSATTEDIIKFFLEYELTEENVHIAIRSDGKATGEAFVEFPTAEVAKTAMCKDKMTIGTRYVELFPSTPEEASRARTRGRH

SEQ ID NO: 9032 - protein, 164 aa, Zea mays
  misc_feature (55)..(55): Xaa can be any naturally occurring amino acid
  misc_feature (92)..(92): Xaa can be any naturally occurring amino acid
  misc_feature (95)..(95): Xaa can be any naturally occurring amino acid
  misc_feature (100)..(100): Xaa can be any naturally occurring amino acid
  misc_feature (109)..(109): Xaa can be any naturally occurring amino acid
  misc_feature (149)..(149): Xaa can be any naturally occurring amino acid
MLVYTDLLTGDELLSDSFPYKEIENGILWEVEGKWTTKGCVEVNIGANPSAEEGXEDEGVDDSVEKVVDIVDTFRLQEQPTYEQKGFIRYIXKYXQLLTXKLTPEQQEXLKKGIGGSYQVTFFPSSRDFQFLCWGRGCPKDPPIGFGYXREGVQNPNFLIFPMG

SEQ ID NO: 9033 - protein, 126 aa, Zea mays
ELIESAAEMLYGLIHVRYIITSKGLSAMLDKYRNVEFGRCPRVNCSGQPCLPVGQSDVPRSSTVKIYCPRCEDIYTPRSKYLSNIDGTYFGTTFPHSLLMTYPHLKPQKPLQQYVPRVFGFKIRKP

SEQ ID NO: 9034 - protein, 237 aa, Zea mays
CYGIIQDERRKTWDSWSTKRKLMHILARRFPSLLPFFYRQTFLSGKQGHPESWLSLSLGKKDKTLLEGPAFNAFWERNVAESVRQGDARPFVEEAVLQVSDWGFSLSDIQMQKKEARGFFELIKSLFNQAEREWVGFLGPIHIWQGMDDRVISPSVAEFVRRLVPGATVHKLLDEGHFSYFCFCDECHRQIFSTLFGIPQGPMNPAPQPSEVVSELNEEITVPDNVTDQEQGKSGLP

SEQ ID NO: 9035 - protein, 527 aa, Zea mays
  misc_feature (443)..(443): Xaa can be any naturally occurring amino acid
MTWHEDLATHVGNTGVRLPGAGGHAPAAANVAAAGAGWYGEEEEGRAEEGWAQQAKGFAESTAEMLRELGRGLWDVAAQSLAGAEDSEVARRLRKRAAATGKRLSFMNEYLPEERDPVRCWLTVAAVAFVSLLVLGFGSGNETPVELPKKLIIGPPSADRIQLPDGRHLAYQEQGVSANRARFSLIDPHSFLSSRLTGIPGISASLLEEFGVRLVTYDLPGFGESDPHVGRNLNSSALDMLYLANALNIPEKFWVVGYSGGGMHAWSALRYIPDRIAGAAMFAPMANPYDSKMTKDERRKTWDSWSTKRKLMHILARRFPSLLPFFYRQTFLSGKQGQLESWLSLSLGKKDKTLLEGPVFNAFWERNVAEAVRQGDARPFVEEAVLQVSDWGFSLSDIQMQKKEAGGFFELIKSLFNQAEREWVGFLGPIHIWQGMDDRVVSXAVAEFVRRVVPGATVHKLLDEGHFSYFCFCDECHRQIFSTLFGIPQGPINPAPPQPGEVVSELTEETTVPDNATDEEQGKSGLP

SEQ ID NO: 9036 - protein, 293 aa, Zea mays
MINSNHCSVLYQNVLLLVLMSDLKSYIAARSRGSDIGVIAKIESIDALKNLEEIIRASDGVMVARGDLGAQIPLEQVPSIQQRIVRMCRQLNKPVIVASQLLESMIEYPTPTRAEVADVSEAVRQRADALMLSGESAMGRYPEKALSVLRSVSLRIERWWREEKRQEALELQGVSSSFSDKISEEICNSAAKMANNLGVDAVFVYTKDGYMGSLLSRCRPDCPIFAFTSSTSVRRRLNLQWGLIPFRLSESDDMESNLNRTFSLLKARGMVQSGDLVIALSDMLQSIQVVNVP

SEQ ID NO: 9037 - protein, 917 aa, Zea mays
MVRRKKSKQACSKGLNQRLKEDRISQFYESLLCQILNYLPTKDVVKTSVLSTRWRSLWLLVPSLELDSRDFSDFNTFVSFCDRYFDSNRVLCINKLKLTISENEEDGFYLKSWIDAAAKRKIQHLDVQFLPQFHKIHFNLYKCEALVSLRLFEVSLDKGRIFSFPCMKTMHLEDNVYPNEATFKELISCCPVLEDLTVIIYGMDRKVFQIEGRYDAKFVSFPCMKTMHLEDNMYPNESTFKKLISCCPVLEDLTVIIYGMDRKVFRVHSQSLKRFSLKRVSSFLHEVALSGVVIDAPLLCSLRINDNVSKSFIVNNLGSNDKLDLSILFGLWHFDETSVTSMRSSIDRFLPGILSVMEMTIHSPAFMLMYRYLALIPLPHLPKFSYMSRLSVTLGVSDLQFLPTFLESCPNLKSLIMESNSNSKRMLLNGNYHINFSSVPKCLLSSLEFVDIKSSILVYVARMKLVKYFLENSTTLKKLTLRLALRLQYCSAKDEIVKKLRKFPRISKTCQDLVTTRVLSTRWRSLWLWLPCLELNSLYFPDFNAFVSFGDKFFDSNRVSCINKFKLYIYGYDVGVDDPSYLTSWIDAAVKCKIQHLHVQCLPAKYIYEMPLSLYICETLVYLKLCRVMLDDAEFVSLPCLKTIHLEYVWFPNEANLERFVSCCPVLEELKIYGCGNENAITLRLLSRSLKKLSINILKSMCDFHSEVVIDAPLLSYLKINDNVSERYIVNNLESNAKLDISLPFGLLDFDEASVSSRTDSIHSFLRGILKVSDMTIWVDTFKLICKYSELESLPRFGYMSRLHVTLCIYDLKWLPTFLESCPNLKSLILVCVGDNDEMLSEEMIQFGSSLVPECLLSSLEFVDIRIPFRGHLEVMKLVRYFLENSAILKKLSLDHDIFKKLFTIPRRSTKCQVVFI

SEQ ID NO: 9038 - protein, 549 aa, Zea mays
MARRAASSLVSRCLLARAPAGAPPAAPSAPRRTVPADGMHRLLPGVLQRFSTAAAVEEPITPSVHVNYTKLLINGNFVDSASGKTFPTLDPRTGEVIAHVAEGDAEDINRAVAAARKAFDEGPWPKMTAYERFRILLRFADLIEKHNDELAALETWDNGKPYEQAAQIEVPMVARLMRYYAGWADKIHGLIVPADGPHHVQILHEPIGVAGQIIPWNFPLLMFAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFKKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGMGREKGVDSLKNYLQVKAVVTPIKNAAWL

SEQ ID NO: 9039 - protein, 155 aa, Zea mays
  misc_feature (139)..(139): Xaa can be any naturally occurring amino acid
  misc_feature (146)..(146): Xaa can be any naturally occurring amino acid
MSTIQARWVPIQSPVEDKAMKPLNYETKKPHSYETILRDADLPIPPSTEQLRSGVLLKKLIKYWVDDRNINCFMIFPRKLSITWSDDPNYWTWLPNDSPNEKGVEAAELNNVCWLDITGKFDTSNLTPGITYEVVFKVXKLEDPAXYGWDTPVNV

SEQ ID NO: 9040 - protein, 216 aa, Zea mays
HNDSLLPEGVSRVQQFVEKPDEKRATEFVKSGGYFWNSGMFLFRASRFLEELKKHDPDIYDTCVLTLERSNHTADTIDIDESTFACCPDNSIDYAVMEKTQLACVVPLTAGWSDVGCWASLWDVNEKDANGNVSKGDVVIQDSKNCMIHGNGKLVSVIGLENIVVVETKDAMMIAHKDKVQGVKQMVNTLNEQGRSETQNHCEVYRPWGSYDSVDI

SEQ ID NO: 9041 - protein, 202 aa, Zea mays
MLTRRHGGFRLGRKLLSVWRWALCRRRRRRVRGRGYLRLQPCQRGGGTTKSPSPSPMAAHAVVSIKMMQQQQQKHDDSAGSPRMLTWGRSLARRVRLLRRRGGGGGKDRLLEDAAADATTPKGQVAVYVGGGGESMRYVVPVVYFNHPLFGELLREAEEEFGFQHPGGITIPCAASRFERAAAVAAAGGGAAAGKKVPSVWW

SEQ ID NO: 9042 - protein, 303 aa, Zea mays
  misc_feature (237)..(237): Xaa can be any naturally occurring amino acid
  misc_feature (270)..(270): Xaa can be any naturally occurring amino acid
MAVVVCVTGAGGFIGSWIVKLLLARGYAVRGTSRRADDPKNAHLWALDGAAERLTMVQVDLLDRASLRAAFHGCDGVIHTASPMHDTPEEIIEPVITGTLNVVEMAADAGVRRVVLSSTIGTMYMNPHRDPDAPLDESCWSDLDYCKQTKNWYCYAKTIAERGAWEAARALGLDLAVVIPVVTLGELLQPSMNTSTRHILKYLTGEAKAYVNESHAYVHVKDAAEAHVRVLEAPNAXGRRYVCAERTLHRGELCRNLAGLFPEYPIPTKXKGEVDPPKKGYKKNNQPSEGTWLKGHPLGKNNL

SEQ ID NO: 9043 - protein, 369 aa, Zea mays
MLLFCFVFALEAAGDSADKCLPLFAQPALGRTHSPVRPSVRGAPTRHRHQHHRPPGARHAREEEEEEGTGRQRAMAAVVCVTGAGGFIGSWIVKILLARGYAVRGTSRREAADPKNAHLWALDGAAERLTMLQVDLLDRASLRAAFRGCDGVIHTASPMHDNPEEIIEPIIAGTRNVVEAAADAGVRRLVLSSTIGTMYMDPRRDPDAPLGDSSWSDLEYCKSTENWYCYAKTVAEQGAWEAARARGLDLAVVIPVVVLGELLQPSMNTSTLHRGELCRILAGLFPEYPIPTRCKDQVNPPKKGYKFTNQPLKDLGVKFTPVHGYLYEAVKSLQDKGFLPKTSGAKVPERRSCLPQTTSQPPPEIVSKL

SEQ ID NO: 9044 - protein, 203 aa, Zea mays
GFTAHLPFEAEMKNQDLNTRRSLATPRGVGVMCDFYAVRAENATLWDANGKEYIDFAGGIAVLNTGHLHPKVKAAVSAQLDNFTHTAYQIVPYEGYVSLAERINRLAPIDGLKKSAFFTTGVEAVENAIKIARSATGRSGVIAFSGSFHGRTMLGMALTGKVAPYKLSFGPMPGDIYHVPFPNGTQSITVADSLKALDLLFKI

SEQ ID NO: 9045 - protein, 357 aa, Zea mays
LGTSRPAGIPLSPRHSLPSLPVSSKFNRLQAPIRPISKSQAGRQPTSHGVRAGGADAWALPLSALFLLHVAISHALFTHIDSDDTALDASSPGTDTQRRLLSRLASDWLALLLFKSAYLLALLLLSLLSVAASVFSVASVYSAKRDALTFPRVLSVVPRVWRRLAATFLAAFALLFAYHAVAVLVFVGLLVAADNGSGLAGLLAFLVAVAYLLGLVYLGVVWHLASVVSVLEDHKGFAAMRKSKDLIRGKLVTAGAIFFTLNVVFAAVELGFRAWVVRGSGAASSRLLLGLIMLAALCCVVMLALVTQTVVYLVCKSYHHESLDKANISDHLEVYLGDYVPLKASDVQMEQFQPGNL

SEQ ID NO: 9046 - protein, 562 aa, Zea mays
MGNTCGVTLRSKYFASFRGSASQRRDAPGYSPVATSAAADEPAPYGNGKRATRPSQAAAAADGSAPPPAPGMRRGVPAPAELTANVLGHPTPSLRDHYALGRKLGQGQFGTTYLCTDLATGGLRCKSIAKRNVITKEDVEDVRREIQIMHHLAGHRNVVAIKGAYEDQLYVHIVMEFCAGGELFDRIIQRGHYSERKAAELTRIIVGVVEACHSLGVMHRDLKPENFLLSNKDDDMSLKAIDFGLSVFFKPGQIFTDVVGSPYYVAPEVLRKRYGPEADVWTAGVILYILLCGVPPFWAETQQGLFDAVLKGVIDFDLDPWPVISESAKDLIRRMLNPIPSRRLTAHEVLCHPWICDHGVAPDRPLDPAVLSRIKQFSAVNKLKKMMALQVIAESLSEEEIAGPKEMFMAMDTDNSGAITYDELKEGLRKYGSTLKDTEIRDLMEAADIDNSGTIDYIEFIAATLHLNKLEREEHLVAAFSYFDKDSSGYITVDELQQACKEHNMPAAFLDDVIKEADQDNDGRIDYGEFVAMMTKGNMGVGRRTMRNSLNISMRDTPAGAL

SEQ ID NO: 9047 - protein, 427 aa, Zea mays
AGHSMELEAIGKRLRISSGSSSLAGDRLTSLPDCLIHHIMSFLKARQVVQTCVLSTRWRHLWRSVPCLDIDQDEFKAAGSNRITEKEQEDFEDFTDHLLIPNNISIALLDTLRLHVSDDEYYHRGASVRWIRHGIKYSAQNPGIMHKESNLAFWRLKKLHLSGVYLDGSFMKHVSSGCPYLEVLELKDCPCTFEEVTSHTLKNLILENCGCNELSGITSPTLKSLTIIASGYYNINRLVLKAPAVAYLLLDVNAYFVKRDVSFDEMSSLAKASIYLRDSVGSGLSKDQFKLLCSVSNVTTLVLSGFQTMVISEEFPEFHNLLTLLLEKCDLTDNFQMLANFLQHSPDLEKLTLGRCKFSKDPKKKKGKARLSKGCLNQFNVRCKNLKLTEIIYEDDDAKKVVELLWSMSGDLPKNYIKLTKVDPDHP

SEQ ID NO: 9048 - protein, 245 aa, Zea mays
  misc_feature (231)..(231): Xaa can be any naturally occurring amino acid
MATAARSLHLPGPTPPKSSTPSSHRLPVPCHLRPQRRRLAASSSDLTSFPEPPPAPNGVYVPWAAASSVAAAAASIVVDAATEAELRENGFRSTRRTKLVCTVGPATCAAAELEALAVGGMNVARVNMCHGDREWHREVIRAVRRLNDEKGFAVAVMMDTEGSEIHMGDLGGAPSAKAEDGEVWTFSVRSSDTSLPDRIIHVNYDGFAEDVKAGDELFADRGMARFEVIEXLGPDVKCRWTDPGL

SEQ ID NO: 9049 - protein, 466 aa, Zea mays
MELVTMVTLTLLAYSAAMLARLLVARAQRRRCYLLDYVCYKATDDRKLPTDLCGEIIQRNKLLGLASDKFLLKVIVNSGIGEETYGPRNMIEGGEARPDRLREGMEEMDETFHAVLDELFARSAAPGGVGIRPADVDVLVVNVSMFSPAPSLSARVVRRYGLREDAKVYNLTGMGCSATLIALDLVNGYFRTHAGQVALVMTSESIAPNWYAGNKRTFMLGNCLFRSGGCAYFLTNDPRLRPHAKLRLRHVVRTHTGASDEAYNCALQMEDEAGRPGFHLGKELPRAAVHAFVHNLRVLAPRVLPLPELLRLACATLSARLARKKRQRGAGHGHGHLTIRMKAGVDHFCVHTGGAAVIDGVGKGLTLTEHDLEPSRMTLHRFGNTSASSVWYVLAYMEAKGRLRQGDRVLMLTFGAGFKCNSCVWTVERPATDAGVWKDRIHHYPLKDVSNPFMDKYGFVKDLIDL

SEQ ID NO: 9050 - protein, 341 aa, Zea mays
MEGDEMLRVKLGRQGLEVSKLGFGCMGLTGVYNAPVPDQAGIDIIKHAFEAGITFFDTADAYGPHTNEVLLGKALKHFPREKVQIATKCGIAGFDASGMRVKGTPDYVRACCEASLQRLATDYIDIYYQHRIDQSVPIEETMGELKKLVEEGKVRYVGLSEASADTIRRAHAVHPITAVQLEWSLWTRDIEEDIIPVCRELGIGIVPYSPLGRGFFAGRAAVERVPSESLLSKHPRYSGENLEKNKVLYTRLEMLSKKYGCTPAQLALSWVLHQGEDVVPIPGTTKAKNLDENIGAVKVRLSKEDLEEISGAFPAGEVAGSRLLGVLEPFSWRLANTPPPK

SEQ ID NO: 9051 - protein, 722 aa, Zea mays
MAPHTTAAAGGGGGEEALEEASTLRHRHSAAKDGGEEGQANNGVAASHLVAADDDGEGNALSVERAFADQAVPSWREQLTVRAFVVSFFLAIMFSVIVMKLNLTTGIIPSLNVSAGLLGFFFVRLWTAAIERVGLLRQPFTRQENTVIQTCVVAAYDIAFSGGFGTYLFGMSETIAKQATEADNPQNVKNPHIGWMIGFLFLVSFIGLFALVPLRKVMIVDYKLTYPSGTATAYLINGFHTPEGAKLAKKQVKTLGKFFLMSFLWGFFQWFYTGGDNCGFQNFPTLGLQAYKNKFYFDFSPTYVGVGMICPHIVNVSVLLGGILSWGIMWPLIGNQKGNWYDASLPESSLHGLQGYRVFISIAIILGDGLYNFVKVLIRTTAGFISMMKKNSTLPVSNNGSPITEGVSFDDERRRDLFLKDQIPRSVAYGGYVAVAAISIGTLPQVFPQLKWYYILVAYIFAPVLAFCNAYGTGLTDWSLASTYGKLAIFIFGAWAGASNGGVLVGLAACGVMMSIVSTAADLMQDLKTGYLTLASPRSMFISQVIGTAMGCVIAPCVFWLFYKAFADIGLSGSEYPAPYAIVYRNMAILGVDGFSSLPKNCLTLCYIFFAAAIVVNLVRDLVPKKVARFIPLPMAMAIPFYLGSFFAIDMFIGTVILFAWETINKAKANAFAPAVASGLICGDGIWTLPQSILALAKVKPPICMKFLSRSVNAQVDGFLGS

SEQ ID NO: 9052 - protein, 422 aa, Zea mays
  misc_feature (309)..(309): Xaa can be any naturally occurring amino acid
  misc_feature (343)..(343): Xaa can be any naturally occurring amino acid
MATKYAAAAADLVTGRPRKRARLGWDVASAAEAQIGTFCGQEVGDVASLLLSANPSDHTCSSLLPKGVARNASPPWREDDKDGHYVFAVGENLASRYKIYRKMGEGTFGQVLECWDRESKEMVAIKIVRSVKKYSDAAMIEIDVLQKLAKNDAAGKHCVQIRNWFDYRSHICIVCEKLGPSLYDFLQKTGFHPFPIDLIRRIGQQLLESVAFMHRLQLIHTDLKPENILLVSSDYVKLPDPKDGSFSRKLPKSSAIKLIDFGSAAYHHQDRSYIVSTRHYRAPEVILGHGWSYPCDIWSVGCILVELCXGETLFQTHDNLEHLAMMDRVLGPLPRHMLERADXHAEKYVRKGGLNWPQAITTVESVRAVLKLPRLQNLVMQHVDHSAGDFIDLLKRLLAYEPSGRLTAQEALGHVFFTRYRQ

SEQ ID NO: 9053 - protein, 168 aa, Zea mays
MAALPLATAEVCDANPHLIMNGELRALQPIFQIYGRRQVFAGPIVTLKVYEDNVLVREFLEEKGHGRVLVVDGGGSMRCAILGGNPVQQAQNNGWAGILVNGCIRDVDEINGCDIGVRALSSHPMKANKKGMGEKHVPVNIAGTRICDGEWLYADPDGILVSRTELTV

SEQ ID NO: 9054 - protein, 565 aa, Zea mays
MGSTAAVSVSASAIASRGCARSEAARRPGGIRVCGLRSEALTCHSLRISQAPARLTVARPPPPAAATNGAAAGTCGFDYDLVIIGAGVGGHGAALHAVEEGLKTAIIEGDVVGGTCVNRGCVPSKALLAVSGRMRELHDEHHMKSLGLQVSSPGYDRQAVADHANNLASKIRINLTNSMKALGVDILTGVGTIVGKQKVRYGKAGFPDKEITARNIIIATGSVPFVPKGIEIDGKTVFTSDHALKLESVPDWIAIVGSGYIGLEFSDVYTALGSEVTFVEALDQLMPGFDPEIAKLAQRVLINPRKIDYHTGVFASKITPAKDGKPVLIELIDAKTKEHKETLEVDAALIATGRAPFTKGLGLENINVVTQRGFVPVDERMRVMDADGNVVPNLYCIGDANGKLMLAHAASAQGISVVEQISGKDHILNHLSIPAACFTHPEISMVGLTEPQAREKADKEGFEINVVKTSFKANTKALAENEGDGIAKLIYRPDTGEILGVHILGLHAADLIHEASNAIALGTRVQDIKFAVHAHPTLSEVLDELFKAAKVNSGVSHSVNEPVAA

SEQ ID NO: 9055 - protein, 514 aa, Zea mays
MPAGGFSVSAPSGVEFEAKITPIVIISCIMAATGGLMFGYDVGISGGVTSMDDFLGKFFPAVLRKKLEDKESNYCKYDNQPLQLFTSSLYLAGLTATFFASYTTRRLGRRLTMLVAGVFFIVGVIFNGAAQNLAMLIVGRILLGCGVGFANQAVPLFLSEIAPTRIRGGLNILFQLNVTIGILFANLVNYGTSKIHPWGWRLSLSLAGIPAALLTLGALFVTDTPNSLIERGRLDEGKAVLKRIRGTDNVEPEFNEIVEASRVAQEVKHPFRNLLQRRNRPQLVIAVLLQIFQQFTGINAIMFYAPVLFNTLGFKSDASLYSAVITGAVNVLSTLVSVYSVDRVGRRMLLLEAGVQMFLSQVAIAIVLGIKVTDHSDNLGHGWAIMVVVMVCTFVSSFAWSWGPLGWLIPSETFPLETRSAGQSVTVCVNLLFTFVIAQAFLSMLCHLKYAIFVFFSAWVLVMSLFVLFFLPETKNVPIEEMTERVWKQHWFWKRYMDDDNHHIVNGKLTGASV

SEQ ID NO: 9056 - protein, 600 aa, Zea mays
MPLYLFSPAAAKLATGPHASLHRRRQFLFRVPHRPSRRAPLLTSAAERPAGRTMATADTGASTVTDSRLRATGVKQALISLSDKTDLANLGNGLQRLGFSIISTGGTASSLEASGVNVTKVEEITQFPEMLDGRVKTLHPSIHGGILARRDQEHHLKALKEHGIGTFDVVVVNLYPFYDKVTSGAISFEDGIENIDIGGPTLIRAAAKNHKDVLVVVDHKDYPALLEYLEGKQDDPDFRRTLAWKAFQHVASYDSAISEWLWKQSNKDSFPPSFTVPLTMKSTLRYGENPHQKAAFYGDRSLSLVNAGGIATAIQHHGKEMSYNNYLDADAAWNCVSEFESPTCVVVKHTNPCGVASRHDILEAYRLAVRADPVSAFGGIVAFNTTVDEDLAREIREFRRPTDGETRMFYEIVVAPGYTAEGLEVLKGKSKTLRILEAKRRRSGKGTLLSLRQVGGGWLAQEPDDVTPEDVAFTNVSERAPDARELSDAKFACLCVKHVKSNAIVIAKNSCMLGMGSGQPNRLESLRIAFRKAGEEAKGAALASDAFFPFAWNDAVEEACQRGVAVIAEPGGSIRDQDAVECCNKYGVALVFTGVRHFRH

SEQ ID NO: 9057 - protein, 581 aa, Zea mays
MGNTCIGPSAPSDRHSFFNTVSLAVLWRTPAAADPAEPSPTAEPSSSTPCSPPSRAPNPVTISDSEHPPHSTSTALGPAAPPNPNGKPKPKPKVKRVQSAGLLAGSVLKRDSERLKDVYTLGKKLGQGQFGTTYQCVEKATGKHFACKSIAKRKLVTDEDVEDVRREIQIMHHLAGHPNVVSIVGAYEDAVAVHLVMELCAGGELFDRIIQRGHYSEKAAAQLARVIIGVVEACHSLGVMHRDLKPENFLFVNQKEDAPLKAIDFGLSIFFKPGEIFSDVVGSPYYVAPEVLKKRYGCEVDVWSAGVIIYILLSGVPPFWAESEQGIFKQVLKGGLDFSSDPWPSISESAKDLVRKMLNRDPRKRLTAHDALCHPWVCVDGVAPDKPLDSAVLTRLKQFSAMNKLKKMALRVIAENLSEDEIAGLKEMFKMLDTDNSGQITLEELKIGLKRVGANLKDSEITTLMEAADIDNSGSIDYGEFLAATLHLNKVEREDNLFAAFSYFDKDGSGYITHDELQKACEEFGIEDAHLEDIIHDVDQDNDGRIDYNEFVTMMQKGNNPLGKKGHCQMSFGLREALKLG

SEQ ID NO: 9058 - protein, 239 aa, Zea mays
SPTRPPTRPRTRGLARSEVEDVHETAAGALWNLAFYSGNALRIVEEGGVPVLVKICSSSRSKMARFMSALALAYMFDGRMDEVALVGASSDSSSKSVNVEGARRIAFKHIETFVLTFSDPQMFSMAAASSAPAALSHVAEAVFIHEAGHLRCSRSEIGRFVSMLRNPSPILRACAAFALLQFTIPGGRHAVHHAGLLQEAGAGRVLRAAAAATTASIEAKIFARIVLRNLEHHQLGMST

SEQ ID NO: 9059 - protein, 426 aa, Zea mays
MADLTDIGCCSCFSFLRKPSVPVRQHQDADGMLSEDLLKRQSAEDPDGSFYTGDDPDVSFYNGDDLDRSFYNGDDPDRSFYDRDDTDYIEGSDDGPPRKSSEDIVQLRTQNGFACREISVKETKKVFRSEDENGNKMVNQYVHLGKIGSGSYGKVVLYRNIKDGKLYAIKVLNKPYMMKVRVVRTETAMTDVLREVSIMKMLNHPNIVNLVEVIDDPNIDKFYMVLDYVEGKMVCDNGLEEGTARNYLRDIISGLMYLHSHNVIHGDIKPDNLLVTSAGNVKIGDFSVSQVFEDDDDMLWRSPGTPVFTAPECCQGSAYHGRASDTWAVGVTLYCMVSGHYPFLGDTLQETYDKIANDPVQIPGDMNPQLADLLLRLLCKDPGDRITLQAAAEHPWVAGDEGPVPEFICRCGFGRRKRNDVREEVQ

SEQ ID NO: 9060 - protein, 475 aa, Zea mays
MGALLLFAVCLLAPIVLACAVRGRKRRAAAPAPAPACGKKALPLPPGSMGWPYVGETLQLYSSKNPNVFFARKQNRYGPIFRTHILGCPCVMVSSPEAARFVLVTQAHLFKPTFPASKERMLGPQAIFFQQGDYHARLRRLVSRAFSPQAIRASVPAVEAVALRSLRSWDGRLVNTFQEMKLYALNVALLSIFGEEEMRYIEELKQCYLTLEKGYNSMPVNLPGTLFHKAMKARKRLSAIVAHIIEARRERPRPRGSDLLASFLDGREALTDAQISDNVIGVMFAARDTTASVLTWMVKFLGDHPAVLKAVIEEQQEIARSKGSSGDEPLTWADTRRMRVTSRAIQETMRVASILSFTFREAVEDVEYQGYLIPKGWKVLPLFRNIHHSPDHFPCPDKFDPSRFEVAPKPNTFMPFGNGTHSCPGNELAKLEMLVLFHHLVTKYRWSTSKSESGVQFGPFALPLNGLPMTFARKD

SEQ ID NO: 9061 - protein, 511 aa, Zea mays
LLVVPLLLLLLSPLLCLLSSGRRRRREQGAAERRRAPPGPPKQLPVLGNLLQVGSRPHRYFQAVARRYGPIVEVQLGRVRTVVVSSPDAAKEVLRTNDLHCCSRPNSPGPRMLSYDFLDVAFSPYSDYWREMRKLFILELLSMRRVQSFAYARAAEVDRLVSSLASTPPGAAVDLSEKLYALSDGVVGTVAFGKMYGSAQFERSSFQRVMDETLRVLGSFTFEDFFPASRLARFADVLTGAAGRRSRIFRQIDRFFDSVIDKHLEPERLQAGVQEDMVDALVKMWREEQADGYEAPHGLTRDHIKGILMNTFAGGIDTCAVTMIWIMAELMRNPRVMQKAQAEVRTLVGNKPRVDEEDVKSLSYLKMVVKENFRIHPPGTLLIPRETMRSCVIGGYDVLPGTRIFVNVWAMGRDASIWDRPEEFSPERFEGSHVDFRGSSFELLPFGSGRRSCPAIAMGVANVELVLANLLHCFDWELPDGMVEEDIDMEETGQLAFRKMVPLCLVPIKRV

SEQ ID NO: 9062 - protein, 575 aa, Zea mays
MAARRQHRRGFPLVPLLLSLLAAAAYGRLISDGGPSAQLLSVIRLSGSSPAAGAANKAEEKCEQSYGFLPCTTTVLGNLFLVLTYGYLMYKAATYLSAGSELLLEIMGPGLVGGLLLPILGALPDALLVLVSGLSGSKEEAQSQVLIGMGLLAGSTVFLLTLLWGTCVVVGKCDLGPNREAVDVTDTKGFSLTGTGITTDVQTSYAARIMGLSVIPFIIAQFPKMLKTHHGQRLAMLLALIVSFLLVLSYCLYQVFQPWIQRRKLAYAKHKHVISGILRHAQMQSLGRLLNDDGTPNDDVIRKLFRKIDMDESRSLSRAELHALIVGINFEEVDFDRTDAVDKVMDDFDTSRNDVVEEEEFVQGMRKWLDEARRSVPVGGAFSSKFIHEYHERTRQEHDELVDRSDEAVESVENPGWCIAKAVALLLLGSAAAAAFADPLVDAVHGFSNATRIPSFFISFIALPLATNSSEAVSAIIFASRKKQRTCSLTFSEVYGGVTMNNTLCLGVFLALIYFRNLTWDFSSEVLIILLVCVVMALFTSFRTTFPLWTCLVAYMLYPLSLIIVYILDYVFGWS

SEQ ID NO: 9063 - protein, 257 aa, Zea mays
MADSMVASFWGPVTSTTELCEENYAHSSYIAEFYNTISNVPCVLLALIGLVNAFCQGFEKRFSVLHISNMILAIGSMIFHATLQLLLQQSDETPMVWEILLYMYVLYSPDWHYRSTMPTFLFLYGAAFAVVHFFARFQVVFKLHYVGLCLLCIPRMYKYYIQTKDVGAKRLAKLWVLTLTLGTLCWLVDRVFCKKLSHWYVNPQGHAWWHVLMGLNSYYANTFLMFCRAQQRGWEPRITHLLGFLPYVKVQKPEKRE

SEQ ID NO: 9064 - protein, 489 aa, Zea mays
MSKEDVLKVQTLMLRVNIHCDGCEKKVKKTLHKIDGVYQSSIDAEQGKVTVSGLLDPDTIIRKLNKAGKPAQLWGSKPGITQNAYHGGGKAHSKDAGGGKSHSKDSGGGKGHSKDAGGGKAQKGGAGGGGHKGPGGGGGGGGGVGNPKMVMPQPTPQQLQQLQQQLQMKGLKLPPHLLGGNMPAFPAAAPMKDPKSVKFALPEDNFDDYGSEFDDDFDDGFDDDEDDYDDDGLDDDVYGDPKMMMKPMAVPPPAGGGDKKGGGGKKGGGGGNEIPVQIKGNNHGGAGGQPHNAKGGAPGGGAHLGQGKKGGGSAAAVGVGGPMGGMLPQQGMMRPPNILGGAGAGFPSTAQMGGGPMGMPVGHPHMGIMQQGGGGGGGGMPGLGFHPGLGGGGMHSGADMLQAAAASGNPVAQQQYMALMQQQQQQMMMMQQQQQQHGNGGLGYPAAMGYGYGRPPMHYPMGYPVLPPHSHAEPYNIFSDENANSCSLM

SEQ ID NO: 9065 - protein, 395 aa, Zea mays
MSIPRLLLLAVLAAAAACAPAHAAGAGACAAEKFSGNRAFAACADLARLGASLHWSYDAAAASLSVAFLAAPPSAGGWVAWGLNPRAQSMDGTQALVAVPSSGGGGAYEVQTYSISGTSLGAPGPLSAYRTSGLAAEVGGDGRVRVFATLVLPNGTGAEVNHVWQVGPYSGGIQIHDTKGDNMNAKGTLNLLTGATAAASGGGSIIRKKNTHGILNAVSWGLLLPMGAIFARYLKTFRSADPAWFYLHVACQLLGYGVGVSGWATGIHLGNLSKGITYSLHRNIGVTVFALGTLQIFALFLRPKKDHKYRVYWNAYHHSVGYTVIVLGVVNIFKGMAILDVEQRWKTGYIAAISVLGAVAVALEAVTWGVVLRRRKEESKSYNGTSNGGRLPLSM

SEQ ID NO: 9066 - protein, 372 aa, Zea mays
MDSSGGGGGAQIKGMATHGGRYVLYNVYGNLFEVSSKYAPPIRPIGRGAYGIVCAAVNSQSGEEVAIKKVGNAFDNHIDAKRTLREIKLLRHMDHENILALKDVIRPPTRENFNDVYIVTELMDTDLHQIVRSNQPLTDDHCQYFLYQLLRGLKYVHSANILHRDLKPSNLFLNANCDLKIADFGLARTTSETDLMTEYVVTRWYRAPELLLNCSQYTAAIDVWSVGCILGEIVTRQPLFPGRDYIQQLKLITELIGSPDDASLGFLRSDNAKRYMKQLPQFPRQDFRLRFRNMSPGAVDLLERMLVFDPSRRITVDEALHHPYLASLHEINDEPTCPAPFSFDFEQPSFTEAHIKELIWRESLAFNPEPPY

SEQ ID NO: 9067 - protein, 517 aa, Zea mays
  misc_feature (100)..(100): Xaa can be any naturally occurring amino acid
  misc_feature (125)..(125): Xaa can be any naturally occurring amino acid
METYTTDDALTIMGFGKFQALVLFYAGMGWVAEAMELMLLSFLGPFIREEWNVSPENESLLSSVVFAGMLLGACAWGFVSDKYGRSGIGSGLLMASGWTXICFVSKLTSHVSNLPHTMIHKDYRXGLIFSTLFTSGMGFLSALSPNYLCLVALRFLVGVGVGGSHVFISWFLEFVPAQNRGTWMVIFSLFWTLGTILEASLAWVVLPALNWRWLLVFTALPCFLLLPFFGLTPESPRYLCAQNRMSDATSVLERMANANQSALPPGVLTYNRQTKCDHDVLAPESECLLPVREKECTVDNAKSSESGSLAALRMLLSRELLRSTLLLWFVFYANSFAYYGLVLLTSQLSDANKSCASGVSFGLRQKEINLYKDTFITSLAEIPGLFLSAVLVDWFGRKASMWSMMFACCAFLGPLVLQQTELLTTILLFGARACAMGSFTVLCLYAPEVYPTFVRSTGAGIATAIGRIGGVVCPLVAVAMLRSCHQMEALIVFEVILCLAAVACMFFPVETKGRGMD

SEQ ID NO: 9068 - protein, 586 aa, Zea mays
  misc_feature (115)..(115): Xaa can be any naturally occurring amino acid
  misc_feature (186)..(186): Xaa can be any naturally occurring amino acid
  misc_feature (277)..(277): Xaa can be any naturally occurring amino acid
MAGGGGGGPGPGPGRVKAGSRPPWVGLAAAVWVQVAAGSAYVFPLYSHAVKEALGYNQQALTMLGVGNDVGENVGLVPGLLANRLPPWLILVIGSACAFFGFGTLWLAVTKTVAXPYWVLWIALCIGTNSSAWLGTAALVTNMRNFPLSRGTVAGLIKGYVAVSAAVYTETFNGMLGNSPTNLLMXLALGIPTACIVVMYFVRPCTPSLDEDNSTEHSHFMYTQISSVVLGIYLMVATILGDTLKLSQAVTYLLFGIMILLLLAPLAIPIKMTLYPXQTNKGKRPAPLAPSYSTDSLSGADPENSQPLLGSASTTLATGTNESDDSTDLDLLLAEGEGAVNLKKKRGPRRGDDFTFLEALVKADFWLLFVVYFCGVGTGVTVLNNLAQIGMSVGANDTTILLCLFGFCNFAGRILGGSVSEYFVRSRMLPRPFWMMCTQIIMVVTFLLFATGLHSLIYVSTTLLGICYGVQFAVMIPTVSELFGLRDFGLMYNFMLLVNPLGAFFFSALLAGYIYDKEAARQHPGVLEPSDCYGPDCFRLTFYVCAVVCCCGTLLGVFFISRIKPVYQMLYASGSFRHPRSQQQLH

SEQ ID NO: 9069 - protein, 499 aa, Zea mays
FLRNSGGRALPFDDNINFHKTIAAAIVVGVVLHAGNHLVCDFPRLISSSEVKYAPLRKYFGENKPTYLDLVKGVEGITGIIMVVCMLIAFTLATRWFRRSLVKLPRPFDKLTGFNAFWYSHHLFIIVYISLVIHGECLYLIHDWYKRTTWMYLAVPVGLYVGERTLRFFRSGSYSVRLLKVAIYPGNVLTLQMSKPPTFRYKSGQYMFVQCPAVSPFEWHPFSITSAPGDDYLSIHVRQLGDWTRELKRVFSAACEPPVGGKSGLLRADETTKKALPKLLIDGPYGSPAQDYSKYDVLLLVGLGIGATPFISILKDLLNNIIKMEEEEEASSDLYPPIGRSKAHVDLDTLMRITSKPKRVLKTTNAYFYWVTREQGSFDWFKGVMNEIAELDQRNIIEMHNYLTSVYEEGDARSALITMLQALNHAKNGVDIVSGTKVRTHFARPNFKKVLSKIATKHPYAKIGVFYCGAPVLAQELSKLCYEFNGKSTTKFEFHKEHF

SEQ ID NO: 9070 - protein, 418 aa, Zea mays
GREKKKKALALAPPKPSSRTGDTPPRTRKNRIDLRIFLTIGMVGTAVFTALFGAGYWLNVHSFYYFLVVQMVSGLFQSVGWPSVVAVVGNWFGKSKRGLIMGVWNAHTSIGNIAGSLLAAFLLEFGWGWSFAVPSLVMALVGLVVYVSLPVSPEVMEIDIAGSGELNCEKDTGTVKEPLLEPGQQVKHKAVGFLEAWRIPGVAPFALCLFFSKLVAYTFLYWLPFYISHTRIGGVYLSDAMAGSLSTIFDVGGVLGGVLAGHISDRLNARAITAASFMYCAIPALFLYRAYGSTSMAWNVCLMFVTGMFVNGPYALITNAVSADLGTHSSLNGNSRALATVTAIIDGTGSIGAAIGPLLTGYISSKSWSAVFTMLMAAALLAGLLLTKLVCAELQGKTPTSASKDVADAQGTYYSDEV

SEQ ID NO: 9071 - protein, 596 aa, Zea mays
MVEIGSRVRGFLRNRWLVFVAAMWMQSCAGVGYLFGSLSPVIKASLGYNQRQVAGLGVAKDLGDSVGFLAGTLCSVLPLWAALLVGAAQNLVGYGWVWLAVTRRVPVPPLWAMCILIFIGNNGETYFNTAALVSCVQNFPKSRGPIVGILKGFAGLSGAILTQIYAIVHSPDDAALIFMVAVGPTMIVIALMFIVRPVGGHRQVRPSDNTSFTFVYSVCLLLAAYLMGVMLLEDLVDLSQSVTVLLTIVLIIFLLVPIVIPVLLSFFSDDDETLHALLLPSPRKEEPSASTSSEEQQEVILSEVEDEKPKDVDLLPASERQKRIAELQTRLFQAAADGAVRVKRRKGPRRGEDFTLMQALIKADFWLLFFSLLLGSGSGLTVIDNLGQMCQSLGYEETHIFVSMISIWNFLGRIGGGYFSEIIVKDYAYPRAIALAIAQILMAIGHFNFAMAWPGTMYVGTLLVGVGYGAHWAIVPAAASELFGVKNFGALYNFLTVANPAGSLVFSGVIASGIYDAEAAKQAQQRHSTSKLLATSGRVVSVVSEAAPALKCEGAICFFLSSLIMAGFCVVAFGLSLILVYRTKVVYAGLYGKPRT

SEQ ID NO: 9072 - protein, 243 aa, Zea mays
GRDLPFLFPLSLSLSLSLSLSLSLPPAPRPPPLPAPQTKAAAPRDAADDEDNVVSLKVSLLGDCQIGKTSFMVKYVGIRHDGEEQNGLQMTGLNLMDKTMPVRGAKIAYSIWDVAGDHQSVDHVPIACKDAVAILYMFDLTSRCTLNNIVDWYGRARKWNKTAIPILIGTKFDDFAQLPLEMQWTIVNQARAYARAMKATLFFSSATHNINVNKIFKFITAKLFDLPWTVERNLTIGEPIIDF

SEQ ID NO: 9073 - protein, 610 aa, Zea mays
  misc_feature (194)..(194): Xaa can be any naturally occurring amino acid
MDLAPQGLITQQQKANERRPVGSSQIWTRYGVLLPSQQTRKLKEWILTDEQQQLVNASGLGHLALTTGFTIDRSLLTSFCERWNNETNTAHFMGFEIAPSLRDVSYILGIPVTGHVVTAEPIGDEAVKRMCLHYLGESPGNGEQLCGLIRLTWLYRNFHQLPEHPTINKIAYSTRAYLLYLVGSTLFPDTMRGXVSPRYLPLLADFGKIREYAWGAAALAHLYRGLSVAVTPNATTQFLGSATLLMAWIYEYLPITQPQQKNQSTLLPRACRWNFGGATRGQRKKVMDWRKVFEQLQFSEVNWNPYKDMNPAIVPEYCIAADNICYSRTWLISFNIKEAYVPDRFARQFGREQGRLHGVPMWTRRTWSKWKDWMTEYAREIEEFHQLVGCHFTPPAETNINSFPLHESSAGQNDAGCSLNISHNFSAMVEDLKNDLPVIGRYLEGNLLPSDVASFLERVSTMIKSYTPPQGSRRKDRVSHGHADPVRSKNPRKRGRHSLFQDSFPHRYLSTPVNIVFDGTIPLLNGGEALKEQVAMDPWRVSQSHLTMTTSSSSLDSSSPESMKRRREGGDEIPITRDTDCLQSGRLCVQLKMFKHRDGVNAEAANPIFR

SEQ ID NO: 9074 - protein, 178 aa, Zea mays
MDCGSDSDGAPEELTAVQGVEKHEEISQVEKDSAIRVTREGKERRKRWAQRRTSSKPDKKAPKEVVEDEGTKQSEETDTMPGMLPTSVIEILAAREKQTFASDSEEENVKQKVQKRKKRMKTAGPETILLKDVRSTQHVKNALDFLEQRKNQVPRSNAVLKNASKALRLLSSKGNFLS

SEQ ID NO: 9075 - protein, 180 aa, Zea mays
MDSGSDSDGAPEELTAVQGVAKHEEISKVEKDSVLRVTREGKERRKRWAQRRTSSKPDKKAPKEVEDEDTKKSEEHEEINTMPGMLPTSVIEILAAREKQTFASDSEEENVKQKVQRRKKRMKTDGPETILLKDVRSTQHVKNALDFLEHRKNRVPRSNAVLKNASKALRLLSSKGNFLS

SEQ ID NO: 9076 - protein, 225 aa, Zea mays
MDMEVYERLTAETSHYRGTRFDALIGLDEVEPSDEEEDEEEEERAAGAGAGDELLCPFCSEELDAVGLWCHMDDEHRAEVNAGVCPICTDKVDMNLIVHISSQHRGFLKDKWRNQQGSSGVRYSTLALLKKDLHERISGSSRAAPVSTVPDPLLSSFVGSFYEVDLPKDAKKESLVETEVRSDNIEQRAAESFDEPLLPEVKEEKTRRSQFVQGLVLSLMFDDIL

SEQ ID NO: 9077 - protein, 118 aa, Zea mays
CCPVNFEFQNYTIITSKCKGPKFPAGPCCAALKEFACPYYTYLNDESNDCASTMFSYINLYGKYPPGLFSSECKEGKQGLSCADVLERDSATASSGHHAQISLLALITVLSVVVALFH

SEQ ID NO: 9078 - protein, 507 aa, Zea mays
MASPAPASPAAATAHCPPPRIGLAGLATMGQNLALNIAEKGFPISVYNRTAAKVDSTLSRARDEGSLPVLGHRDPRGFVLSLARPRAVVLLVQAGPAVDATIQALSPYLEPGDAIVDGGNEWYQNTERRIQEAAARGVLYLGMGVSGGEEGARNGPSLMPGGSADAYANIRDILQKAAAQTEDGACVTFVGPGGAGNFVKMVHNGIEYGDMQLIAEAYDVLRRLGGLSNSEIADVFAEWNRGELESFLVQITADIFTVADPLDGSGSGGGALVDRILDKTGMKGTGKWTVQQAAELAVAAPTIAASLDGRYLSGLKDERVAAAGVLEEEGMPAGLLETVNVDKKVLVDRVRQALYASKICSYAQGMNLLRAKSVEKGWNLNLAELARIWKGGCIIRARFLDRIKSAYDRNPELANLIVDREFAREMVQRQNAWRWVVARAVEAGISTPGMTASLSYFDTYRSSRLPANLIQAQRDLFGAHTYERIDCPGSFHTEWTKLARRSNGAAI

SEQ ID NO: 9079 - protein, 473 aa, Zea mays
MAGAAAAAVASGVSARPAAPMRASAGRRARLSVVRAAISLEKGEKAYTVQKSEEIFNAAKELMPGGVNSPVRAFKSVGGQPVVFDSVKGSRMWDVDGNEYIDYVGSWGPAIIGHADDKVNAALIETLKKGTSFGAPCLLENVLAEMVISAVPSIEMVRFVNSGTEACMGALRLVRAFTGREKIIKFEGCYHGHADSFLVKAGSGVATLGLPDSPGVPKGATYETLTAPYNDVEAVKKLFEDNAGEIAAVFLEPVVGNAGFIPPQPGFLNALRDLTKQDGALLVFDEVMTGFRLSYGGAQEYFGITPDVTTLGKIIGGGLPVGAYGGRRDIMEMVAPAGPMYQAGTLSGNPLAMTAGIHTLKRLTEPGTYEYLDKITGELVRGILDVGAKAGHEMCGGHIRGMFGFFFTGGPVHNFGDAKKSDTEKFGRFYRGMLEEGVYFAPSQFEAGFTSLAHTSQDIEKTVEAAEKVLKRI

SEQ ID NO: 9080 - protein, 680 aa, Zea mays
MVVNGRPLKRARARVEARDFARFPAAGDCGAAGTFREAVRGFLAKHARLLPLPSIFSPAAAAAPPHLLIWRVSLRVGEAGEEESGGGVELNVVEEDVLRSRSVYCDQCRVVGWSGHPVCVKRYHFIIENDSSHLSGRRRTCCLRCGTPMAAGESRCALCNFDMDGEEIEECAYLHLDDPTHLLHAVVHANGYGHLLRVNGREGGSRFLTGRDIMSLWDRLCKVLHVRKVTVMDISKKHGMDYRLLHAVISGHPWYGQWGYKFGAGSFALTSDTYRNAVDMLSSINLALYFSHRSQIRTPLQNTIALYWALSNRQLVTLRDLFRFIMHLLHQGQKMSKPSADKHKELTSNELCAWTKEDLHRAEGAMLKVLQVVQTGQWVSWRALRGAASKAVDSQELLDYSLRGLGGKQLDNGLCVAVRCNAGTSAIEYRLESSSVRSPANAATFGPSVDQLLHDLRFLYDALLNPESMLSSQPEVVGASAHSAAAKIIDCKQFIKHYDEHALRTPSNPFLLCVRCSIELLDHPKDYTTPPEELVLLPASATLGDLKVQASKAFQETYLMFQSFQTEQLPDFPNFSDTTPVKHVLGSGQLLRVRGRCTGDYRRIVQFRMERGLENWTVDCSCGAKDDDGERMLACDICGVWQHTSNGGGTMEVTASGRCKDEIGASVGGAGKYGRMATVG

SEQ ID NO: 9081 - protein, 713 aa, Zea mays
MVVNGRPLKRARARVEARDFARFPAAGDCGAAGTFREAVRGFLAKHARLLPLPSIFSPAAAAAPPHLLIWRVSLRVGEAGEEESGGGVELNVVEEDVLRSRSVYCDQCRVVGWSGHPVCVKRYHFIIENDSSHLSGRRRTCCLRCGTPMAAGESRCALCNFDMDGEEIEECAYLHLDDPTHLLHAVVHANGYGHLLRVNGREGGSRFLTGRDIMSLWDRLCKVLHVRKVTVMDISKKHGMDYRLLHAVISGHPWYGQWGYKFGAGSFALTSDTYRNAVDMLSSINLALYFSHRSQIRTPLQNTIALYWALSNRQLVTIRDLFRFIMHLLHQGQKMSKPSADKHKELTSNELCAWTKEDLHRAEGAMLKVLQVVQTGQWVSWRALRGAASKAVDSQELLDYSLRGLGGKQLDNGLCVAVRCNAGTSAIEYRLESSSVRSPANAATFGPSVDQLLHDLRFLYDALLNPESMLSSQPEVVGASAHSAAAKIIDCKQFIKHYDEHALRTPSNPFLLCVRCSIELLDHPKDYTTPPEELVLLPASATLGDLKVQASKAFQETYLMFQSFQTEQLPDFPNFSDTTPVKHVLGSGQLLRVRGRCTGDYRRIVQFRMERGLENWTVDCSCGAKDDDGERMLACDICGVWQHTRCSGISDFEEVPENFICRKCASPRKGDGRGGGGSNGGGTMEVTASGRCKDEIGASVGGAGKYGRMATVG

SEQ ID NO: 9082 - protein, 341 aa, Zea mays
MHLESERMANTAKGKVCVTGASGFIASWLVKRLLESGYHVLGTVRDPGNGKKVGHLWGLEGAKERLQLVRADLLEEGSFDDAVMACEGVFHTASPVVTGSNSKEEMLDSAINGTMNVLRSCKKNPSLKRVVLTSSSSTVRIKDEADLPPNVLLDESSWSSIEFCESLQIWYAVAKILAEKAAWEFAGEHRIDLVTVLPTFVVGPTLSPELGPTASDVLGLFQGETGKFTTYGRMGYVHIDDVARCHMLAYEAAGARGRYICSAAVLDCGDLAALLARRFPAYPVPRSLPRAYGEQSYGFDTSKARALGLAEFKGVEEMFDDAVASFIGHGHLPAAEERRHA

SEQ ID NO: 9083 - protein, 498 aa, Zea mays
MKGSSHSQAGAQAVRRRRWGCLLPLLVGAAFLAEIAFLGRLDMAKNAEAVESWTTSFYRRSADLGDAVGGGAASRAGGDSEDEEIRLCEQRLEREDAVPYDRDFDSDPVLVGGAAKDWNKCYVGCEFGFSASKTPDATFGIAPDPSVDGILRSMESSQYYSENNIDVARGRGYKIVMTTSLSSDVPVGYFSWAEYDIMAPVPPKTEEALAAAFISNCGARNFRLQALEMLENLDVKIDSYGSCHRNRDGKVDKVDTLKRYRFSLAFENSNEEDYVTEKFFQSLVAGSIPVVVGAPNIQEFSPGEGAILHIKELDDVASVAKTMKNIASNPDAFNQSLRWKYDGPSDSFKALIDMAAVHSSCRLCIHIATKIHLKEERTPKFTNRPCSCSTKKGTIYHLFIRERGRFKSESIYMRSGQLTLGALESAVLGKFRSLNHVPVWKDERPPSIRGGDDLKLYRIYPVGLTQRQALYGFRFRDDSELEQYIKDHPCAKLEVIFV

SEQ ID NO: 9084 - protein, 386 aa, Zea mays
MAKPVSIQVWNPSGKYRVVSTKSMPGTRWIRLLTDNDCRLEICTEHKTILSVDDILALIGDRCDGVIGQLTEDWGDVLFSALKRAGGTVFSNMAVGYNNVDVEAANRNGIAIGNTPGVLTETTAELAASLSLAAARRIVEADQFMRAGLYDGWLPHLFVGNLLKGQTVGVIGAGRIGSAYARMMIEGFKMNLIYYDLYQATRLENFVTAYGQFLKANGEEPVTWKRAATMEDVLREADVISLHPVLDKTTYHLINPERLAIMKKEAVLVNASRGPVIDEAALVEHLKANPMFRVGLDVFEDEPYMKPGLADMKNAVVVPHIASASKWTREGMATLSALNVLGKIKGYPVWGNPNQVEPFLQENLTPPPACPSIVNAKQIGLPSAKL

SEQ ID NO: 9085 - protein, 371 aa, Zea mays
  misc_feature (217)..(217): Xaa can be any naturally occurring amino acid
MAPVEAEQHRRRALALAAHDASGAVSPIRISRRDTGDDDVAIQILYCGICHSDLHTIKNEWKNANYPVVPGHEIAGLITEVGKNVKRFNVGDKVGVGCMVNTCQSCESCEGGHENYCSKIIFTYNSHDRDGTVTYGGYSDMVVVNERFVIRFPDGMPLDRGAPLLCAGITVYNPMKHHGLNEAGKHIGVVGLGGLGHVAVKFAKAFGMRVTVISTSXPGKREEAMETLGADAFVVSGDANQMKAAKGTMDGIMNTASASMSMYAYLALLKPQGKMILLGLPEKPLQISAFSLVTGGKTLAGSCMGSIRDTQEMMDFAAKHGLAADIELIGTEEVNEAMERLAKGEVRYRFVIDIGNTLNAASLGSSPVPAL

SEQ ID NO: 9086 - protein, 805 aa, Zea mays
MVKFSREYEASIIPEWKAAFVDYKGLKKLVKRIKIARRDRAARSTSNDHDDATTTTYGFSVLDPVRALASHFNNATPPASPEGGSDDALRTLESDSGELVRATDKHEQEFVERADEELEKVNKFYAAQEADMLARGDALIEQLRILADVKRILADHAAASSRRGRARLARTGGNSSPPSVDGSNSGRHLLSSPFVASSPQSMSDGSVQLQQARVAEGAAVAEEVMAALERNGVSFVGGGLGKAKKDGSGKQLMGRAALLQLPATVRIDIPPTSPGRAALKVWEELVNVLRKDGADPAAAFVHRKKVQHAEKSIRDAFLALYRGLDLLKKFSSLNVKAFTKILKKFVKVSEQHRKGDLFSEKVKRSPFSSSDKVLQLADEVECIFLRHFAGNDRKVAMKYLKPQQPRNTHMVTFLVGLFTGTFVSLFIIYSVLAHVAGIFSSTGNTAYMEIVYHVLSMFALISLHVFLYGCNLSMWKGTRINHNFIFDFSSTALTHRDAFLMSASIMCTVVAALVVNLFLRNAGATYANALPGALLLLSAGVLFCPFNIFYRSTRFCFMRVMRNIVLSPFYKVLMADFFMADQLTSQIPLLRHLEFTGCYFMAETFRTHAYGSCTSSSQYKNLAYVLSFLPYYWRAMQCLRRYLEEGHDMNQLANAGKYVSAMVAAAVRFKYAATPTPFWMWMVIASSTGATIYQLYWDFVMDWGFLNPKSKNFWLRDQLILKNKSIYYASMMLNLVLRLAWAESVMKLRLGMVESRLLDFSLASLEIIRRGHWNFYRLENEHLNNAGKFRAVKTVPLPFRELETD

SEQ ID NO: 9087 - protein, 557 aa, Zea mays
  misc_feature (213)..(213): Xaa can be any naturally occurring amino acid
  misc_feature (513)..(513): Xaa can be any naturally occurring amino acid
MAGAPGVGPGAGGGGGAAAGLKTYFKTPEGRYKLQYEKAHSAVLHYSHGGKTVSQLTVAYLKEKPASQGSQPSTPSASSGMRSAAARLLGTGNGSKALSFGGGNGASRAVAGSSRVGGGLGTPTGLGGSQGGTNYDGKGTYIVFNAADTLFISDLNSQEKDPLKSIHFSNSNPLCHAFDPEAKEGHDLIIGMGSGDVYSMSLRQQLQESWKKXVAALHYNKGDKDVSPNGSRCTSVAWVPEREGIFVVSHSDGNLYVYDKNKDGNTDCTFPAVKDQSQFMVAHAKSSKSNPVARWHICQGSINAISFSPDGAYLATVGRDGYLRVFDFSKEQLIFGGRSYYGALLCCTWSSDGKYLLTGGEDDLVQVWGMDDRKIVAWGEGHNSWVSGVAFDSYWSPPSSDGNGENVYRFGSVGQDTQLLLWDLALDEIVVPLRHPSSASPTFSSGSPSTHWDNACPPTGVLQPSPRMRDVPKLSPLVAHRVHADPLSGMVFTSESILTICREGLIKIWVRPXQSENNQQSNSSEFALGPASKDRAITSSNKASSSSFKKLPPVLVT

SEQ ID NO: 9088 - protein, 392 aa, Zea mays
GASRAVRHDELRHDVCRDSCSSSGSEEFRRSWPSKVTADDSVAPARSSDAAASASWIDRKLLVDPKMLFVGDKIGEGAHGKVYKGKYGDQIVAIKVLNRGSTPEEKATLEARFIREVNMMCKVKHENLVKFIGACKEPLMVIVSELLPGMSLKSYLHSIRPSQLDTHTAISYALDIAHAMDCLHANGIIHRDLKPDNLLLTANRKKLKLTDFGLAREETVTEMMTAETGTYRWMAPELYSTVTLRRGEKKHYTNKVDVYSFGIVLWELLTNRMPFEGMSNLQAAYAAAFQQKRPALPEETPQELVFIVQSCWVEDPAMRPSFSQIIRMLETFIMTIHPPPLSEPNEGEESEETRSSLSSRSSSGSSLVSRATSKLSVVRHLFVSKKTGNGKA

SEQ ID NO: 9089 - protein, 356 aa, Zea mays
HTRPPTRPPTRPRTRGFFPWNYDWHRDQPHVDESVIKSSEVTRRCKSGPVEHDAVLRAMSRALETTEEAYMDIVENELDRHPELALMGSCVLVMLMKDQDVYVMNLGDSRAILAQDNDQYNSSSFSKGDLRHRNRSRESLVRVELDRISEESPMHNPNSHLNSNTKAKELSICRLRMRAVQLSTDHSTSIEEEVLRIKVEHPDDPQAVFNGRVKGQLKVTRAFGAGFLKKPKFNEALLEMFRIDYVGTSPYISCNPAVLHHRLCANDRFLVLSSDGLYQYFSNDEVVSHVLWFMENVPEGDPAQYLVAELLCRAAKKNGMNFHELLDIPQGDRRKYHDDVSVMVVSLEGRIWRSSG

SEQ ID NO: 9090 - protein, 361 aa, Zea mays
MAPTPTPTHTAAAVALAAHDSSGHLAPLTITRRSTGDDDVAIKILYCGMCHSDLHSIKNEWHNATYPMVPGHEIAGVVTEVGKNVTSFKAGDRVGVGCMVNSCQSCGSCDEDFENSCRAVIFTYNSVDRDGTVTYGGYSSSVVVHERFVVRFPDAMPLDRGAPLLCAGITVYSPMKYHGLNVPGKHVGVMGLGGLGHVAVKFAKAFGAKVTVISTSPGKKQEALDRLGADAFVVSKDAEEMKAAASTMDGIINTVSANLTLAPYMGLLKPNGKMIMVGLPTKPLEIPPFDLIIGNKTLAGSCIGGMRDTQEMINVAAKHGVTADIELVAADYVNTAMERLAKADVRYRFVIDIGNTLKNSE

SEQ ID NO: 9091 - protein, 284 aa, Zea mays
MSSSVGGGSAGGGGVDMVSLLEKAKELDQLKKEQDEIVADINKIHKKLLASPEMVDKPVDTILLKLRGLYARAKELSENEISASNALIGLLDGLLQSGASTAQKKKIVAFYISEVGEQKKKRIKSDTDSARFSAASMRNQLDQAASLKGEQVAARVKSDDEKDEWFVVKVIHFDKETKEYEVLDEEPGDDEESTQKKYKLPMSYIIPFPKKGDPSSAPDFGQGRQVLAVYPGTTALYRATVASHRKRKSDDYILEFDDDEEDGALPQRAVPFYRVVALPEGHRQ

SEQ ID NO: 9092 - protein, 125 aa, Zea mays
QEYLSISHEVYSFHHQLIFLVCVFFTSLLLLNPLSRLWSLLWLFALKKMCKEGAYWGTVAGVYVGVVYGVERVRGRSDWKNAMVGGALSGALVSAASSNHGDKIVKDAITAGAVATAVEFANYLT

SEQ ID NO: 9093 - protein, 247 aa, Zea mays
MDSEHWISRLAAAKRYYAAQLGRVDDVPGMGTEEVEMEVEDDGDMEMELEMALELGDATWPEVACPYCYEDHDVASLCIHLEEDHPYEPHAAPCPICSQRITRDMLNHITMQHGYLFKNGHRSRRFIVPESHAISLLSRDLRGTHLQALLGGGHGHRSNNAVTTNISSDPLLSSFGLSFSASDAPEPSKSASSIPDGTAIRKETPVQPWESSIDSSLTSEEREQKRKQATGRATFVQGLVMSTLFGD

SEQ ID NO: 9094 - protein, 216 aa, Zea mays
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKGFAEREMTFFMETSALESMNVESAFTEVLTQIYRVVSKKALDIGDDPAAPPRGQTINVGGKDDVSAVKKAGCCSS

SEQ ID NO: 9095 - protein, 216 aa, Zea mays
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKGFAERESTFFMETSALESMNVESAFTEVLTQIYRVVSKKALDIGDDPAAPPRGQTINVGGKDDVSAVKKSGCCSS

SEQ ID NO: 9096 - protein, 183 aa, Zea mays
MDEATKKNVEATVLEILRGSDMESVTEYKVRAAASDRLGIDLSIPDRKLFVRGVVEEYLLSLSSKEEAKAEEEGVTGRESKGKEHEEEDEEDDDEEEDEGKGGGKREYDDQGDLILCRLSSKRRVTLSEFKGRSLVSIREFYVKDGKEMPSAKGISMTLEQWEAFCNAVPAIEDAIKKLEDSD

SEQ ID NO: 9097 - protein, 267 aa, Zea mays
MYNNYRNPPGTHMPPQNSQPVQFDNPLYGASSGLIRSGIGVYGEKFLGSSSEFMQSNINRYFSNPQYYFHVNDQYVRNKLKVILFPFFHRGHWTRISEPVGGRLSYKPPIYDINAPDLYIPFMAFGSFIILSGFTLGFMGKFTPEAINLQFTRALIGWGFQLTVLKGLLYSMGGGEVPLLDLVAYGGYLFAGLSLAVVARLVWAYSYYVMMPWMSLCMGVFLVRTMKRVLFTEMRSSERHSSRQHYFLLFMAIVQFPLFFWLGSIGV

SEQ ID NO: 9098 - protein, 177 aa, Zea mays
MFNMSRDPLVVGNVVGDIVDPFITTASLRVFYNNKEMTNGSELKPSQVMNEPRVHVGGRDMRTLYTLVMVDPDAPSPSNPTKRENLHWLVTDIPETTDASFGNEIVPYESPRPIAGIHRFAFVLFRQSVRQTTYAPGWRSNFNTRDFAAIYGLGSPVAAVYFNCQRENGCGGRRYIR

SEQ ID NO: 9099 - protein, 375 aa, Zea mays
  misc_feature (103)..(103): Xaa can be any naturally occurring amino acid
  misc_feature (172)..(172): Xaa can be any naturally occurring amino acid
  misc_feature (181)..(181): Xaa can be any naturally occurring amino acid
  misc_feature (201)..(201): Xaa can be any naturally occurring amino acid
  misc_feature (317)..(317): Xaa can be any naturally occurring amino acid
  misc_feature (346)..(346): Xaa can be any naturally occurring amino acid
MEMESTPLLTPYKMGDFNLAHRVVLAPLTRCRAFGNVPQPEHMALYYRQRATPGGFLIAEACAVSESARGYPDVPGLWTHQQVVAWKPIVDAVHASGAVFFAXLWHTGRASPSEFQPNGQAPISSTDKQIPAQVNHSGDVNTFAVPRRLETEEIPHVVNDFRVAARNAIKAXGFDGVEIHXANGYLFDQFMKDSTNDRDDXYGGSLENRCRFTAEVMAARRGTRSVPTRLGVRLSPFADYMDCHDSNPEALALHVIDETLNPLGVLYCHMVEPRMRVNPDDGIMTLEHMLLPFRRAFRGTFIANGGYDREEGNDAIXRGRGYADLIAYGRIFLANPDLPMRFAQEXPPLNKYDRSTFYTSDPVVGYTDYPFLDQL

SEQ ID NO: 9100 - protein, 390 aa, Zea mays
  misc_feature (160)..(160): Xaa can be any naturally occurring amino acid
  misc_feature (181)..(181): Xaa can be any naturally occurring amino acid
MEMESTPLLTPYKMGDFNLAHRVVLAPLTRCRAFGNVPQPEHMALYYRQRATPGGFLIAEACAVSESARGYPDVPGLWTHQQVVAWKPIVDAVHASGAVFFAQLWHTGRASPSAHRPVILWPSASGHCWLQQFQPNGQAPISSTDKQIPAQVNHSGDVNXFAVPRRLGTEEIPHVVNDFPXAARNAIKAGFDGVEIHAANGYLFDQFMKDSTNDRDDSYGGSLENRCRFTAEVMAAVADEVGANRLGVRLSPFADYMDCHDSNPEALALHVIDETLNPLGVLYCHMVEPRMRVNPDDGIMTLEHMLLPFRRAFRGTFIANGGYDREEGNDAIARGRGYADLIAYGRIFLANPDLPMRFAKNAPLNKYDRSTFYTSDPVVGYTDYPFLDQL

SEQ ID NO: 9101 - protein, 391 aa, Zea mays
TKQISEQKLIVKRTSSNNTNLVLSRYAIDAMQSVCTKEARKGGVLRSAEETTLVQLIFGGYLRSKIKCSRCHVSSEQCEPMLDLTVEIDGDISSLDEALVRFTSTEALDGENKYHCSRANIFINTSVTGCKSYERAKKKLTIEEAPNILTIALKRYQSGKFGKISKAIRFPETLNIVCYMNPDTDDISPVYSLYAVVVHHDVMNAAFSGHYVCYVKDTQGKWFKADDSQVKPVSLDNVMSKCAYMLLYARCSPRAPSSVRQAMSDPAHPKQAKQRVVPGGPTWRVGSFNGHQAGQRHSDDAEDDDATHAAFDEYRYAPYSPSDSPSPSESSSLFSNSDAGSHSTDSSESTRNSTSTEEYEYVFGAADQMYRVGGGHLWRVAIRRIPVRGPA

SEQ ID NO: 9102 - protein, 534 aa, Zea mays
MKPVPSALTVDKATSVRGNCSITPNNSSKVADNLPDRNFEPSDRSGSTANNLATSLKKMVRQQTAPKVVRHYPSESTLFPYELFVRLYVKVELRPFGLHNLGNSCYANAVLQCLMFTRPLTTYLLEGLHSKNCSQNGWCFMCEFEKLIVEGKRRKIALSPTGILSHLNDIGSSFGPGKQEDAHEFLRYAIDAMQSVCTKEARKGGVLRSAEETTLVQLIFGGYLRSKIKCSRCHVSSEQCEPMLDLTVEIDGDISSLDEALVRFTSTEALDGENKYHCSRCKSYERAKKKLTIEEAPNILTIALKRYQSGKFGKISKAIRFPETLNIVCYMNPDTDDISPVYSLYAVVVHHDVMNAAFSGHYVCYVKDTHGKWFKADDSQVKPVSLDNVMSKCAYMLLYARCSPRAPSSVRQAISDPARPKKAKQKVVPGGTTWRGGSFNRHQDGQRHSNHTADDLTHAFDEYRNAPYSPSDSPSPSESSSLFSNSDAGSHSTVSTDSSESTRNSTSTEEYEYVFGAADQMYPGGPHGRSTCGE

SEQ ID NO: 9103 - protein, 354 aa, Zea mays
MCVEGLDDAAGRLGFGDQDTDRRAGDAMERVCENTVAVDFKQTKLNNFVPFIRSGEWSDIGGRDYMEDAHVCISDLAKNFGYDSVEDEVISFYGVFDGHNGKDAAHYVRDNLPRVIVEDADFPLELEKVVKRSFVQTDSKFAEKFSHHRGLSSGTTALTAMIFGRSLLVANAGDCRAVLSRRGTAIEMSKDHRPCCMNERKRVESLGGYVDDGYLNGQLAVTRALGDWHLDGMKEVGEPGGPLSAEPELKMVTLTKDDEFLIIGSDGIWDFFSSQNAVDFARRRLQDHNDLRLCCREIVDEAVRRGASDNLTAVMVSFHPDAPPPSRANKRTGRVTRSISAEGLHSLRVLLEGQ

SEQ ID NO: 9104 - protein, 637 aa, Zea mays
MQRLTAIVFVATSFLVASVPHAKSADLNSDKQALLAFAASLPHGRKLNWSSTTPVCTSWVGVTCTPDKSRVHTLRLPAVGLFGPIPSDTLGKLDALEVLSLRSNRLTVDLPPDVGSIPALHSLYLQHNNLSGIIPTSLSSSLTFLDLSYNTFDGEIPLKVQNLTQLTALLLQNNSLSGPIPDLQLPKLRHLNLSNNNLSGPIPPSLQRFPSSSFLGNSFLCGFPLEPCFGTAPSPSPVSPPSPSKTKKSLWKKIRTGVIIGIAVVGGVLLLILILVLLICIFKRKGHTEPTTASSKGKAIAGGRAENPKEDYSSGVQEAERNKLVFFEGSSFNFDLEDLLRASAEVLGKGSYGTTYKAVLEDGTIVVVKRLKEVVVSKKDFEQQMEIIGRVGQHQNVIPLRAYYYSKDEKLLVFDYVPSGSLAAVLHGNKAAGRAPLNWETRVKISLDVAHGIAHLHAEGGGKFIHGNIKASNVLLSQNLDGCVSEFGLAQIMTTPQTPPRPVGYRAPEVLENKKSTQQSDVYSFGVLLLEMLTGKAPLRSPGREDPSVEHLPRWVQSVVREEWTAEVFDVDLLRHPNVEDEMVQMLQVAMACVAAHPEERPKMEEVIRRVTEVRNSYSSGTRTPLEDKPSETARAP

SEQ ID NO: 9105 - protein, 755 aa, Zea mays
  misc_feature (190)..(190): Xaa can be any naturally occurring amino acid
MRWWKRSSSPSCPASSSSASTPASPARASTPRLIGGWGSGPSSRRDGSGASNDPQPRLIRARRMRYVVDDLEVGVSALGVDSPARRDAAAGFALETVSSAPISWSPSNMEVAPARSSSTPVLLPHPLPLPGEGESPCRGPGRPLPPPVPRMLDGEGKGPAADAPGVLETGSQRMTPLLARRVAVQTLPKXHEHNDFRLNGTTCCQRRKAFKEKFQDKNCDETLNFRLNIPAKSAPSSGFSSPVQSPRRLSNVDFSSAAISIQDTNVWSARSLWSSDAMGSSPPCDSPDKFAGGQERSPLSSPLRSPVLKSRNPSAPPSPMHPKLFPENHVSRPDGNGSASFHPLPLPPASVSPKQTNASHQLVPKAEMPSVAGQWQKGKLLGSGTFGCVYEATNRHTGALCAMKEVNIIPDDAKSVESLKQLEQEIKFLSQFKHENIVQYYGSETIEDRFYIYLEYVHPGSIHKYVHQHCGSLTEAVIRNFTRHILKGLAFLHSQKIMHRDIKGANLLVDINGVVKLADFGMAKHLSTAAPNLSLKGTPYWMAPEVVRATLDKSAGYDLAVDIWSLGCTIIEMFTGKPPWSGLEGPAAMFKVLRTDPPIPDNLSPEGKDFLRCCFKRNPTERPTANKLLEHPFIQTLNHYSPHSVVHSFSGIKSPDTVHSSARDKVPWKSDSYMRGKHANGETSSARSSESLAYRLMTPLPNLGTNSLSPPPLSSASSSGSAAHTPNSMHFSVPYHQPSPLPKPNGKEAINLVSH

SEQ ID NO: 9106 - protein, 597 aa, Zea mays
  misc_feature (110)..(110): Xaa can be any naturally occurring amino acid
  misc_feature (500)..(500): Xaa can be any naturally occurring amino acid
MAAMNGKVLGKCGRNMNSLKRKRENPAAYDADIFHNSELHQHPVNDSAVRFHVDKDRKAKIVCHFNKQVLQSYKNFMSSAPPKRILLRIGAVWKDFPEKIVKLAQADFRXKKTITETGYQNQLFLLDFAHMTFIDTKTGLQRPIAWIDENGNRYFPESFVQDQKIFMKKDFGNGYHDYISVESNGTREMNDQLGTSESSAESSNFGSSTEDVSSPKRARAENNSIIKKYCDMGEAIGENEPCTLLPTACNLLPRQANLGEVSRAQRTIEAVEKLLLQGMGSVIESKDIIGIYRTPLLDDHGQVRYHNHEKHVQVTRCHRGNANVRYAWLPCSKSTVHEMMLNSSLQVHKPPIKCAAYGEGTFLTPANRSDACVKFSAVDENGIVHMMLCRVIMGNVEIVHPGSKQHQPSSDYFDSGVDDLKNPQHYIVWDMNLNRHIYPEFVVTVKLPSKTKDYFVSQEDCQNSSDLSLVLNSSSPDCISEEMNLEAPPALGGGCAAPMXLGDSMAKAPSSPWMPFSMLFAAISTKVSPQIMDMVIGCYEEFKSKKISRCELIKELRHVVGDRVLISTIMRLQDKQLPPVERREGPGASAAKMVAKP

SEQ ID NO: 9107 - protein, 555 aa, Zea mays
MAAPALAFPMLLAASLLSVAAPALARSPSCPDGWQGGPVQNRCFMYISASLSWDRSEAVCHNYSGHLAAVSSVQELNFVKSLCGSSSTGCWVGGHHYSTSTGNGWKWSDDSSVWNETVFLGEPLPANCSDPACKVATSNDFCTLVTNGQPSTITEKRCSESHGLICRMNHVDRCYHDHCHKEYFISIIAVSGFILATTLAVVVWLLVYRRSKKRRRSREVLSASAAALVAPQWKVFTSEELRSITKNFSEGNRLPGNAKTGGTYSGILPDGSKVAIKRLKRSSLQRKKDFYSEIRRVAKLYHPNLVAVKGCCYDHGDRFIVYEFVANGPLDVWLHHIPRGGRSLDWAMRMRAATTLAQGIAFLHDKVKPQVVHRDIRASNVLLDEDFGSHLMGVGLSKFVPWEVMHERTVKAASYGYLAPEFIYRNELTTKSDVYSFGVLLLEIISGRRPAQSVESVGWQTIFEWATPLVQSHRYLDLLDPLIQESPDAGVVQKVVDLVYSCTQHVPSVRPRMSHVVHQLQQLELKSAASEQQLRSGTSTSATSPMLPLEVRTPR

SEQ ID NO: 9108 - protein, 202 aa, Zea mays
MAETVFTPSLEGMKHVKAENGVILTKPFLDVCKQILPVLDKFGAAMAIVKNDISGNITRLENKYSSDPSKYGHLYSMVQEEVQNKTAKGSSSCTNGLLWLTRAMDFLVELFRNLLEHPDWTMTQACTDSYTKTLKKFHGWLASSSFTVAMKLSPNRDKFMEVISGTGDINADIEKFCTTFSPFLKENHEFLASVGLDDMKAS

SEQ ID NO: 9109 - protein, 544 aa, Zea mays
MGNQCPNGTLGSDYYNRPASRFADGCLEDDRYSDLKKFDKPWPEVNSFKPTAVGILKRGLDPTSITVLERKTADVREHYIIGRRLGQGQFGTTFLCTEISTGCEYACKTIPKRKLITKEDVEDVRREIQIMHHLSGHKNVVSIKDVYEDGQAVYIVMELCAGGELFDRIQEKGHYSEQKAADLIRIIISLVAMCHSLGVMHRDLKPENFLLWDKEDDLSIKAIDFGLSVFFKPGQVFTELVGSPYYVAPEVLHKRYGPEADVWSAGVILYVLLSGVPPFWAETQQGIFDAVLKGHIDFDSDPWPKISESAKNLIRKMLCPCPSERLKAHEVLRHPWICENGVATDQALDPGVLSRLKQFSAMNKLKKLALRVIAERLSEEEIAGLRQMFKAVDVQNRGVITFGELRQGLKRYGSELENREISDIMEVADNDNNVTINYEEFIAATVPLNKIEREEHLMAAFTYFDKDGSGYITVDKLQRACGEHDMDDTFLEEIILEVDQNNDGQIDYAEFVAMMQGNKVGLGWQQMETTLNVTLRDAPQVHCH

SEQ ID NO: 9110 - protein, 326 aa, Zea mays
MAHYQQGRRQQVDEYGNPVPGGHGVQGQQLGEAAGGYGVAGTGSYGGQQQAGYGPTGTGTHDAGGYDGSDHPGYGATGTGVDDAGGPGAYGAATGTRAHGTHGGVTGIQDGAAGLTGGGLHGATGMGTTTGTGAHGATGMLDTGVLGGGGHAATGMPAGHGTRPGATGVAGTGGAFPHAAEHKTGGGILRRSGSSSSSSSSSSEDDGMGGRRKKGLKEKIKEKMPGGHREGQGQATATGAYGGTGYVAGPTTGGPHEKKGVVEKIKEKIPGGHKDYDQHQHTTAATGGGGGYGGTTDTTYGTTTTEGTHEKKGFMDKIKEKLPGQH

SEQ ID NO: 9111 - protein, 170 aa, Zea mays
  misc_feature (98)..(98): Xaa can be any naturally occurring amino acid
GVGFLEAMADIGKKDGLKGYWKGNLPQVIRIIPYSAVQLFSYEVYKKIFRRKDGELSVFGRLAAGACAGMTSTLGTYPLDVLRLRLAVQSGHSTLSQXMKKSVPEKYKNRPETSLATALLSATFATLMCYPLDTVRRQMQMKGTPYNTVFDAIPSIVERDGLTGLYRGFV

SEQ ID NO: 9112 - protein, 448 aa, Zea mays
MLHALPSYPIPIPSFAFLPLPAQFFSCCHPFLQSPPDSRGARRSRKDTPPPPMSRHRVETCDSWRPPRKNHAGAPPLLRAGPRLLAFASLSVRDGGDSAAAVAKAVEEAVVVRSDEVKEAVAGEERKKTKSAERRLPPAAQLVSHPLALLALVPNSAAIFAAGAAAGTVAKTVTAPLDRVKILMQTHSVRVAGESAKKGVGFLEAMADIGKKDGLKGYWKGNLPQVIRIIPYSAVQLFSYEVYKKIFRRKDGELSVFGRLAAGACAGMTSTLVTYPLDVLRLRLAVQSGHSTLSQVALNMLREEGLASFYGGLGPSLVAIAPYIAVNFCVFDLMKKSVPEKYKNRPETSLATALLSATFATLMCYPLDTVRRQMQMKGTPYNTVFDAIPGIVERDGLTGLYRGFVPNALKNLPNSSIKLTVFDTVKTLIATGQKEMDKLIQENEEKRS

SEQ ID NO: 9113 - protein, 396 aa, Zea mays
MSRHRVETCDSWRPPRKNHAGAPPLLRAGPRLLAFASLSVRDGGDSAAAVAKAVEEAVVVRSDEVKEAVAGEERKKTKSTERRLPPAAQLVSHPLALLALVPNSAAIFAAGAAAGTVAKTVTAPLDRVKILMQTHSVRVAGESAKKGVGFLEAMADIGKKDGLKGYWKGNLPQVIRIIPYSAVQLFSYEVYKKIFRRKDGELSVFGRLAAGACAGMTSTLVTYPLDVLRLRLAVQSGHSTLSQVALNMLREEGLASFYGGLGPSLVAIAPYIAVNFCVFDLMKKSVPEKYKNRPETSLATALLSATFATLMCYPLDTVRRQMQMKGTPYNTVFDAIPGIVERDGLTGLYRGFVPNALKNLPNSSIKLTVFDTVKTLIATGQKEMDKLIQENEEKRS

SEQ ID NO: 9114 - protein, 568 aa, Zea mays
MEEARDHRLSSTAGRPFLSGFCAAALRRKPLGARASAAAAATGEGLVRQLGVLDLVLLGIGASIGAGIFVVTGTVARDAGPGVTISFVLAGAACVLNALCYAELASRFPAVVGGAYLYTYAAFNEITAFLVFTQLMVDYHIGAASIARSLASYFIEFLELIPLLKGQIPSWVGHGEEFFGGVVSINILAPVLLIILTAILCYGVKESSAVNTFMTTLKIIIVIVIVFAGVFEVDVSNWSPFMPNGFKSVVTGATVVFFAYVGFDAVANSAEEAKRPQRDLPIGILGSLIACVLLYVAVCLVITGMVPYTLLGEDAPLAEAFAAKGLKFITVLISIGAVAGLTTTLLVGLYVQSRLYFGLGRDGLLPSVFAEVHPTRHTPVQSQIWVGCVAAVMAGLFNVRMLSHILSVGTLTGYSVVSACVITLRWNDKGTSRRSLGSMSIWQEGVLSLVIVALCGFIVGLCYRFNYAIAFMVVAFLIAVAASFALQFRQVYVDPPGFSCPGVPLVPIISVFFNMVLFAQLHEEAWYRFVILSLIAVGVYAGYGQYNAVPSSSEHSTIGYHGIPSEAA

SEQ ID NO: 9115 - protein, 568 aa, Zea mays
MEEARDHRLSSTAGRPFLSGFCAAALRRKPLGARASAAAAATGEGLVRQLGVLDLVLLGIGASIGAGIFVVTGTVARDAGPGVTISFVLAGAACVLNALCYAELASRLPAVVGGAYLYTYAAFNEITAFLVFTQLMVDYHIGAASIARSLASYFIEFLELIPLLKGQIPSWVGHGEEFFGGVVSINILAPVLLIILTAILCYGVKESSAVNTFMTTLKIIIVIVIVFAGVFEVDVSNWSPFMPNGFKSVVTGATVVFFAYVGFDAVANSAEEAKRPQRDLPIGILGSLIACVLLYVAVCLVITGMVPYTLLGEDAPLAEAFAAKGLKFITVLISIGAVAGLTTTLLVGLYVQSRLYFGLGRDGLLPSVFAEVHPTRHTPVQSQIWVGCVAAVMAGLFNVRMLSHILSVGTLTGYSVVSACVITLRWNDKGTSRRSLGSMSIWQEGVLSLVIVALCGFIVGLCYRFNYAIAFMVVAFLIAVAASFALQFRQVYVDPPGFSCPGVPLVPIISVFFNMVLFAQLHEEAWYRFVILSLIAVGVYAGYGQYNAVPSSSEHSTIGYHGIPSEAA

SEQ ID NO: 9116 - protein, 312 aa, Zea mays
MSSSSNSGKKPAPAGGRGGPTIRTLADINRGPAGFPGAGGGSSDDDEPQEYYTGGEKSGMLVQDPTRRNDVDAIFEQARQAGAIHGMPPFLGGESSSSRSFTGTGRLLTGETVPSAAPQEPVPVRIRHNIHLWNNGFTVDDGPLRYYDDPENEEFLESLKMSKCPKELVPTDGEHVDVSVIKRMEDYREPVRPQSAFQGVGRTLGGGPSPDESATPAPAPTAPAASRSAGIVVDDSQPFTSIQLRLADGTRMVARFNMHHTVGDIRSFIDASRPGTARPYQLQTGFPPKQLADPTQTVVQAGLANSVIMQKM

SEQ ID NO: 9117 - protein, 127 aa, Zea mays
FRPNLCVRISRETVTAMAAAGGVSTDDVPILQAENLTSNVKSVYYSRTFLSIIGGVVAGIWGFTGLMGFVFYFLIMMVASIGLLAKSKFSVQAYFDSWTRISIEGVFGGLMSFVLFWTFAYDIVHIF

SEQ ID NO: 9118 - protein, 212 aa, Zea mays
GLARTLRVPTPSCHRFVSDCNQNRSTNQSLYKLEKQIVPTNQSDGNEQGLTHLRPSAAPSPSAAPRRRRPVFLPPTSAVPLFFPRFCPNFCIRISHEVVTAMAATGGVSTDDIPILQAENLTSNVKSVHYSRTFLSIIGGVVAGIWGFTGLTGFVFYFLIMMVASIGLLAKSKFSVQTYFDSWTRISIEGVFGGLMSFVLFWTFAYDIVHIF

SEQ ID NO: 9119 - protein, 138 aa, Zea mays
MLFRTKTESKDPEIDTLSFTKLRDKLLALDPLAIDHVVKINKAEAEYWKKSEGYRMGWSDEILGFDCGGQQWVSENCFPTGTLAKPSMKDLEYIDKLLQLIEKEEIPAPGPIEQRWTARSKSPMSPGSSSEEDDVFHG

SEQ ID NO: 9120 - protein, 637 aa, Zea mays
  misc_feature (79)..(79): Xaa can be any naturally occurring amino acid
  misc_feature (403)..(403): Xaa can be any naturally occurring amino acid
  misc_feature (449)..(449): Xaa can be any naturally occurring amino acid
PLTPKRRRDLLRWPLPAPSIPTAHHRLHHATDSASRSPLAAPPERHDASPPPLPLPPPRWRQRHPQRPLPPPPPPPRPXSSPSPVSSDAELRKYAGYALLLLGCGAATYYSFPFPADALHKKAVPFRYAPLPEDLHAVSNWSGTHEVHARVLLQPDSLPALEGALAAAHKERRKLRPLGSGLSPNGIALSRAGMVNLALMDKVLDVDAKKKTVTVQAGIRVAELVDALREHGLTLQNFASIREQQVGGFTQVGAHGTGATLPPVDEQVISMKLVTPAKGTIELSREKDPELFYLARCGLGGLGVVAEVTLQCVERHQLVEHTFVSNADEVKKNHKKWLSENKHIKYLWIPYTDTVVVVQCNPPSKWITPKLASKYGKDEALQHVRDLYRESLKKYRCFSELKXESKDPEIDTLSFTELRDKLLALDPLDKDHVVKINKAEAEYWKKSEXGYRMGWSDEILGFDCGGQQWVSENCFPTGTLAKPSMKDLDYIDKLLQLIEKEEIPAPGPIEQRWTARSKSPMSPASSSEEDDVFSWVGIIMYLPTSDARQRKEITEEFFSYRSLARSLWDDYSAYEHWAKIEVPKDKDELAELQARLRKRFPVDAYNKARMELDPNKVLSNAKLEKMFPVLEPAHQTK

SEQ ID NO: 9121 - protein, 146 aa, Zea mays
MPRSGISGTLRSPQIDVVIDTGNPFLNRTVDGFLKIGAVGACKVAAEETFDCLHRGDVSKRKVEHALKKMCKEGAYWGTVAGVYVGVVYGVERVRGRSDWKNAMVGGALSGALVSAASSNHGDKIVKDAITAGAVATAVEFANYLT

SEQ ID NO: 9122 - protein, 463 aa, Zea mays
  misc_feature (50)..(50): Xaa can be any naturally occurring amino acid
  misc_feature (118)..(118): Xaa can be any naturally occurring amino acid
  misc_feature (130)..(130): Xaa can be any naturally occurring amino acid
  misc_feature (150)..(150): Xaa can be any naturally occurring amino acid
  misc_feature (214)..(214): Xaa can be any naturally occurring amino acid
MAASSSPRAAGLRGPSLTVLLFLVAAMVSVPPAAAEIRETAIRADPRSIXPLDEFGFSHSGVLELNVSGIAFDPQASAELDLSQLGFFLSTLDAWVHVLRQLQDLDVTCALQSELVKXAFSFDAPPPALXTLPGVEVARSSSFSTAFRVXEPGQYTLVFANCLGGGLKVDMDVRSAMYNVDPATGERQYLSAGASALPSFYFLFCLAYAGLAAXWVSILLRKRAAVFRIHYFMLAVLVLKALNLLAEAEDKSCIERTGTAHGWDVLFYIFSFLKGISLFTLIVLIGTGWSFLKPYLADREKKVLMAVIPLQVVANIAQVVIDESGPYARDWVTWKQIFLLVDVICCCAVLFPIVWSIKNLREAARSDGKAAVNLMKLTLFRQYYVVVICYIYFTRVVVYALQTITSYRYLWTSVVAGELATLAFYVFTGYKFRPEVHNPYFAIDDEEEEAAAEALKLDDEFEL

SEQ ID NO: 9123 - protein, 267 aa, Zea mays
MAAMNTGMGGLGGRPIHPQANPFGPALQGAGPGLIRTGLETYGGRILDSSSEFMQSNITQYLSDPQYYFQVNSQYVRNKLKVILFPFLHRGHWTRITEPVGGRLSYKPPVQDINAPDLYIPLMAFGTYIVAAGYALGVLGRFTPEALTLQFSKGILGWFLQVVLIKGLLYSLGSGEAPLLDIVAYAGYGFAGTSLAMVARIFWSYLYYFIMPWFCLCTGVFLVKTMKRVLLGGPRSYERHPGRNHYFLIFLAVVQFPMLFWLGNICG

SEQ ID NO: 9124 - protein, 514 aa, Zea mays
MTMNGAAAPERSPPASPPPLVQAQAPPSPSPTQPLEWRFSQVFGERSAGEEVQDVDIISAIEFNKSGHHLATGDRGGRVVLFERTDVKDLASRKDAEKADYSISRHPEFRYKTEFQSHEPEFDYLKSLEIEEKINQIKWCQATNCALFLLSTNDKTIKFWKVQEKKVKKVSEMNLDRSTAPTNGSPGGTGYPRPSLSNGNVLKPGGLPLLRLPVVTTQETSLAASCRRVYAHAHDYHINSISNNSDGETFISADDLRINLWNLEISNQSFNIIDVKPTNMEDLTEVITSAEFHPTHCNTLAYSSSKGSIRLVDLRQSALCDTHSQIFEQHEAPGSRSFFTEIIASISDIKFSKDGRHILSRDYMTLKLWDVKMNSGPVATFQVHEYLRPKLCDLYENDSIFDKFECCQSGDGLRVATGSYSNIFRVFGCRSGSSEATTLEATRNPTRRQVQTTSRATRSLSTLTRAVRRGGESTGIDANGNSYDLSTKLLHLAWHPSENLIACAAANSLYMYYA

SEQ ID NO: 9125 - protein, 338 aa, Zea mays
RSTAPTNGSPGGTGYPRPSLSNGNVLKPGGLPLLRLPVVTTQETSLAASCRRVYAHAHDYHINSISNNSDGETFISADDLRINLWNLEISNQSFNIIDVKPTNMEDLTEVITSAEFHPTHCNTLAYSSSKGSIRLVDLRQSALCDTHSQIFEQHEAPGSRSFFTEIIASISDIKFSKDGRHILSRDYMTLKLWDVKMNSGPVATFQVHEYLRPKLCDLYENDSIFDKFECCQSGDGLRVATGSYSNIFRVFGCRSGNSEATTLEATRNPTRRQLQNPTRATRSLSSLTRTVRRGGESTGIDVNGNSYDLSTKLLHLAWHPSENLIACAAANSLYMYYA

SEQ ID NO: 9126 - protein, 317 aa, Zea mays
MELRELGGTGLRVSAVGFGASPLGNVFGDVPRDTARAAVRRALDLGINFFDTSPYYGGTISESVLGDCLRHAAVPRDRVVVATKCGRYKDEGFDFSANRVTRSIDESLARLGLDYVDILHAHDIEFTHLEQIVNETIPALQKIKENGKARFIGITGLPLSIYPYVLDRVAPGSVDVILSYCHYGINDTSLVDLLPYLKSKGVGVISASPLSMGLLTDNGPPEWHPAPEELKSACKAAADHCRKKGKSITKLAMQYSLMNNEISTVLVGMNSLEQVEENVAAALELSTSGIDEELMREVEAILEPVKNLTWPSGIQQA

SEQ ID NO: 9127 - protein, 506 aa, Zea mays
MAPPQTIPRRGLFIGGAWREPCLGRRLPVVNPATEATIGDIPAGTAEDVEIAVAAARDAFSRDGGRHWSRAPGAVRANFLRAIAAKIKDRKSELALLETLDSGKPLDEASGDMDDVAACFEYYADLAEALDGKQQSPISLPMENFKSYVLKEPIGVVGLITPWNYPLLMATWKVAPALAAGCTTILKPSELASVSCLELGAICMEIGLPPGVLNIITGLGPEAGAPLSSHSHVDKVAFTGSTETGKRIMISAAQMVKPVSLELGGKSPLIVFDDIGDIDKAVEWTMFGIFANAGQVCSATSRLLLHEKIAKKFLDRLVAWAKNIKVSDPLEEGCRLGSVISEGQYEKIKKFISTARSEGATILYGGGRPQHLRRGFFLEPTIITDVSTSMQIWQEEVFGPVICVKEFRTESEAVELANDTHYGLAGAVISNDQERCERISKALHSGIIWINCSQPCFVQAPWGGNKRSGFGRELGEWGLDNYLTVKQVTKYCSDEPWGWYQPPSKL

SEQ ID NO: 9128 - protein, 448 aa, Zea mays
MSHYHSADFEEMEDEYDMNEPVDDMEGEDEYQELVIRDSDAEDEDDADQLHKLSDTSAADARSGKDIQGIPWETIEVTRETYRQARLEQYKNYENIPNSGVAAMMACKSTEKGRTYYEFRRNTRSVKSTISHFQLRNLVWATSKHDVYLLLHYSVLHWSALNGVDTEIMDVHGHVAPSEKHPGSLLEGFLHTQISTMAVKDNLLVAGGFQGELICKHLDREGISFCCRTTYDDNAITNALEIFNTSSGALHFIASNNDCGVREYDMERYQLFKHFRFDWPVNHTSLSPDGKLVIIVGDDTDALLIDSNSGKTIHSMKGHLDFSFASAWSPDGLTFATGNQDKTCRIWDARNLTESVHVLRGNVGAIRSIRFTSDGHFLSMAEAADFVHIFDIKSDYNKRQELDFFGEVSGMSFSPDTDTLYVGISDRTYGSLLQFGRLYNYSYLDSLL

SEQ ID NO: 9129 - protein, 176 aa, Zea mays
  misc_feature (31)..(31): Xaa can be any naturally occurring amino acid
  misc_feature (40)..(40): Xaa can be any naturally occurring amino acid
MVGKKRGVISPLDHLAGLLEVRVVRGVDLAXRDLRSSDPXVVLRIGKAQKVKTRVVKKSINPEWNEKLTLSIEDPAVPIRLEVFDKDTFVDDAMGNAELDIRPLVEIVKMKLQGVADKTVVKKLVPNRQNCLAEESSIYISEGKVKQDLVVRLRNVECGEIELQLQWVHLPGSKGV

SEQ ID NO: 9130 - protein, 437 aa, Zea mays
MDGQAPPLLDAVVLEPLAVGDELHPRRPVEVEDAPAAAPPSGMDGQVPPLYNVTRDPLTVSDELQPTGEVVDDALPVAPDIVKGEVMEDDVLPVATDIINDAASECPEAGSDGVVLTDELRNRIVKQVEYYFSDENLPTDEFLLNYVKKNNKGFVPIEIIASFRRMKKLVQDLSVIEAALRTSSKLVVSSNGKRVRRLHPLPHKELKDSKKSTVLVENLPPDFSMESIQEKFATVGKVVNITINDPESVKEFSTAKKPDFNLSCKAHVLVEYEAVEAAEKAVTALSDESNWRTGMKVRLLSKQSVMGPGKYKKPSKENQDAVSKMIDQNQHSKEDQLKTLEKISGADAVGITKDRDNLKPVFITETEHQDQKPNARGRKGWYKGQGQMQQNANKQGSCGSESLNKPISGPRMPDGTRGFTLGRGRSLPLQKSEKAEE

SEQ ID NO: 9131 - protein, 360 aa, Zea mays
  misc_feature (117)..(117): Xaa can be any naturally occurring amino acid
MGGAAAGTKWIHHIQRLSAAKVSAEAVERGQSRVIDASLTLIRERAKLKAELLRALGGVKASASLLGVPLGHNSSFLQGPAFAPPRIREAIWCGSTNTRPCICSSTHTGGHLVWKHXSSTEEGKELNDPRVLTDVGDVPIHEIRDCGVEDDRLMHVISESVKTVMEEEPLRPLVLGGDHSISYPVVRAVSEKLGGPVDILHLDAHPDIYDCFEGNTYSHASSFARIMEGGYARRLLQVGLRSITKEGREQGKRFGVEQYEMRTFSKDREKLENLKLGEGVKGVYVSVDVDCLDPAFAPGVSHIEPGGLSFRNVLNILQNLQGDVVAADVVEFNPQRDTVDGMTAMVAAKLVRELTAKISK

SEQ ID NO: 9132 - protein, 470 aa, Zea mays
MEADSGKLFVGGISWETDEDRLRAYFGRFGEVTEAVIMRDRNTGRARGFGFVVFADSGIAERVTIDKHMIDGRMVEAKKAVPRDDQSIASKNNSSIGSPGPGRTRKIFVGGLASNVTEVEFRRYFEQFGVITDVVVMYDHNTQRPRGFGFITYDSEDAVDKALHKSFHELNGKMVEVKRAVPKEQSPGPIARSPAGGQNYAMSRVHNFLNGFNQGYNPNPLGGYGMRVDGRYGLLTGARNGFSSFGPGYGMGMNVEGGMSGYFGASSGFVNSSNGRQIGSYFNGSSNRLGSPIGYVGLNDDSGSILSSMSRNVWGNGNLNYIGNHTNMNSFPQPGSGGGISGDEISWGSLTSAHGMGNISSLGSGNLGRGTGDNNFGLPSGNYVRSNSTGTIGEPFSASANAYESNNPGAYGSSSIYGDSTWRFNSSEVDMPPFGHDLGNVDPDIKSEISANYMGNYTVNNNQTSRGITS

SEQ ID NO: 9133 - protein, 398 aa, Zea mays
MAANGKSSLANGASTGGKPIKCKAAVAWGPGEPLVMEEVEVAPPGRLEVRVKLLFTSICHTDLSFLKGENELHRKFPRILGHEAAGVVESVGDGVEDLAAGDHVIPIFNGECGACAYCESDRTNLCGTYRVDASKSTMVSDGGTRFSVADRVSGRTVPVYHFLNTSTFAEYTVLDAACAVKVNPEAPLQKMCLLSCGISTGVGAVWNTANVSAGSTVAIFGLGAVGLAVAEGARLRGAARIIGVDINPEKFTKGREMGVTDFVDSRASDKPVHEVIREMTHGGVDYSFECTGINGVLREAFVSTHDGWGLTVVLGIHATPKMLPLHPMELFDGRRITACVFGDVKGKSQLPAIVDKCVNGDLDINLDGFITHRMPFSDINKAIQLLEEGKSLRCVLNL

SEQ ID NO: 9134 - protein, 444 aa, Zea mays
MDEFELEDNLEFILQSIQELMEDPGDNNAFGDANQNELFASIVNYDQENMLPDVSAADVAAGKDIQGIPWEKMLFGRDKYREMKMKNYRNYQNLSYAREDALQECKQVKKDSPYYDFHYNTRRARPSIVHFQLRNLVWATTKHDVYTMHDQSVTHWSSLEQTSTELINADDCIVPKQRGHGSQSVAMVQVTTMAVDSNLLVVGGFQGEIICKRLDDEGVVYSTRVTDDENAITNSLEMYQDPSGSRRLVAANNDCSIRIFDTEYFDLLKHYVFPWSVNSVSVSPNGKLFAVLGDHEDGCVVDPKCGKAIGSLRGHLDYSFASAWHPDGNIVATGSQDTTCRLWDIRNLSQSVAVLGGRMGSIRCVKFSPDGRFLATAEPVDFVHMYDAYADYSRSHEIDLFGEIGGLAFSPDTEAFYVGLADQTYGGMIEFSKRHQHHYFNSLW

SEQ ID NO: 9135 - protein, 146 aa, Zea mays
MLRHFFEDTFVVTRLDPDGKKFDRVSRVEARSEQLDMYMQLDVATDVYPMHAGEKFNMVIAPTLNLDGTPDTGYYTQAGRKTLADNYEYVMQGKLYKISEDTSSSQNAKVEMYASFGGLLMLLRGDPSTAASFELDQRLFLLIRKV

SEQ ID NO: 9136 - protein, 169 aa, Zea mays
MEGRREPEADGGKAGGLPPSEPPHLQGQPPQEYGYGTFQGPRHPPVGFPQPAPPPGLGGGGYHNQQQPYAPAETYYAQGYQAVPGYGPVAEGRPVRMRRLPCCGLGLGWCLFITGFFLAAIPWFIGAFVLICVRVHDQREKPGYVACTIAAVVAAVAILLGVTKGTHVW

SEQ ID NO: 9137 - protein, 175 aa, Zea mays
MGGGHEEQEGGGAKAGGYSSGLPPSEPPHLQGQPPQEYGYGTFQGPRHPPVGFPQPAPPPGFGGGGGYHNQQQPYAHAETYYAQGYQAVPGYGPVAEGRPVRMRRLPCCGLGLGWCLFIAGFFLAAIPWYIGAFVLICVRVHDHREKPGYVACTIAAVVAAVAIFLGVTKGTHVW

SEQ ID NO: 9138 - protein, 433 aa, Zea mays
MAAGDAGRAPTAAAAQSLVESFCGVTSATPQEAAFYLESHNWALESAVRSYYDSVDGEADAVAADPVPPPPAAPAGGGEDTEDEDCVVGGGGGGDDDEDDEDYVDGDGSDDEDAALAAEAAEEEERRRPFKRLKRTHDARGGSGSSAKARGNVRTLADLDSGKGTAGSDENSEDDDEWTPPPEYETRDRSRRKNNTDEIFKQAKKKGAKQGPFEARPRSSSRNFTGTGRLLTGETVERNASQPPEEITHNIHFWRNGFTVNDGPLRSFDDPANAPFLKSIKDSDCPTELVPADEKSIVNVNLVRTEEEFTEPVKRAAPFEGERRNLMEPSDNNTSNAAAAAAASSSATASRTITVDDSLPSTSLQIRFADGSRLVARFNTSHRISDVRAFIDATRPGASDYTLQAGFPPKPLEDTAKTIEEAGVANSVIIQSV

SEQ ID NO: 9139 - protein, 416 aa, Zea mays
MAMSASSSSRALLRRIGGALLRRSFSSSSAASAGYHVAGGPSYMRGAVFWEPGRPLTLEEFRMPRPKAGELLIKTKACGVCHSDLHVLKGELPFSTPCVVGHEITGEVVDHGTHTPVEIINRFPVGSHVVGAFIMPCGNCFYCVKGQEDLCESFFAYNRAKGTLYDGETRLFLRGNGKPVYMYSMGGLAEYCVVPANALAVLPDSLPYTESAILGCAVFTAYGALRHAAEMRPGDSVAVIGVGGVGSSCLQIAKAFGASQVIAVDVLDEKLQNATTLGATHTVNAAKDDAVERIKEITDGRGVDVAIEALGKALTFSQCAKSVRDGGKAVMIGLAATNVMGEVDITRLVRRQVKIIGSYGARARQDLPQIVKLAESGAFNLQNTISRKCKFEEANGAYEDLNQGKIVGRAVVEIME

SEQ ID NO: 9140 - protein, 166 aa, Zea mays
  misc_feature (134)..(134): Xaa can be any naturally occurring amino acid
MASEHAAGGDAKHHQKQSLMDKAKGFVAEKIAHIPKPEATLDGVTFKGLSRECITLHSSVNVSNPYDHRLPICEVTYTLRCAGKEVASGTMPDPGWIAASGSTALEIPAKVPYDFLVSLVRDVGRDWDIDYELXVGLTVDLPIVGNFTIPLSTSGEFKLPTLKDLF

SEQ ID NO: 9141 - protein, 467 aa, Zea mays
MSSHMVNTWGYSTINFFAPMSRYASAGGGPVAASKEFKQMAFHNSGIEVILDVVYNHTNEADDVNPYMTSFRGIDNKVYYMLDLNNSAQLLNFSGCGNTLNCNHPVVKELVLDSLRHWVKEYHIDGFRFDLASVLCRGPDGSPLDAPPLIKEIAKDSVLSRCKIIAEPWDCGGLYLVGRFPNWDRWAEWNGKYRDDIRRFIKGDPGMKGVFATRVSGSADLYQVNNRKPYHSVNFVIAHDGFTLCDLVSYNSKHNDANGEGGRDGCNDNYSWNCGIEGETNDLNVLSLRSRQMKNFHVALMISQGTPMMLMGDEYGHTRYGNNNSYGHDTHINNFQWGQLEERKDGHFRFFSEMIKFRHNHPILRRDRFLNKNDVTWHENRWENQDSKFLAFTIHDHSSGGDIYLAFNAHEYFVDAVIPPPPHHKSWSRVVDTNLESPKDIVPEGVPFTGSGYRIAPYSSILLKAKP

SEQ ID NO: 9142 - protein, 631 aa, Zea mays
  misc_feature (179)..(179): Xaa can be any naturally occurring amino acid
  misc_feature (191)..(191): Xaa can be any naturally occurring amino acid
MASVKLGSKPDAFKRQGQAWFCTTGLPSDVTVEVGDMSFHLHKFPLLSKSAFLERSIEENSDQEECIIKLNDIPGGAKSFELVARFCYGVKIELSPANVVYLRCASEHLEMTEEVAEENLIAQSEMFLNQVVLRNWKDSLAALETCDDLLPHAEDLQIVNRCIESLASKATSNPNLFGXWPIREHGMMQSXPGGSVLWNGISTGARPRNFNSDWWYGDASSLSFPMYKRLISTMESRGIRPEIIAGSLTYYAKKYLPGLRRHSHSMGTMPLTATLSEVEQKNLLEEIDRLLPLHRGIASTKVLLGLLRTAMILKASPTCISNWEKRIGMQLDQATLEDLLLPNFSYTMETLYNVECVHRILDHFLAMDQANGGESPCLDDVMASPSLTPITSVAKLIDGYLAEIAPDINLKPPKFQALASAIPEYARPLDDGLYRAIDIYLKAHSWLSEAEREQFCRLLDCQKLSLEACTHAAQNERLPLRVVVQVLFFEQLQLRTSIAGCLLVSDNLEGSRPLRSGIATSGEAGGWATAVRENQVLKVGMDNMRTRLAELEKECSSMRQEIEKLGGRAGKGGGGGWASRVVPRRLGLKVRSQMCSAQEGSVSEQHRSMSAKLDKLQAKVSKQKKQLAADA

SEQ ID NO: 9143 - protein, 518 aa, Zea mays
MAAITPPTQSEPSPQTGRPASSAAAAAKRGGGGAGAAGGPLMGKYELGRLLGHGTFAKVYHARHVDTGDNVAIKVLDKEKAVKSGLVPHIKREIAVLRRVRHPNIVHLFEVMATKTKIYFVMELVRGGELFSRVSKGRLREDTARRYFQQLVSAVGFCHARGVFHRDLKPENLLVDEQGNLKVSDFGLSAVAEQFRPDGLLHTFCGTPAYVAPEVLGRRGYDGAKADVWSCGVILFVLMAGYLPFHDKNIMAMYKKIYKGEFRCARWFSKDLTSLLMRILHTNPNTRITLPEIMESRWFKKGFKPVKFYIEDDQLHNVIDDEDGLLDMGPAGPVPPPLPPPPPPLPPPKVDGDESGSDSDSSISSCPASMLSDESQRPRGSLPRPASLNAFDIISFSRGFNLSGLFEEKGDEVRFISAEPMSDIITKLEDIAKLKSFKLRRKDWRICLEGTREGVKGPLTIGAEIFELTPPLVMVEVKKKAGDNEEYENFCDKELKPGMQHLVHHMVRAPSMLLTDAK

SEQ ID NO: 9144 - protein, 345 aa, Zea mays
MSTGRTEEAAGSAETACVTGAGGYIASWLVKLLLSRGYTVHGTVRDLSDNKTAHLKRLENASENLKLFKADVLDYDAMAGAVAGCQGVFHVATPVPSGKITDPEREMLGPAVTGTINALKAASAANARRVVVVSSMVAVEINPKDWPRDKIKDENCWSDKEFCRNEENWYSVAKISSEEAALEYAKQTGLDVVTVNPAVVFGPLLQPTLNTSCQFLVYFLKGGPDRMRDKLWHIVDVRDTADALLLVYETPQASGRHICAPHFISARDLLELLKTMYPDDYPFISKESIYDMEHPAPMTSDKLKKLGWKVRPLKETIAETVEFCQHAGFLEDVEGFRFPPLYNII

SEQ ID NO: 9145 - protein, 434 aa, Zea mays
MASWDNLGELSNIAQLTGLDAVKLISLIVRGGVHGRGLHKRNCRRFAQHLKLIGGLLEQLRVSELKKYPETREPLEQLEDALRRGYLLVNSCQDRSYLYLLAMGWNIVYQFRKAQSEIDNYLRLVPLITLVDNARIRDRLEYIERDQCEYSFDEEDKKVQDALLNPDPCSNPTIVLKKTLSCSYPNLPFNEALRKESEKLQVELQRSQSNMDLGSCEVIQHLLGVTKTVESTIPEKETNVKAPEKKGSNYSESKGETAKSFDDDDDYPKKQNDDYQDIEYTKKQKDTCSTQRCSSQVPYGHDLVSSRGSYSDEWHADLLGCCSEPALCLKTLFFPCGTFSRIASIAKDRPMSSGEACNDIMAYSLILSCCCYTCCVRRKLRQKLDIAGGCCDDFLSHLLCCCCALVQEWREVEIRGAYSEKTKVTPPACQYMEH

SEQ ID NO: 9146 - protein, 346 aa, Zea mays
  misc_feature (289)..(289): Xaa can be any naturally occurring amino acid
MDTQARPVPPRVKLGIQGFEVSKLGFGCMGLTGAYNSPLDDEAGIAVIAHAFSRGVTLFDTSDVYGPLTNEILLGKALKQLPREQVQVATKFGIRHDESGTRTVCGRPEYVRACCEASLRRLGIDCIDLYYQHRIDTTTPIEETIGELKKLVEEGKVKYIGLSEASPDTIRRAHAVHPITAVQMEWSLWSRDIEPEIVPLCRELGIGIVPYSPLGRGFFGGRGVKEQVSAESNLHGIPRFAPENLEKNKQIYLRMEELANKHQCSPAQLALAWVLHQGDDVVPIPGTTXKIKNLDSNIDSLKVKLTDEDLKEMGSQIREEDVAGGRQFTSFAHTTWKYADTPKKQS

SEQ ID NO: 9147 - protein, 454 aa, Zea mays
MGKKRKLEPKSAAGFTPVKASPTTRSATAKAAGLSEVLAPVEATMEKLPQGAGGEDVEEIEEVEVEEEVEVEEEEEGESDQASIQALLDSFPKDQLVELLRDAAIAHGDVLTTIRRVADADPAQRKIFVHGLGWDTTTDTLTEAFGPYGEIEDLKVVTDRNTGKCKGYGFILFRHRSGARAALREPQKKIGNRSTACQLASVGPVPGGAPNSAAPAPVQLQLPPVSEYTQRKIFVSNVGADIDPQKLLQFFARFGEIEEGPLGLDKVTGKPKGFALFVYKTIESAKKALEEPHKHFEGVMLHCQKAIDGPKPNKLGGAGGFFGAGASSGGKGFAGYGATSHSLPGTVGIVQPMSPLAPGLASLPGGISAAPGVDPALGQALTALLATQQGGGLSFNSILGVGANGSGLPPQGPTGALGGSSVQGMQGGYMGGYGGSGGYGGASSGGPGRHYMGH

SEQ ID NO: 9148 - protein, 212 aa, Zea mays
RAPSSPHARHALLRFRSRRLPSSSSIRPARQRAGVGSVRCMARRPDSSYSPLRSGQGGDRAPTEMAPLFPGCDYEHWLIVMDKPGGEGATKQQMIDCYIQTLAQVLGSEEEAKKKIYNVSCERYFGFGCEIDEETSNKLEGLPGVLFVLPDSYVDAENKDYGAELFVNGEIVQRSPERQRRVEPVPQRAQDRPRYSDRTRYVKRRENQSYQR

SEQ ID NO: 9149 - protein, 221 aa, Zea mays
MATAARALVAARALVAARPARPLLPPRRLPSSSSIRPARQRAGVGCVRCMARRPDSTYSPLRSGQGGDRAPTEMAPLFPGCDYEHWLIVMDKPGGEGATKQQMIDCYIQTLAQVVGSEEEAKKRIYNVSCERYFGFGCEIDEETSNKLEGLPGVLFVLPDSYVDAENKDYGAELFVNGEIVQRSPERQRRVEPVPQRAQDRPRYSDRTRYVKRRENQSYQR

SEQ ID NO: 9150 - protein, 255 aa, Zea mays
  misc_feature (179)..(179): Xaa can be any naturally occurring amino acid
MRRPAAGPGPKVQNPIQFQIPLLASSPPPPLLPSPSRPAMATAARALVAARPARPLLPSRRLPSSSSIRPARQRAGVGCVRCMARRPDSTYSPLRSGQGGDRAPTEMAPLFPGCDYEHWLIVMDKPGGEGATKQQMIDCYIQTLAQVVGSEEEAKKRIYNVSCERYFGFGCEIDEETSXNKLEGLPGVLFVLPDSYVDAENKDYGAELFVNGEIVQRSPERQRRVEPVPQRAQDRPRYSDRTRYVKRRENQSYQR

SEQ ID NO: 9151 - protein, 217 aa, Zea mays
MATVARTLVAACPARSLLRLRSRRLPSSSSIRPARQRAGVGSVRCMARRPDSSYSPLRSGQGGDRAPTEMAPLFPGCDYEHWLIVMDKPGGEGATKQQMIDCYIQTLAQVLGSEEEAKKKIYNVSCERYFGFGCEIDEETSNKLEGLPGVLFVLPDSYVDAENKDYGAELFVNGEIVQRSPERQRRVEPVPQRAQDRPRYSDRTRYVKRRENQSYQR

SEQ ID NO: 9152 - protein, 687 aa, Zea mays
TVRRPTRDGAAYHRSRRDDDGEGNALSVERAFADQAVPSWREQLTVRAFVVSFFLAIMFSVIVMKLNLTTGIIPSLNVSAGLLGFFFVRLWTAAIERVGLLRQPFTRQENTVIQTCVVAAYDIAFSGGFGTYLFGMSETIAKQATEADNPQNVKNPHIGWMIGFLFLVSFIGLFALVPLRKVMIVDYKLTYPSGTATAYLINGFHTPEGAKLAKKQVKTLGKFFLMSFLWGFFQWFYTGGDNCGFQNFPTLGLQAYKNKFYFDFSPTYVGVGMICPHIVNVSVLLGGILSWGIMWPLIGNQKGSWYDASLPESSLHGLQGYRVFISIAIILGDGLYNFVKVLIRTTAGFISMMKKNSTLPVSNNGSPITEGVSFDDERRRDLFLKDQIPRSVAYGGYVAVAAISIGTLPQVFPQLKWYYILVAYIFAPVLAFCNAYGTGLTDWSLASTYGKLAIFIFGAWAGASNGGVLVGLAACGVMMSIVSTAADLMQDLKTGYLTLASPRSMFISQVIGTAMGCVIAPCVFWLFYKAFADIGLSGSEYPAPYAIVYRNMAILGVDGFSSLPKNCLTLCYIFFAAAIVVNLVRDLVPKNVARFIPLPMAMAIPFYLGSFFAIDMFIGTVILFAWETINKAKANAFAPAVASGLICGDGIWTLPQSILALAKVKPPICMKFLSRSVNAQVDGFLGS

SEQ ID NO: 9153 - protein, 306 aa, Zea mays
MIPYATAAEAEGALGRTMTWAETAWYEYSAVMPDSWLHCHTTFILFVIYSIAPLPLLLLEQFAPSVVLPYKLQPRVRLPPAASLSCYMDAACIFPLAVGLQFVSYPAVAKILRTRMGLPLPSVRETIAQLVVYSLVEDYLSYWMHRLLHTQWCYEKIHRVHHEFTAPTGFAMSYSHWAENVVLSIPALAGPVLVPCHVTTQWLWFSIRLIEGINTHSGYHFPFSPCRLIPFYGGAAYHDYHHYAGGRSQSNFAPLFTYCDYLYRTDKGYRYHKLKQEKLKSLAENSADKGGNYSFDEGKKNRYFCA

SEQ ID NO: 9154 - protein, 476 aa, Zea mays
MAQPHLVLPSPRPLLPAAATPSRRAVAVRAALSTASPPAKAAAGAEAVRSIRARQIVDSRGNPTVEVDLVAGDGRLHRSAVPSGASTGIYEALELRDGDKAVYGGKGVLQAVRNINEVIAPKLVGVDVRNQSDVDAIMLDIDGTQNKSKLGANAILGVSLSVCRAGAGAKGVPLYKHIQELAGIKEPVMPVPAFNVINGGSHAGNNLAMQEFMLLPVGAATFAEALRMGSEVYHVLKGIIKAKYGQDACNVGDEGGFAPNVQDNREGLVLLMDAIEKAGYTGMIKIGMDVAASEFLTKDGNYDLNFKNQPNDGVHVLSAQHLGDLYRDFVKDFPIVSIEDPFDQDDWSSWASLQSSVGIQIVGDDLLVTNPKRIADAIDRKACNALLLKVNQIGTVTESIQAALDSKAAGWGVMVSHRSGETEDNFIADLAVGLASGQIKTGAPCRSERLAKYNQLLRIEEGLGNVRYAGEAFRSP

SEQ ID NO: 9155 - protein, 553 aa, Zea mays
MFLQTQLAVTTEQRREPHRISAPKPLANATSPPPPDPTKRHDDLYLYLAATVTVARRHISKPSPRPPPRLATLRLRHMAHPHLVLPSPKSLLPAAATPSRRAVAIRAALSTALSPAKAAAGAEAVRSIRARQIVDSRGNPTVEVDLVAGDGRLHRSAVPSGASTGIYEALELRDGDKAVYGGKGVLQAVRNINEVIAPKLIGVDVRNQSDVDAVMLDIDGTQNKSKLGANAILGVSLSVCRAGAGAKGVPLYKHIQELAGIKELVMPVPAFNVINGGSHAGNNLAMQEFMILPVGATTFAEALRMGSEVYHVLKSIIKSKYGQDACNVGDEGGFAPNVQDNREGLILLMDAIEKAGYTGKIKIGMDVAASEFLTKDGNYDLNFKNQPNDGAHILSAQHLGDLYRDFVKDFPIVSIEDPFDQDDWSSWASLQSSVDIQIVGDDLLVTNPKRIADAIDKKACNALLLKVNQIGTVTESIQAALDSKAAGWGVMVSHRSGETEDNFIADLAVGLASGQIKTGAPCRSERLAKYNQLLRIEEELGNVRYAGEAFRSP

SEQ ID NO: 9156 - protein, 445 aa, Zea mays
MDVEGEVPAAAAAAVANGLGGAGAEEASPAPVSAEQLDVEAYAAQYSGRTRLVRLLFVADRCGVEAMQLEALRMAYDEIKRGEDVQLHRDVVTKIGGRLGPRYGLDQAWVFSVSRRADQRKEKLESELNGYRTNLIKESIRMGYNDIGDFFYAHGQLSDAFKSYIRTRDYCTTSKHIVQMCMNVILVSIELGQYAHVSNYVSKAEQTPDSLDPTIVAKLKAAAGLANLETKKYKFAARKFVETGIELGNNFSEVIAPQDVAVYGALCALASFDRSDLKSKVIDNINFRNFLELVPEVRELVNDFYASRYGSCLGHLEKLKPNLLLDIHLHQHVETLYMEIRHKAIIQYTLPFISVDLNTMAAAFKTSVSMLQKELAALITEDKIQARIDSHNKILYARHADQRNATFQRVLQTGNDFERDVKSMLLRANLLKHDYIQKTSGPRKM

SEQ ID NO: 9157 - protein, 183 aa, Zea mays
CYGIIQDKTLLEGPVFNAFWERNVAESVRQGDARPFVEEAVLQVSDWGFSLSDIQMQKKEARGFFELIKSLFNQAEREWVGFLGPIHIWQGMDDRVISPSVAEFVRRVVPGATVHKLLDEGHFSYFCFCDECHRQIFSTLFGIPQGPINPAPPQPGEVVSELTEETTVPDNATDEEQGKSGLP

SEQ ID NO: 9158 - protein, 324 aa, Zea mays
HTVPTQLEEFGVRLVTYDLPGFGESDPHIGRNLNSSALDMLYLANALNIPEKFWVVGYSGGGMHAWSALHYIPDRIAAMFAPMANPYDSKMTKDERRKTWDSWSTKRKLMHILARRFPSLLPFFYRQTFLSGKQGHPESWLSLSLGKKDKTLLEGPAFNAFWERNVAESVRQGDARPFVEEAVLQVSDWGFSLSDIQMQKKEARGFFELIKSLFNQAEREWVGFLGPIHIWQGMDDRVISPSVAEFVRRLVPGATVHKLLDEGHFSYFCFCDECHRQIFSTLFGIPQGPMNPAPQPSEVVSELNEEITVPDNVTDQEQGKSGLP

SEQ ID NO: 9159 - protein, 62 aa, Zea mays
MAGGRVAHATLKGPSVVKEIFIGLTLGLIAGGMWKMHHWNEQRKTRSFYDMLDKGQIVVVEE

SEQ ID NO: 9160 - protein, 558 aa, Zea mays
MDASLLLSVGLALVLIPLSLSLLNRLRRENMGALEAGRTNPRRRAAMDASLLLSVGLALVLIPLSLSLLNRLRVGRLPPGPRPWPVLGNLRQIKPVRCRCFQEWAERYGPIISVWFGSGLTVVVSTSELAKEVLKENDQQLADRPRNRSTQRFSRNGQDLIWADYGPHYIKVRKLCNLELFTPRRLEALRPIREDEVTAMVESVHRAATAPGNEGKPMVVRKHLSMVAFNNITRLAFGKRFMNANGDVDEQGREFKTIVNNGIKIGASLSVAEFIWYLRWLCPLNEELYKTHNERRDRLTMKIIDEHAKSLKESGAKQHFVDALFTLKQQYDLSEDTVIGLLWDMITAGMDTTVISVEWAMAELVRNPRVQKKLQEELDRVVGRDRVMLETDFQNLPYLQAVVKESLRLHPPTPLMLPHKASSNVKIGGYNIPKGANVMVNVWAVARDPKVWSNPLEYRPERFLEENIDIKGSDFRVLPFGAGRRVCPGAQLGINLVASMIGHLLHHFEWSLPEGTRPEDVNMMESPGLVTFMGTPLQAVVKPRLEKEELYNRVPVEM

SEQ ID NO: 9161 - protein, 671 aa, Zea mays
  misc_feature (114)..(114): Xaa can be any naturally occurring amino acid
  misc_feature (391)..(391): Xaa can be any naturally occurring amino acid
  misc_feature (504)..(504): Xaa can be any naturally occurring amino acid
  misc_feature (575)..(575): Xaa can be any naturally occurring amino acid
  misc_feature (597)..(597): Xaa can be any naturally occurring amino acid
  misc_feature (608)..(608): Xaa can be any naturally occurring amino acid
MGSEGEITGPLLASGAGAPAPEAVPPWREQVTARGLAVSAVLGVLFCLITHKLNLTVGIIPSLNVAAGLLGYFLVRTWTAALERFGVVSKPFTKQENTVIQTCVVACYGLAFSXGGFGSYMLAMDQRTYELIGPDYPGNRAVDVKTPSLGWMIGFMFVVSFLGLFSLVALRKVMVIDYKLTYPSGTATAMLINSFHTTTGAELADKQVRCLGKYLSISFIWNCFKWFFSGVGDSCGFDNFPSLGLAAFKNTFYFDFSPTYIGCGLICPHIVNCSTLLGAIISWGILWPYISTKAGDWYPADLGSNDFKGLYGYKVFISVSVILGDGLYNLIKIIYATIKEIMNARAKQGRLPLAQVQDGDEGSNLSAEEKHLNETFIKDSIPPWLAGSGYXGLAAISIATVPMIFPQIKWYLVLSAYVVAPLLAFCNSYGTGLTDWNLASTYGKIGLFIFASWVGQNGGVIAGLAACGVMMSIVSTAADLMQDFKTGYLTLSSPRSMFVSQLIXGTALGCVIAPLTFWLYWSAFDIGNPDGAFKAPYAVIFREMSILGVEGFSALPQHCLAICSFFFIASLVINXLLRDVTPKNVSRFIPIPMAMAXPFYIGAYFAIXMFVGTVILFVWERVNRKECDDFAGAVASGLICGDGIWTVPSAILSILRIDPPICMYFKPSLSS

SEQ ID NO: 9162 - protein, 260 aa, Zea mays
  misc_feature (161)..(161): Xaa can be any naturally occurring amino acid
MDRKRIKDALEKHLERSSPSTSRGVVSKERERLAAGKLPSSLGKAEVSDGEEFETDSEDSDVSGSEGEDTSWISWFCTLRGNEFFCEIDDDYIQDDFNLCGLSNQVPYYDYALDLILDIESSNDDGFTEEQNELIESSAEMLYGLIHARYILTSKGLAAMXLEKFKNYDFGRCPRVYCCGQPCLPAGQSDVPRSSTVKIYCPKCEELNYPRSKYQGNIDGSYFGTTFPHLFLMTYSHLKPQKPSQQYTPRVFGFKLHKPS

SEQ ID NO: 9163 - protein, 336 aa, Zea mays
MPGGSSGPDGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPQQLPPPPYAHARAGRPRLSEFHDRSFEGDYGREVDEIGNGISETGMRGKLVKRNKKSSGDLDIYGGHRINVEPIGTLGEDSRSEIRSRGDRDIDNQQALQAEEKDVVSSVATVLSDLCGPGEWMPMAKLHNELLEQFGNVWHPSRVRKYLTQDDWSPTETKGRPWFGLLALLRKYPEHFVINTRSKGRMTSEFVSLVSLLS

SEQ ID NO: 9164 - protein, 469 aa, Zea mays
METADYSGKLFVGGISWETDEDRLREYFGRFGEVTEAVIMRDRSTGRARGFGFVVFADATVAERVTIEKHMIDGRMVEAKKAVPRDDHSIVSKSNTSSIGSPGPGRTRKIFVGGLPSNVTEADFRGYFEQFGVITDVVVMYDHNTQRPRGFGFITYDSEDAVDKALHKSFHELNGKMVEVKKAVPKEQSPGPVARSPAGVGQNYAMNRVHSFLNDFNQGYNPNPIGGYGMRVDGRFGQLSGARNGLSSFGPGYGMGMNVEGRMSGTFGANSGFISNSNGRQMGSYFNGSSNRLSSSIGYLGYDSGSMLSSMSRNFNAGVNYPINPTNMSAFAALGNGGGVNYMGLPSIAPELAQLGNISSLGSGNFSRGAGVNNLSLPSGSYGRSNSTGTIGEPFSASGNAYEVNNPDTYGNNSIYGGTSWRFPSSEVDVPSFSHDLGNVDPNMKSDISANYMGNYSVSNNQPSRGITS

SEQ ID NO: 9165 - protein, 363 aa, Zea mays
MVLWYPPVLSTHGVEHPAVAHVRRHPAHPVSARLHHPPTRQKSAMAFALKAAAAGSASFSAAGPRRRAAATGRVSFRSAAPVVAVRAAAAAAAAVAEDKRSISGTFAELRQQGKTALIPFITAGDPDLATTAKALRILDACGSDVIELGVPYSDPLADGPVIQASATRALAKGTTFEDVISMVKGVIPDLSCPVALFTYYNPILKRGVPNFMSIVKEAGVHGLVVPDVPLEETDVLRSEAAKNNLELVLLTTPTTPNERMEKIAQASEGFIYLVSTVGVTGTRANVSGKVQSLLQDIKKVTEKPVAVGFGVSTPEHVRQIAGWGADGVIIGSAVMKTLEEAASPEEGLKKLEEFAKNLKAALP

SEQ ID NO: 9166 - protein, 485 aa, Zea mays
MGSVPEEKAKLGFGGLVGDLREVYESGRTQGLEWRQSQLRGLVRLLEEKEEEIFDVLHEDLGKHRGEAFRDEVGVLKKSVVDKLQNLKNWAAPEKAHTPLVAFPATALVVPEPLGVVLVFSCWNLPISLALEPLSGALAAGNAVVVKPSELAPATSAFLAANIPKYLDSKAVKVVEGGPEVGEKLMEHRWDKVLFTGSSRVGRLIMAQAAKHLTPVALELGSKCPCIVDWLDSDRDSQVAVNRIIGAKWSTCSGQACIAIDYLLVEEEFAPILIEMLKSTLERFFTKPEYMARILNEKQFQRLSGFLADRRVASSVVHGGHFNPKTLSMEPTLLLNPPLDSDIMTEEIFGPLLPIITVKKIEDSIKFLRSKPKPLAIYAFTRNEKLKQRIIDETSSGSITFNDAIVQYGLDSIPFGGVGHSGFGQYHGKYSFDMFSHKKAVLKRSFLVEFMFRYPPWDETKIGMLRRVYRFDYVSLFLALIGLRR

SEQ ID NO: 9167 - protein, 115 aa, Zea mays
MAARCSLSSSSLSVHGPLRRNKPSKRLAPCLPSSPRPGAAALRARAAKLPPGVEAPRVQPKLSEPFLGFTQTAEIWNSRACMIGLIGTFIVELVLNKGILQMIGVEVGKGLDLPL

SEQ ID NO: 9168 - protein, 312 aa, Zea mays
  misc_feature (100)..(100): Xaa can be any naturally occurring amino acid
  misc_feature (120)..(120): Xaa can be any naturally occurring amino acid
IFACGTSPSHFSSHTHQTPARRGPSRPVPLRFVSPPLVPQTGASIHRTLPGDASNHRQAWLIARTGVYVDDYLEYSSTLAGDLQRILSTMRELDDRAHGXIMGQTKEQIKYILGVSSHGXDRSNMDDDESERMKKDIEASQDNALNLCTEKVLLARQAYDLIESHIKRLDEDLGQFAEDLKHEGKIPPDEPTVLPPVPVVSRDEKRRFGFSTPQASKKFREREWDRERGMDFDLMPPPGSSKKAGTSMDVDQTIDPNEPTYCICHQISYGDMIACDNENCGGGEWFHYTCVGLTPETRFKGKWFCPTCRNLQ

SEQ ID NO: 9169 - protein, 143 aa, Zea mays
MEVFGKSVIAEPSNVIFLSAILNTEGSNPSHKCDKRCQSERILGNMYRCKLTETTHICDKNCNQRILYDNHNSLCRVSGQLFPLSPLEQQAVRGIRRKHEVDSSEGCCFKRRRGAQLHPSPFERSYSAVYPIPSQVGDGMDMS

SEQ ID NO: 9170 - protein, 105 aa, Zea mays
YSLWNKLGATQANSIQSADAILAYQQALDLKPNYVRAWANMGISYANQGLYEDSIRYYVRAVTMNPKADNAWQYLRISLGNASRADMIAACDARNLDALQKEFPL

SEQ ID NO: 9171 - protein, 678 aa, Zea mays
MALRHLVTGQNNCAPDGASSSNPLNALANAFLGQSSKAQSIKELPGSVSVPSTSGFSAPAPLSNIPGSENEFKQDQRPFVQGSDFIHGGPANDWIKSFRPPGVPELGGIEAHFPDFEQIYNNAGTTFQPPLDGPPQRVLSGVLHSFLTSGPAGVPFQPLPVPAALGLSESDKQCIRDRSCIMARHIFSDQPEEYIQAQVNTLLHSLDIDNRMRGPMHGQYPELQEYWNQSQSSMGPALMHNTADKWITEFGKQNNNPENWAKSFEQQYGPNGWASEFEQHQSQMAMGQMGGVNMANLAAMEQSRMLAQTLASNNDPKFQLSQGADKWVSEFSSQHNQGALNESWVDEFSKLNVTDEWAEEFSGGGFGESSADPWVDEFQEHLSSFKQSSGASRGVYVYSENNPYVGHPNPMQEGQELFRKGLLSEAVLALEAEVLKNPDNAEGWRLLGITHAENDDDQQAIAAMMRALEANPTNLEVLLALGVSHTNELEQGEALRYLYRWLQNHPKYGGLVPPQSTDSPYGPDVVRLFNDAAQMSPEDADVHVVLGVLYNLSREYDKAITSFKTAVQLKPQDYSLWNKLGATQANSIQSADAILAYQQALDLKPNYVRAWANMGISYANQGLYEDSIRYYVRAVTMNPKADNAWQYLRISLGNASRADMIAACDARNLDALQKEFPL

SEQ ID NO: 9172 - protein, 734 aa, Zea mays
MALRHLVTGQNNCVPDGASSSNPLNALANAFLGQSSKAQSIKELPGSVNVPSTSDFSVSAPLSNIPGSENEFKQDQRPLARGADFIRGGPANDWIESFRPPRVPQLGVEAQFPDFEQIYNNAGTTFQPPLDGPPQRVLSGVLHSFLTSGPAGVPFQPLPVPAALGLSESDKQCIRDRSCIMARHIFSDQPEEYIQSQVNTLLHSLDIDNRMRGPMHGQYPELQEYWKQSQSSTRPAPMHNAADKWITEFGKQNNNPENWANSFEQQYGPNGWASEFEQHQSQMAMRQMGGANMANLAAMEQSRVLAQTLASNNDPKFQNSKFFQFVSKMSRGELIIEDNQVKEGSASQSSGWADEFQTPYIANANSWADQFAHEELSQGADKWVSEFSSQPNHGALNENWVDEFSKLNVTDEWAEEFSGGGFGESSADPWVDEFQEHLSSFKQSSGASRGVYVFSENNPYVGHPNPMQEGQELFRKGLLSEAVLALEAEVLKNPDNAEGWRLLGITHAENDDDQQAIAAMMRALEANPTNLEVLLALGVSHTNELEQGEALRYLYRWLQNHPKYGGLVPPQSTDSPYGPDVVRLFNEAAQMSPEDADVHIVLGVLYNLSREYDKAIASFKTALQLKPQDYSLWNKLGATQANSIQSADAILAYQQALDLKPNYVRAWANMGISYANQGLYEDSIRYYVRAVAMNPKADNAWQYLRISLSNASRADMIAACDARNLDALQKEFPL

SEQ ID NO: 9173 - protein, 1055 aa, Zea mays
  misc_feature (536)..(536): Xaa can be any naturally occurring amino acid
MADNGDAKGGSGAYAINIENFSKRLKVFYDHWKEHKSDLWGSSDAIAIATPPPSDDLRYLKSSALDIWLLGYEFPETIIVFMHKQIHVLSSQKKGNLIGTLKKAANEAVGVDIVLHVKTKNSDGADLMDDIVHAARNQSKSDKPVVGHIAKEAPEGKLLETWIKKLSGSGLRLVDVTNGFSELFAVKDTTEITCVKKAAYLTSSVLKNFVIPKLEKVIDEEKEVSHSSLMDDAEKAILDPLKVKVKLKPDNVDICYPPVFQSGGKFDLKPGASSNDEYLYYDSASIIICAIGSKYSSYCSNVARTYLIDATPTQNKAYETLRKAHEAAIQQVKPGNQMSAVYQAAVAVIERDAPELLPNLTKSAGTGIGLEFRESGLNLNAKNDRRIKKGMVFNVSLGLHNIQAETTSEKTKQFSLLLADTVLVNERGHEILTAPCSKAFKDVAYSFNEDDDAVAAEVKIKSKTIDVMPTKATLRSDNQEMSKEELRRQHQAELARQKNEETARRLAGVGTGSGDGRGPARASNELVAYKNVNDVXFVRDLVIQVDQKNEAVLLPIYGSMVPFHVSTVKSVTSHQDNRTCTIRIFFNVPGMPFSNDSKFNSQGAIYLKEITFRSKDPRHSSEVVQQIKTLRRQVASRESERAERATLVTQEKLQIGSNRMKMMRLSDVWIRPAFGGRGRKLTGNLEAHFNGFRYSTSRSDERVDIMFGNIKHAFFQPAEKEMITLLHFHLHNHIMVGNKKTKDVQFYVEVMDVVQTLGGSRRSALDPDEIEEEQRERDRKNRINMDFQNFVNKVNDHWSQPQFKGLDLEFDVPLRELGFHGVPYKASAFIIPTSTCLVELIETPFLVVSLSEIEIVNLERVGFGTKNFDMAIVFKDFKKDVLRIDSIPSASLDAIKEWLDTTDLKYYESRLNLNWRPILKTIIDDPQKFIDDGGWEFLNMEASDSETEDTEESDQGYVPSDAEPESESEDDDSDSESLVESDDDDEESDEDSEEEKGKTWEELEREASNADREHGAESDSEEERRRRKAKTFGKSRAPERSSFKGAPPSKKPKFR

SEQ ID NO: 9174 - protein, 233 aa, Zea mays
NSRVDPRVRKSYYGALLCCSWSADGKYLLSGGEDDLVQVWSMDDRKIVAWGEGHNSWVSAVSFDPYWSPPNSDETEENVMYRFGSIGQDTQLLLWDLALEEIAVPLRHPSGGSPTFSSGSPSAQWDNACPPAGVLQPSPRMRDVPKLSPLVAHRVHVDPLSGLEFTSESILTICREGLIKIWARPIHSESNQQPDSSEQVVGNATAKDKMLTSSNKAGASSPSFKQPPPVLFT

SEQ ID NO: 9175 - protein, 145 aa, Zea mays
DTQLLLWDLALEEIAVPLRHPSGGSPTFSSGSPSAQWDNACPPAGVLQPSRPRRDVPKLSPLVAHRVHVDPLSGLEFTSESILTICREGLIKIWARPIHSESNQQPDSSEQVVGNATAKDKMLTSSNKAGASSPSFKQPPPVLFT

SEQ ID NO: 9176 - protein, 565 aa, Zea mays
MASVAGSGGGASAGAGGLKTYFKTPEGRHKLQYEKTHSPAVVHYNHNGKTVAQMTVAYLKEKPAGQGSTPSTPSAGSGMRSAAARLLGTGNGSRTLSFGSNGTSRAVSGSSRMGGGIGVSTSASGSQGMANYDGKGSYIIFNTADTLFISDLNSHDKDPIKSIHFSSSNPLCHAFDPEAKDGHDLLIGVFSGDVYSMSLRHQLQDPGKKPVSYQHFVNKDKDKDKDPSQGGAASSQCTCVAWVPEREGIFVVSHADGNLYVYDKFKDGNTDWTFPTVKDQSQVLISHAKSSKSNPIARWHICQGAINDISFSPDGAYLATVGRDGYLRVFDFAKEQLIFGGKSYYGALLCCSWSADGKYLLSGGEDDLVQVWSMDDRKIVAWGEGHNSWVSAVSFDPYWSPPNSDETEENVMYRFGSIGQDTQLLLWDLALEEIAVPLRHPSGGSPTFSSGSPSAQWDNACPPAGVLQPSPRMRDVPKLSPLVAHRVHVDPLSGLEFTSESILTICREGLIKIWARPIHSENNQQPDSSEQVIGSATAKDKMLTSSNKAGAFSSSFKQPPSVLFT

SEQ ID NO: 9177 - protein, 221 aa, Zea mays
  misc_feature (39)..(39): Xaa can be any naturally occurring amino acid
  misc_feature (126)..(126): Xaa can be any naturally occurring amino acid
MQRAQLQHADPPFHHNRYVYDEIEPDDDLHSYFPCPYCXKTLMLAFLCDHLEDEHPFESKIVSCPVCSARISKDLVDHITLQHGYLLKLQKHQRVRRVTGNGNHNLSYAGRDLQLQETYLKVLLGXSSRSSSTNASSTVTDSLLPSLVLNLSSPEVEDASKFSAPAVVENNWFKRSLPSKTWKLRTVDSTLSHEERERRRRRAAVRSAFVQHLLVTTIFED

SEQ ID NO: 9178 - protein, 527 aa, Zea mays
MAMAMMAMRRAVALGARHIPAAAASSFRVVSLRHMSADAGAAMEKIRAAGLLRTQGLIAGQWVDAYDGKTIEVQNPATGEVLANVSCMGSRETSDAIASAHSTFYSWSKFTASERSKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSEFTPLTALAAADLALQAGIPAGALNVVMGNAAEIGDALLQSTQVRKITFTGSTAVGKKLMAGSANTVKKVSLELGGNAPCIVFDDADIDVAVKGSLAAKFRNSGQTCVCANRILVQEGIYEKFAKAFIQAVQSLKVGNGLEESTSQGPLINEAAVQKVEKFINDATSKGANVMLGGKRHSLGMSFYEPTVVGNVSNDMLLFREEVFGPVAPLIPFKTEEEAVHMANDTNTGLAAYIFTKSIPRSWRVSESLEYGLVGVNEGIISTEVAPFGGVKQSGLGREGSKYGIDEYLELKYICMGNLG

SEQ ID NO: 9179 - protein, 499 aa, Zea mays
YNLGVQMSADASAAMEKIRAAGLLKTQGLIAGQWVDAYDGKTIEVQNPATGEVLANVSFMGSRETSDAIASAHSTFYSWSKLTASERGKALRKWYDLIISHKEELALLMTLEQGKPMKEALGEVNYGASFIEYFAEEAKRIYGDIIPPTLSDRRLLVLKQPVGVVGAITPWNFPLAMITRKVGPALACGCTVVVKPSELTPLTSLAAADLALQAGIPAGALNVVMGNAPEIGDALLQSTQVRKITFTGSTAVGKKLMAESANTVKKVSLELGGNAPCIVFDDADIDVAVKGSLAAKFRNSGQTCVCANRILVQEGIYEKFASAFIKAVQSLKVGNGLEESTSQGPLINEAAVQKVEKFINDATSKGANVMLGGRRHSLGMSFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGVDEYLELKYICMGNLG

SEQ ID NO: 9180 - protein, 216 aa, Zea mays
MAYRAEDDYDYLFKVVLIGDSGVGKSNLLSRFTRNEFSLESKSTIGVEFATRSIRVDDKVVKAQIWDTAGQERYRAITSAYYRGAVGALVVYDVTRHVTFENVERWLKELRDHTDANIVIMLVGNKADLRHLRAVSVEDAKGFAEREMTFFMETSALESMNVESAFTEVLTQIYRVVSKKALDIGDDPAAPPRGQTINVGGKDDVSAVKKSGCCSS

SEQ ID NO: 9181 - protein, 471 aa, Zea mays
  misc_feature (198)..(198): Xaa can be any naturally occurring amino acid
MEADSGKLFVGGISWETDEDRLREYFGRFGDVTEAVIMRDRNTGRARGFGFVVFADSGIAERVTMEKHMIDGRMVEAKKAVPRDDQSIASKNNSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPIARSPAGGXQNYAMSRVHNFLNGFNQGYNPNPLGGYGMRVDGRYGLLAGARNGFSSFGPGYGMGMSVEGGMRGYFGASSGFVNSSNGRQIGSYFNGSSNRLGSPIGYVGLNDDSGSILSSMSRNVWGNGNLNYIGNHTNMNSFPQPGSGGGISGDEISWGSLTSAHGMGNISSLGSGNLGRGTGDNNFGLPSGNYVRSNSTGTIGEPFSASANAYESNNPGAYGSSSIYGDSTWRFNSSEVDMPPFGHDLGNDDPDIKSEISASYMGNYTVNNNQTSRGITS

SEQ ID NO: 9182 - protein, 606 aa, Zea mays
  misc_feature (390)..(390): Xaa can be any naturally occurring amino acid
MLGRAAALSAPRWRGGVPDLRAALRSGGNLLFALFVAAVLAFTLLAAFHSPDDPLLHPSSHQLTDFLTSATSTSTFLTDDSVLRTGEDFNSSSTGAAGEVAAGGVEVVAEAVPFIKLSEVGAEAEKTEPETERAVTVDTDAATGEGAAVAEETAVAEAVSCDTEAPVDCTGDRELFNLLMRAAIERFPDLHFYRFGRPVAVPGSPMECDLAWRFRPAADAIGTGRTTYYKDYRRFTLTRDVNTCSLVVDTVGEYHSGVGAKRNGRRKGKKGKKGKQDAPVTDFVPVKTQIRLDENTANNEAAGAAAEPVFVVGEAVNDSLPVVASESDFSRGKYLIYIGGGERCKSMNHFIWGFLCALGEAQFLNRTLVMDLNVCLNARYTSSGKDEERXKHGLKNFYTEDIRMTPMKLRDIKDTLIMRKFGNVEPDNYWSRVCEGETEGIIKRPWHFLWKSRRLMEIVSAIASRMNWDFDSVHVVRGEKAQNTQLWPNLDRDTSPDSLLMALNDKVGAGRYLYIATNEPDKSFFNPLKEKYKTHFLDDFKYLWDENSEWFTETKELSNGQPVEFDGYMRIAVDTEVFLRGKRHVETFNELTRDCKDGVNTCSASS

SEQ ID NO: 9183 - protein, 637 aa, Zea mays
MLGRAAALSAPRWRGGVPDLRAALRSGGNLLFALFVAAVLAFTLLAAFHSPDDPLLHPSSHQLTDFLTSATSTSTFLTDDSVLRTGEDFNSSSTGAAGEVAAGGVEVVAEAVPFIKLSEVGAEAEKTEPETERAVTVDTDAATGEGAAVAEETAVAEAVSCDTEAPVDCTGDRELFNLLMRAAIERFPDLHFYRFGRPVAVPGSPMECDLAWRFRPAADAIGTGRTTYYKDYRRFTLTRDVNTCSLVVDTVGEYHSGVGAKRNGRRKGKKGKKGKQDAPVTDFVPVKTQIRLDENTANNEAAGAAAEPVFVVGEAVNDSLPVVASESDFSRGKYLIYIGGGERCKSMNHFIWGFLCALGEAQFLNRTLVMDLNVCLNARYTSSGKDEERDFRLYFDFEHLKQSASVIDQSQFWQDWGQWHKKDRLKNFYTEDIRMTPMKLRDIKDTLIMRKFGNVEPDNYWSRVCEGETEGIIKRPWHFLWKSRRLMEIVSAIASRMNWDFDSVHVVRGEKAQNTQLWPNLDRDTSPDSLLMALNDKVGAGRYLYIATNEPDKSFFNPLKEKYKTHFLDDFKYLWDENSEWFTETKELSNGQPVEFDGYMRIAVDTEVFLRGKRHVETFNELTRDCKDGVNTCSASS

SEQ ID NO: 9184 - protein, 557 aa, Zea mays
  misc_feature (32)..(32): Xaa can be any naturally occurring amino acid
  misc_feature (68)..(68): Xaa can be any naturally occurring amino acid
  misc_feature (179)..(179): Xaa can be any naturally occurring amino acid
  misc_feature (212)..(212): Xaa can be any naturally occurring amino acid
  misc_feature (231)..(231): Xaa can be any naturally occurring amino acid
  misc_feature (428)..(428): Xaa can be any naturally occurring amino acid
  misc_feature (496)..(496): Xaa can be any naturally occurring amino acid
  misc_feature (506)..(506): Xaa can be any naturally occurring amino acid
  misc_feature (535)..(535): Xaa can be any naturally occurring amino acid
MAATVRRAASSVLSRFLLTKPSPSPAASAAGXSPALLGAGAAALRHRFSTAPASAAAAAEEPIQPAVXRVKHTQLLINGNFVDAASGKTFPTLDPRTGEVIARVAEGDSEDIDRAVAAARRAFDEGPWPRMTAYERCRVLLRFADLIERHAEEVAALETWDNGKTLAQAAGAEVPMVAXRCVRYYAGWADKIHGLVAPADGAHHVQVLHEPXGVAGQIIPWNFPLLMFAWXKVGPALACGNTVVLKTAEQTPLSALYVANLLHEAGLPEGVLNVVSGFGPTAGAALSSHMGVDKLAFTGSTGTGQIVLELAEESNLKPVTLELGGKSPFIVMDDADVDQAVELAHQAVFFNQGQCCCAGSRTFVHERVYDEFVEKSKARALKRVVGDPFRDGVEQGPQIDGEQFNKILRYVQSGVDSGATLVAGGDRXGDRGFYIQPTVFADAKDEMKIAREEIFGPVQTILKFSGVEEVIRRANATPYGLAAGVFTRSLDAANTXLSRALRAGTXVWVNCYDVFDATIPFGGYKMSGVGREKGXYALRNYLQTKAVVTPIKNPAWL

SEQ ID NO: 9185 - protein, 349 aa, Zea mays
  misc_feature (172)..(172): Xaa can be any naturally occurring amino acid
  misc_feature (227)..(227): Xaa can be any naturally occurring amino acid
  misc_feature (261)..(261): Xaa can be any naturally occurring amino acid
  misc_feature (312)..(312): Xaa can be any naturally occurring amino acid
  misc_feature (328)..(328): Xaa can be any naturally occurring amino acid
RRGLWGTCVVVGKCDLGPGREAVDVTDTKGFSLTGTGVTTDVQTSYAARIMGLSVIPFIIAQFPKMLKTHHGQRLAMLLALVVSFALVLAYCLYQVFQPWIQRRKLAYAKHKHVISGILRHAQMQSLGRLLNDDGTPNEQVIRKCDSFPLSQLLSVVWPVVRSLAHCFRSCXLFRKIDMDESRSLSRAELHALIAGINFEEVDFDRTDTVDKVMDDFNTSRNDVVEXEEFVQRMSKWLDEARRSVPVAGAFSSKFIHEYHXRTRQEQDELVDRSDEPVESVENSGWCIAKAVALLLVGSAAASAFSDPIVNXVHGFSNATSIPSYFIXIIAIPLAANSSETVSAIMFAR

SEQ ID NO: 9186 - protein, 636 aa, Zea mays
MDCLNLRTSFRVLLSIQLLLSSFSPLIVANLSSEKQALLDFVSAVYHGNKLNWDKHTSVCSWHGVKCSEDQSQVFELRVPAAGLIGVISPNTLGKLYSLQVLSLRSNRLTGSLPADVASLPSLRSIYLQHNELSGGLPSSFSPNLSVIDFSYNSFTGEVPASLQNLTQLTVLNLQDNSFSGSIPDLKLHNLKLLNLSNNELKGSIPRSLQKFPKGSFSGNAGLCGLPLVECSHPSPARSPESSPPPQSPPLTHHDKKLGTGFIVAVAVGGFALLMLVVVVCFSKRKGKDEIDVESKGKGTATRSEKPKQEFSSGGQIAEKNKLVFLEGCTYSFDLEDLLRASAEVLGKGSYGTAYKAILEDGTVVVVKRLKDVVAGKREFEQQMELIERLGKHANLLPLRAYYYSKDEKLIVYDYIDTGSVSAMLHGIRGVTAKTPLDWNSRMKIILGTAYGIAHIHSEGGAKLTHGNVKSTNVLVDQDHNPSVSDYGLSALTSVPVNASRVVVGYRAPEIVENRKITQKSDVYSFGVLLMEMLTGKAPLQTQGNDDVVDLPRWVHSVVREEWTAEVFDVELMKHQNIEEELVQMLQIAMVCTAKSPDRRPTMEEVIRMIEGLRQSTSESRASSDEKSKESNPPSV

SEQ ID NO: 9187 - protein, 163 aa, Zea mays
MKIQKANAGVLTNFEVLDFLRSRGAKIDPMGCLGAVAVSECKVYEYILKTPACNQTRESIYEFVKRSEGFRLAEADKLNVINWRPSSAADAYAMIEECGKRFSRDERGEACDEDERVQEFLDMVKEVLPAPPKAEVETAEAEAEAEAEAEAVEAEAEVEAMQE

SEQ ID NO: 9188 - protein, 575 aa, Zea mays
MAAQVVAAAGTPVARPLGGGSGADALRPAATMPRERRTGAVAARGRRESQVVSVISRAPRPDAGVLPVSPDDDAAVKEEANFQHLKAIQQLATAANGVWSKPNVRRKTKIVCTIGPSTNTRDMIWKLAETGMNVARLNMSHGDHASHQKVIDLVKEYNASHADNVIAIMLDTKGPEVRSGDLPQPIFLESGQEFTFTIKRGVGTDTCVSVNYDDFVNDVEVGDMLLVDGGMMSFLVKSKTEDSVKCEVIDGGELKSRRHLNVRGKSATLPSITDKDWDDIKFGVDNQVDYYAVSFVKDAQVVHELKDYLKSCNADIHVIVKIESADSIPNLHSIITASDGAMVARGDLGAELPIEEVPLLQEEIIRMCRSMGKAVIVATNMLESMIVHPTPTRAEVSDIAIAVREGADAVMLSGETAHGKFPLKAVKVMHTVALRTEATIPGGETPADLGQAFKNHMSEMFAYHATMMSNTLRTSIVVFTRTGFMAILLSHYRPSGTIFAFTDEERVRQRLALYQGVCPVQMEFSDDAEKTFGNALSYLLKHGMVKDGKEVALVQSGKHPIWRSQSTHNIQVRKI

SEQ ID NO: 9189 - protein, 326 aa, Zea mays
MDLASSDLAALGAAELIRVSASIPRAAPRTFALLTACLVFPLSFAVLAHSLFTHPILLRIRGAAHSGFAPWLGLFAYQFIYLIVLFTFSLLSTAAAVFTVASLYTGKPASVSSSLSALRPILPRLLRTFLWVSLLMLAYHLAFALAVLLLIVVFAPNASESAPPSLAFVLFLLLVVLVFLGIHVYISALWHLASVVSVLEPLCGLAAMAKSRQLLQGRTGTAATLVVSYFAVCGATSLLFRAAVVKGRTEEGSFGLALPGRLLVGAVLVCVLVSVNLLGLLVQSVFYYACKAFHSQQIDRTALYEHLGGYLGEYVPLKSNIQMENL

SEQ ID NO: 9190 - protein, 274 aa, Zea mays
MANGGAAAGKLTVAETFSNLREQGKSAFIPFITAGDPDLVTTSKALKILNSCGSDVIEVGVPYSDPLADGPVIQASATRALKKGTTLDSVIEMLKGVTPELSCPIVLFTYYNPILKRGVGNFMSTIKQAGIHGLVVPDLPLEETALLRSEAIMHNIELVLLTTPTTPTDRMKGIAQASEGFLYLVSAVGVTGARSNVNLRVEHLLREIKKVTDKPVAVGFGVSTPEHVKQIVGWGADGVIVGSAIVKQLCEAATPEEGLERLEEYARSMKAAMP

SEQ ID NO: 9191 - protein, 478 aa, Zea mays
MGRAFVYVILGGGVAAGYAALEFARRGGYSRGELCIISEEAVAPYERPALSKGYLLPEGAARLPGFHTCVGANDELLTPKWYKEQGIELVLGTKVISADVRRKTLLTGTGETISYKTLIIATGARALKLQEFGIQGSDASNICYLRNIDDADKLVSVMKSCPGGNAVVIGGGYIGMECAAALVTNKIRVTMVFPEKHCMGRLFTPKIAEFYENYYTSKGVTFVKGTVLTSFEKDTTGKVTAVILKDGRHLPADMVVVGIGIRANTSLFEGQLMMSTENGGIKVNGQLQTSDSSVYAVGDVAAFPIKLFDDDIRRLEHVDSARRTGRHAVASILDPSKTRDIDYLPFFYSRVFTLSWQFYGDNVGEVVHFGDFTSSSPRFGAYWVNKGRIAGAFLEGGSREEYEAISIAVRREAVVTDMGELEKQGLALAIQESQKEVPDSGLAVVGKPTYAWHATAGVIAAVSIAAIGYWYGRKRRRW

SEQ ID NO: 9192 - protein, 542 aa, Zea mays
MYMRPPTANDRPPSGGGGGAAAGAAAGDDDFAFYYSYLQDADAAAASATSTLALTVDDPNPSAAGMTNGRRRKQRGADGAGAAGEGEEEATKDGKKRSIAKLLTSLAALEAEEHADRAGAADASRRELALLESNADTRSQATMDYYAKMESSNDGDYEHTSAAAAAAAAGGGGGGRGGGRRLWVKERDHEWWDRMSSPACPEDEFRRAFRMSRATFEAVCEELGAAVAKEDTMLRAAIPVRQRVAVCIWRLATGEPLRLVSKRFGLGISTCHKLVLEVCAAIKAVLMPKAVQWPEAPDAAAAESARFEAASGIPGVVGAMYTTHIPIIAPKANVAAYYNRRHTERNQKTSYSITVQGVVDAGGAFTDVCIGWPGSMSDADVLDRSALYLQRGAAGLLQGQRLVGGAGYPLMDWLLVPYTHHNMTWAQHVFNERVDGVRAVARDAFQRLKSRWGCLQKRTEVKLQDLPVVLGACCVLHNICERAGDAVDPDIAFQLFDDDMVAENPVRSTAAVAARDSIAHNLLHRSSSSSSSAAAGPRFAFN

SEQ ID NO: 9193 - protein, 568 aa, Zea mays
  misc_feature (197)..(197): Xaa can be any naturally occurring amino acid
MYMRPPTANDRPPSGGGGGAAAGAGAAAGDDDFAFYCSYLQDADAAAASATSTLALAVDDPNPNPSAAGMTNGRRRKQRGAEDAGAAGEGEEEAKKDGKKRSIAKLLTSLAALEAEEHADRAGAADASRRELALLESNADTRSQATMDYYAKMESSFDATAESEAAARSKRSRLAASAAAAGAVAGEEAAASAAGVXSASASPTRAAGQGQAGPHQRRLWVKDRSRAWWDRCNSADYPEEEFRRAFRMGRGTFDMICDALGSSVAKEDTMLRAAIPVRQRVAVCVWRLATGEPLRLVSKRFGLGISTCHKLVLEVCAAIKSVLMPRFLQWPDADAAARFKEGFERASGVPGVIGAMYTTHIPIIAPKISVAAYFNRRHTERNQKTSYSITLQGVVGPDGAFTDVCIGWPGSMPDDQVLEKSMLHQRAAAGMMHDSWLVAGASYPLMDWVLVPYTHPNLTWTQHAFNEKVAELRRVAVEAFARLKARWACLQKRTEVKLQDLPVVLGACCVLHNICEIRGEEVDPAIRCELVDDETTPENPVRSETASRARDNIAHNLLHRGLGGNTFF

SEQ ID NO: 9194 - protein, 275 aa, Zea mays
  misc_feature (264)..(264): Xaa can be any naturally occurring amino acid
MGSGGANTAPLITPYKMGKFDVSHRVVLAPLTRQRSYGNVPQPHAILYYQQRATKGGLLIAEATGVSDTAQGYKDTPGIWTHEQVEAWKPIVDGVHQKGGIFFCQIWHVGRVSNSTFQPNGQAPISSTDKPLKPQVRANGIDVATFAVPRRLETDEIPLVVNDFRVAARNAIEAGFDGVEIHGAHGYLIDQFLKDGVNDRTDKYGGSLENRCRFALEVTQAVADEIFSVNFPPPLSPFASYSEGADSDPEALGMYMVNALNEFXILYCHMVEPPD

SEQ ID NO: 9195 - protein, 371 aa, Zea mays
MGSGGANTAPLLTPYKMGKFDVSHRVVLAPLTRQRSYGNVPQPHAILYYQQRATKGGLLIAEATGVSDTAQGYKDTPGIWTHEQVEAWKPIVDGVHQKGGIFFCQIWHVGRVSNSTFQPNGQAPISSTDKPLKPQVRANGIDVATFAVPRRLETDEIPLVVNDFRVAARNAIEAGFDGVEIHGAHGYLIDQFLKDGVNDRTDKYGGSLENRCRFALEVTQAVVDEIGADKVGIRLSPFASYSEAPDSDPEALGMYMANALNEFGILYCHMVEPRMVKLGEKFETPYSLRPIRDAFRGTFIVAGGYGREDGNRAISTGYADLVAFGRLFLANPDLPRRFEVDAPLNKYNRDTFYIPDPVVGYTDYPFLSSDV

SEQ ID NO: 9196 - protein, 514 aa, Zea mays
MAGGVVVNAAGGKTYPGRMTPFVFFTCLVASSGGLIFGYDIGISGGVTSMASFLKEFFPSVYAKAAANKDTNQYCKFDSQLLTLFTSSLYLAALATSFVAASVTRVFGRKWSMFCGGVTFLAGSALNGAATDVMMLIMGRILLGVGVGFANQSVPLYLSEMAPAKLRGMLNIGFQLMTTIGILAANLINFWTAGIEGGWGWRIGLGLAGVPALIITLGALVLPDTPNSLIARGFNDDAKAVLVKIRGTDDVQDEYDDMVAASEEANAIEHPWRNILERRYRPQLTVAALIPFFQQLTGINVIMFYAPVLFLTIGFGDDASLMAAVITGLVNMFATVVSIVCVDRLGRRALFLQGGTQMFVSQIVVGTLIALQFGTAGVGEMSRSNAWLLVLFICLYVAGFAWSWGPLGWLVPSEVFALEVRSAGQSIAVCVNMLLTFIIGQAFLSMLCSLKFGLFYFFAGWMFIMTTFIALFLPETKGVPIEEMNLVWSRHWFWGKYVNVDTQHGGASPRSNGV

SEQ ID NO: 9197 - protein, 602 aa, Zea mays
MPCPNPDPFRGAVPGRKSSWNYRESWCNHHSTCSASPPPGGSSRPRSPPPGPTPASPRPPSPRPRQRMAPSPRCRPSTTRRRRTTGRAPRRSRGRPGRKKPATHTPARRFCRAPTNRAGRKPPQHMQRLASSRRLLQAALAPARANSSLSAAAVAAPAPANGAFPKMPAFDYTPPPYDGPRAEEIFRKRAQFLSPSLFHFYDRPLNIVEGKMQYLFDEDGRRYLDAFGGIATVCCGHCHPDVVEAIVNQAKRIQHSTVLYLNHAIADFAEALASKMPGDLKVVFFTNSGTEANELALMIARLYTGCNDIISLRNGYHGNAAGTMGATAQSNWKFNVVQTGVHHALNPDPFRGAFGSDGEKYARDVQEIIEFGTTGRVGGFISEAIQGVGGIVELAPGYLPVAYSMVRKAGGLCIADEVQAGVARTGSHFWGFEGHGVIPDIVTMAKGIGNGIPIGAVVTTPEIAQVLTRRSYFNTFGGNPVSTAGGHAVLKVLEKEKLQENAFVVGSYLKEQLNNLKDKHEIIGDVRGKGFLLGVELVTDHEKKTPAKAEISRVMNHMKDMGVLVGKGGFYGNVFRITPPLCFTKEDSDFFIEVMDIALSKL

SEQ ID NO: 9198 - protein, 219 aa, Zea mays
MMEPGAPYFGAMGSNASGAGGGLYQPFNSNLAGAGSSTGIQSFPCVRLRGLPFDCNDIDVNKPRLPGGAHLLDKRQNMGRRYVEVFRCKKQEYYSAIANEVSQGGYFESECRRSSPPPRPPKKTAEDKGSMEYTEVLKLRGLPYSATTEDIIKFFLEYELTEENVHIAIRSDGKATGEAFVEFPTAEVAKTAMCKDKMTIGTRYVELVPSTPEEASRAR

SEQ ID NO: 9199 - protein, 635 aa, Zea mays
MSGAIGGAEVHGFRGAAAQLPRSRVLGRPIRVAPPAAARPGGASAGSIRAVSAPAKKDASEVKRSKVEIIKEKSNFLRYPLNEELVSEAPNINESAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPYVKKDILFAQQTAENIAALLTPQSGAYYDLWVDGEKIMSAEEPPEVTKARNDNSHGTNFPDSPEPIYGTQYLPRKFKVAVTAAGDNSVDILTNDIGVVVVSDDAGEPIGFNIYVGGGMGRTHRVETTFPRLADPLGYVPKEDILYAIKAIVVTQRENGRRDDRKYSRMKYLIDRWGIDRFRAEVEKYYGKKFESFRPLPEWQFNSYLGWQEQGDGKLFYGVHVDNGRVGGQAKKTLREIIEKYNLDVSITPNQNLILCGIDQAWREPITTALAQAGLLEPKDVDPLNLTAMACPALPLCPLAQTEAERGILPILKRIRAVFNKVGIKDSESVVVRITGCPNGCARPYMAELGFVGDGPKSYQIWLGGTPNQSTLAESFMDKVKLDDIEKVLEPLFTYWNGTRQEGESFGSFTNRTGFDKLKEVVNKWAESPSAA

SEQ ID NO: 9200 - protein, 503 aa, Zea mays
MLMSHSQQMANSRKPPGLRLLGGAGSLRTYQTLVLVLTFLAYTCFHMTRKIPSIVKSALDPQTKVGFSHWGRLHASRNALTTGWLPFNTADGSALLGEIDVAFLAAYSVGMFFAGHIGDRMDLRVFLTVGMAGTAVFTTLFGAGYWLNVHSFYYFLVIQMVSGLFQSVGWPSVVAVVGNWFGKSKRGLIMGIWNAHTSVGNIAGSLLAAFLLKFGWGWSFAVPSLIMALVGLMVYVFLPVSPEAMEIDSDGGELNCEKDAVKEPLLEPGQEVRHSAVGFLEAWRIPGVAPFALCLFFSKLVAYTFLYWLPFYISHTRIGGEYLSDATAGSLSTIFDVGGVLGGVLVGHISDRLNARAITAASFTYCAIPALFLYRTYGSMSMAWNVSLMFVTGMFVNGPYALITTAVSADLGTHSSLNGNSRALATVTAIIDGTGSVGAAIGPLVTGYVSSRSWSAVFTMLMAAALLAGLLLSKLVCAELQGKTHSSVSKDAGGEHGAYSDEV

SEQ ID NO: 9201 - protein, 245 aa, Zea mays
MFLSRIVLRDLDSIDSPASMASSKKVVTRDEWELKLRDVKIRKEDMNRLVMNFLVTEGFVDAADKFRIESGTQPEIDLATITDRMEVKRAVQSGNVQEAIEKINDLNPTILDTNPQLYFHLQQQKLIELIRVGKINEALEFAQEELAPRGEENQTFLEEIEKTVALLVFEDVKNCPYGELLDVSQRLKTASEVNAAILTSQSHEKDPKLPSLLKMLKWTQNQLDEKAAYPRINDFTTAALEDPSI

SEQ ID NO: 9202 - protein, 354 aa, Zea mays
MHPKARIHADPVREVDHFDCLPDSLVLLILNKVEDVRSLGRCYAVSKRLCGLVSLVHDVYVKIDRVVAVDGDAEGTLNLSSPKPRSIFSHFLKLMLFTIIKPFHNMRSPNGTARPLFPQLSQHSPAQVLRNFTHVRNLRIELPSGDVGTEEGVLLKWRAEYGSTLENCVILGGTRVDRKPVGGEHEPALEDNGSMPESFYTNGGLKLRVVWTISSLIAASTRHYLLRSIINGHPTLQSLVLTDADGQGTLCMGAKQLEEFRENQLSASACSNRTQVPACNMKLKYAPYVELPGGMALQGATLVAIKPSPEGSNGSHPNRKEAEGFVFGAFDGPFKAAVKALMKRRTYLLEMNGF

SEQ ID NO: 9203 - protein, 388 aa, Zea mays
MNGGGEDGKQQPHLVLAHKLFLLSHSDVDDLAKVDLRADVFAAVKSDDMAALYESLAADGVLETDAALLAEMRARIDEEIRKLDEKIADAEENLGESEVREAHLAKSLYFIRVGEKEKALEQLKVTEGKTVAVGQKMDLVFYTLQIGLFYMDFDLISKSIDKAKNLFEEGGDWERKNRLKVYEGLYCMATRNFKKAASLFLDSISTFTTYELFTYDTFIFYTVLTSVISLDRVSLKQKVVDAPEILAVIGKVPHLSEFLNSLYNCQYKSFFIAFSGLTEPIKLERYLQPHFRYYMREVRTVVYSQFLESYKSVTMEAMAAAFGVTVDFIDQELSRFIAAGKLHCKIDKVAGVLETNRPDARNAFYQATIKQGDFLLNRIQKLSRVIDL

SEQ ID NO: 9204 - protein, 578 aa, Zea mays
MLSRLAAARRQLLLSPAVAYRSSSAAATASAVHERAAPASASVLPDTLERGSDAYQRNTAAVGGLLSDLRARVSQVLRGGGAEAVRRNAARGKLLPRDRIDRLLDPGASFLELSQLAGSDVYDEALPSAGIITGIGPVHGRLCMFVANDPTTKGGTYYPLTVKKHLRAQEIASECKLPCIYLVDSGGANLPRQADVFPDRDNFGRIFYNQAKMSSDGIPQIAVVLGSCTAGGAYIPAMADESVIVKGNGTIFLAGPPLVKAATGEEISAEDLGGASVHCKVSGVSDHFAQDEIHGLELGRNIVKNLHLAAKGTNIQSSACGYQEPLYDVEELRSIAPADVKQSFDIRSIIARIVDGSEFDEFKKLYGTTLVTGFARICGQPVGIIGNNGILFTESALKGSHFIELCAQRHIPLIFLQNITGFMVGSKSEASGIAKAGAKMVMAVSCAKVPKITIIVGGSFGAGNYGMCGRAYSPNFLFLWPTARISVMGGIQAAGVLAQIEKNNKRRQGVEWSKDEEEAFKAKVVEAYDREGSPYYSTARLWDDGVIDPADTRRVLSLCLSASAKPVPEDTRYGVFRM

SEQ ID NO: 9205 - protein, 453 aa, Zea mays
MAASARDSTDAAERVVDDHDGWASDAEMDVEMDVVEGDADRRDGGADGDDEYLLLTRIRDTSAAEARAGKDIQGIPWERIHIARQDYRKARLEQYKNYENFPQSGELMDKLCKQVEKSSKYYEFQHNTRSVKPSILHFQLRNLLWATSKHDVYFMSNSTVSHWSSLSHKLSEVLDFSGHVAPAEKYPGSLLEGFSGVQVSTLAVNEGLVVAGGFQGELIGKDVEGCSVKFCMRTTLSDNAITNAIDIHRSISGSLHITVSNNDCGVREYDMERYQLVNHYRYNWPVNHTSVSPDKKLLAVVGDDRDALLVDSRNGKVTSTLVGHLDYSFATAWHPDSRTFATGNQDKTCRIWDTRNLSTSLAVLRGNIGAIRCIRYSSDGRFLVFSEPADFVHVYSVAADYKKRQEIDFFGEVSGITLSPDDESLFIGVCDRVYASLLQYRMIRGFDYLDSYV

SEQ ID NO: 9206 - protein, 461 aa, Zea mays
HWVPRGRPGKNSNATRRWWRPARHPPPPQLRSAMASLQSFLAVKPTTAARRELSAASLAVVDGEARYLVSTYKRSRVVFEHGRGCKLYDTDGREYLDMAAGIAVTALGHADPDVCATIAEQAGKVVHVSNVFYTKPQVELAKRLVEVSFADRAFFASTGTEANEAAIKFSRKFQRAAHPESGDPPTEFLAFSSSFHGRTMGAVALTSKSQYREPFAPVMPGVTFVDYGDLEAAKKFVRSGRVAAVFVEPVQGEGGIHSATREFLQGLRDACDEAGALLVFDEVQCGFGRTGHLWAHEAYGVEPDIMTLAKPLANGIPIGVVLVKEKVAAAINYGDHGTTFGGGPLACQTAITVFDKITRPGFLAEVSRKGESFKQLLRAKLSGNPHVREVRGVGLLVGVELDVPAGPLVDACLDAGVIVLTAGKGNVVRLVPPLIVSEKELEHAADVIRDCLPALDVVAAA

SEQ ID NO: 9207 - protein, 682 aa, Zea mays
PILPSYTYTVGTPSNQRRGDDDCAASAFLPYRNRTNQSIIPLCSRRPSASKQGTDAAGMGSGVRALMRRKQVDSERTRAAGSAHQLRKELSVTQLVAIGVGSTIGAGVYVLVGTVAREHSGPALTLSFLIAGIAAALSAFCYAELASRCPSAGSAYHYSYICVGEGVAWLIGWALILEYTIGGSAVARGISPNLALFFGGQDSLPWILARHEIPWLDVVVDPCASFLVFVVTGLLCVGIKESSFVQGVVTVLNCFVMLFVIIAGSYIGFQTGWVGYKVAGGFFPYGANGMLAGSATVFFAYIGFDSVASTAEEVKNPQRDLPLGIGTALSICCSLYMLVSVVIVGLVPYFAMDPDTPISSAFAKHGMHWAMYLVTTGAVLALCSTLMGSILPQPRILMAMARDGLLPSFFSDVHKTTQVPVKSTVVTGICAAALAFFMDVSQLAGMVSVGTLLAFTIVAVSILILRYVPPDEVPLPSSLQASFRLSQENDEEKLRGTLGDDDHEQGSAEISDVVVEPITDPLIEKQLYASNLSEAKRRKTAACSITSVCIGVLILTTSASATFLPFPVRCSVCVLGGMLLLAGLGMLCWIDQDDGRHSFGHSGGFICPFVPLLPVMCILINTYLLINLGGGTWMRVGVWLVMGVFVYIFYGRTHSSLTDVVYVPVAEANEIYGSSSSLGFVA

SEQ ID NO: 9208 - protein, 176 aa, Zea mays
RIPTRGQATAVYKVSSYAKDHNVPVIADGGISNSGHIVKALSLGASTVMMGSFLAGSHEAPGTYEYKDGLRVKKYRGMGSLEAMTKGSDARYRGRTLKLKVAQGGGGAVADKGSVLRFIPYTMQAVKQGLQDLGADSLQSAHDLLRSETLRLEVRTGAAQAEGGIHGLESYVKKAF

SEQ ID NO: 9209 - protein, 83 aa, Zea mays
  misc_feature (9)..(9): Xaa can be any naturally occurring amino acid
  misc_feature (13)..(13): Xaa can be any naturally occurring amino acid
GDTLKLKVXQGVXGAVHDKGSVLRFIPYTMQAVKQGLQDLGADSVQSAHDLLRSETLRLEVRTGAAQAEGGIHGLVSYVKKAF

SEQ ID NO: 9210 - protein, 111 aa, Zea mays
DKDGCRVKKYRGMGSLEAMTKGSDARYLGDTLKLKVAQGVVGAVADKGSVLRFIPYTMQAVKQGLQDLGADSLQSAHDLLRSETLRLEVRTGAAQAEGGIHGLVSYVKKAF

SEQ ID NO: 9211 - protein, 790 aa, Zea mays
  misc_feature (162)..(162): Xaa can be any naturally occurring amino acid
MAQQLPCVSSPRPLLAVPAGRWRAGVRGRPNVAGLGRGRLSLHAAAARPVAEAVQAEEDDDDDDEEVAEERFALGGACRVLAGMPAPLGATALRGGVNFAVYSSGASAASLCLFAPGDLKADRVTEEVPLDPLLNRTGNVWHVFIHGDQLHGMLCGYRFDGXVFAPERGQYYDVSNVVVDPYAKAVVSRGEYGVPAPGGSCWPQMAGMIPLPYNKFDWQGDLPLGYHQKDLVIYEMHLRGFTKHNSSKTKHPGTYIGAVSKLDHLKELGVNCIELMPCHEFNELEYFSSSSKMNFWGYSTINFFSPMARYSSSGIRDSGCGAINEFKAFVREAHKRGIEVIMDVVFNHTAEGNEKGPILSFRGIDNSTYYMLAPKGEFYNYSGCGNTFNCNHPVVREFIVDCLRYWVTEMHVDGFRFDLASILTRGCSLWDPVNVYGSPMEGDMITTGTPLVAPPLIDMISNDPILGNVKLIAEAWDAGGLYQVGQFPHWNVWSEWNGKYRDTVRQFIKGTDGFAGAFAECLCGSPQLYQAGGRKPWHSINFVCAHDGFTLADLVTYNSKYNLSNGEDNRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTKFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 9212 - protein, 410 aa, Zea mays
MPTRAPRVRLRRQIHPTVRVTPRQGRTHRGRVHTPETEAGRHKLWGLGSSFSPPARSLSLVSRLLHSKRTGAGERREQRATHSPPPDFLGVADRSPGQRGTAGPLGSPEMLPYATAAEAEVALGRPMTPAEALWFRYTAGVSDYHLYCCNILFLFVVFTVAPLPIALLELRAPAAVSPYKLQPRVRLSRAEFVRCYKDVLRIFFLVIGPLQLVSYPAVKFVGIHTKLPLPSLAELAAQLLVYFLVEDYLNYWIHRFLHGEWGYQNIHRVHHEFTAPIGFAAPYAHWAEVLILGIPSFVGPAIVPGHMITFWLWIILRQVEAIETHSGFDFPFTPTKYIPFYGGAEYHDYHHYVGGQSQSNFASVFTYCDYLYGTDKGYRFHKTYLAKLKDLGHNDGQKGDGSGPSYVKLD

SEQ ID NO: 9213 - protein, 512 aa, Zea mays
MGCCGSSQRAGTHPEKKPPGALPPHRPSYSLNQHQAPAPPPPSAARAGARQVPPLKEFSLAELRAATAGFAAGNIVSESGEKAPNFVYRGRLDAGRRAIAVKKFTKMAWPDPKQFAEEAKGVGKLRHCRLANLIGYCCDGDERLLVAEFMPNDTLAKHLFHWENQTIEWAMRLRVAYYIAEALEYCSTEGRPLYHDLNAYRVLFDENGDPRLSCFGLMKNSRDGKSYSTNLAYTPPEYLRNGRVTSESVIFSFGTILLDLLSGKRIPPSRALDMIKGNNIQVLMDSHLEGNYSTDEATTLVDLASQCLQYEPRDRANTKKLVSVLEPLQIKSEVPSYEMLGIPKHEEEAPPPPQPQRPLSPMGEACSRMDLTAIHQILVNTHYRDDEGSNELSFQEWTQQMRDMLEARKRGDFAFRDKDFKAAIDCYTQFVDVGTMVSPTVYARRSLCHLMCDQPDAALRDAMQAQCVYPDWPTAFYMQAVALAKLNMQSDATDMLNEASQLEEKRQKNTKP

SEQ ID NO: 9214 - protein, 464 aa, Zea mays
  misc_feature (424)..(424): Xaa can be any naturally occurring amino acid
MAGCNEAHGWGSQGCLWSPLTLARRNYRRDRRQLHETDGRHVTIYMSHVHESGAQFSHACPSSWLVITTSKSQVRAGEVEVEEEQRNPFQECLMAGGKEAHGWAARDVSGHLSPYHFSRRVQRDDDVTIKVLFCGLCHTDLHVIKNEFGNAKYPVVPGHEIVGVVTDVGSGVTSFKPGDTVGVGYFVDSCRSCDSCSKGYESYCPQLVETSNGVSLDDDDGGATTKGGFSDALVVHQRYVVRVPASLPPAGAAPLLCAGVTVFSPMVQYGLNAPGKHLGVVGLGGLGHLAVRFGKAFGMKVTVISTSLGKRDEALGRLGADAFLVSRDPEQMRAAAGTLDGVIDTVSADHPVVPLLDLLKPMGQMVVVGLPTKPLQVPAFSLVAGGKRVAGSAGGGVGECQAMLDFAGEHGITADVEVVGMDYXQYRHPAPREERCQVPLRCRRRGQQDWRLGITIPSVLSIDV

SEQ ID NO: 9215 - protein, 304 aa, Zea mays
  misc_feature (94)..(94): Xaa can be any naturally occurring amino acid
  misc_feature (111)..(111): Xaa can be any naturally occurring amino acid
MEPGSTPPNGSAPATPGTPAPLFSSGGPRVDSLSYERKSMPRCKCLPLPAVEGWGVATHTCVVEIPAPDVSLTRKLGAEFVGTFILIFFATAAXPIVNQKYGGAISPFGNXAACAGLAVATVILSTGHISGAHLNPSLTIAFAALRHFPWLQVPAYVAVQALASVCAAFALKGVFHPFLSGGVTVPDATISTAQAFFTEFIISFNLLFVVTAVATDTRAVGELAGIAVGAAVTLNILVAGPTTGGSMNPVRTLGPAVAAGNYRQLWIYLLAPTLGALAGASVYTAVKLRDENGETPRTQRSFRR

SEQ ID NO: 9216 - protein, 242 aa, Zea mays
  misc_feature (52)..(52): Xaa can be any naturally occurring amino acid
  misc_feature (64)..(64): Xaa can be any naturally occurring amino acid
  misc_feature (120)..(120): Xaa can be any naturally occurring amino acid
  misc_feature (208)..(208): Xaa can be any naturally occurring amino acid
  misc_feature (232)..(232): Xaa can be any naturally occurring amino acid
KHLRGGCCTQLGAEFVGTFILIFFATAAPIVNQKYGGAISPFGNAACAGLAXVATVILSTGHIXSGAHLNPSLTIAFAALRHFPWLQVPAYVAVQALASVCAAFALKGVFHPFLSGGVTXVPDATVSTAQAFFTEFIISFNLLFVVTAVATDTRAVGELAGIAVGAAVTLNILVAGPTTGGSMNPVRTLGPAVAAGNYRQLWIYLLAXPTLGALAGASVYTAVKLRDENGEXTPRTQRSFRR

SEQ ID NO: 9217 - protein, 225 aa, Zea mays
MAAAKIAPSMLSSDFANLASEAERMVRLGADWLHMDIMDGHFVPNLTIGAPVIQSLRKHTKAYLDCHLMVTKPSDYVEPFGKAGASGFTFHIEVARDNWQDLIQSIKSKGMRPGVSLRPGTPVEEVFPLVEAENPVELVLVMTVEPGFGGQKFMPEMMDKVRTLRKKYPSLDIEVDGGLGPSTIDVAASAGANCIVAGSSIFGAADPGAIISVLRKSVEGSQNKN

SEQ ID NO: 9218 - protein, 217 aa, Zea mays
MAAAAAAARRLLSRRASSNSLSAFLRRGAAPEQSLLRPAVVAAASRLGFPRGMARRPGGDGYGAGRDRAPTEMAPLFPGCDYEHWLIVMDKPGGEGATKQQMIDCYIQTLAKVLGSEEEAKKKIYNVSCERYFGFGCEIDEETSNKLEGLPGVLFVLPDSYVDPEYKDYGAELLVNGEIVQRPPERQRRVEPVPQRAADRPRYNDRTRYARRRENQR

SEQ ID NO: 9219 - protein, 580 aa, Zea mays
  misc_feature (89)..(89): Xaa can be any naturally occurring amino acid
  misc_feature (155)..(155): Xaa can be any naturally occurring amino acid
  misc_feature (169)..(169): Xaa can be any naturally occurring amino acid
  misc_feature (231)..(231): Xaa can be any naturally occurring amino acid
  misc_feature (237)..(237): Xaa can be any naturally occurring amino acid
  misc_feature (251)..(251): Xaa can be any naturally occurring amino acid
  misc_feature (257)..(257): Xaa can be any naturally occurring amino acid
  misc_feature (266)..(266): Xaa can be any naturally occurring amino acid
  misc_feature (308)..(308): Xaa can be any naturally occurring amino acid
  misc_feature (328)..(328): Xaa can be any naturally occurring amino acid
  misc_feature (362)..(362): Xaa can be any naturally occurring amino acid
  misc_feature (412)..(412): Xaa can be any naturally occurring amino acid
  misc_feature (446)..(446): Xaa can be any naturally occurring amino acid
  misc_feature (451)..(451): Xaa can be any naturally occurring amino acid
  misc_feature (484)..(484): Xaa can be any naturally occurring amino acid
  misc_feature (497)..(497): Xaa can be any naturally occurring amino acid
  misc_feature (505)..(505): Xaa can be any naturally occurring amino acid
PLRCANQSTLVHGRHGTATNQLPTYHHSGSPASSIKAGDGHGDGLLPFSQPASRQQWRRPPSFQWRWPWAALVPVSLLLVNRLLYGKLXPPGPRRRPVVGNLFDVQPVRCRCYQEWARRYGPIMTVWLGTSPTVVVSTSELAKEVLKTHDQQLAXDRCRDRSTESFSRXGQDLIWADYGPHYIKVRKLCNLELFTQRRLEALRPIREDEVTAMVESVYKAVTAPGSAGKPXVVKNHXLSMVAFNNITRLAXGKRFVXAAGELDEQXLGREFKGIVHNGIKIGASLSIAQHIPVGCAGWAPVDEQAFKXHGERRDRLTVKIMEEHARAXSSSGGAQQHFVDALFTLRDKYDLSDDTVIGLLWXMITAGTDTTVISVEWAMAELLRNPRVQEKLQEELDRVVGRDRVLSETDFXNLPYLQAVVKESLRLHPPTPLMLPHRASASVKIXGYDIXPKGANVVVNVWAVARDPEVWDSPLEFRPERFLXRENIDIKGADFRXVLPFGAGXRRVCPGAQLGINLVASMIGHMLHHFTWTLPSGTCPEDVSMMESPGLVTFMATPLQAVATPRLDKEELYRRVPSDV

SEQ ID NO: 9220 - protein, 513 aa, Zea mays
  misc_feature (157)..(157): Xaa can be any naturally occurring amino acid
MANIDMAKILADLDRGAGDARLPKTKLVCTLGPASRSVPMLEKLLRAGMNVARFNFSHGTHQYHQETLDSLRQAMHNTGILCAVMLDTKGPEIRTGFLKDGKPIKLTKGQEITVTTDYDIKGDENMIAMSYKKLPVDVKPGNVILCADGTISLAVLXCDPDAGTVRCRCENTAMLGERKNCNLPGIVVDLPTLTEKDKEDILGWGVPNDIDMIALSFVRKGSDLVTVRQVLGQHAKRIKLMSKVENQEGVVNFDEILRETDAFMVARGDLGMEIPVEKIFLAQKMMIYKCNIAGKPVVTATQMLESMIKSPRPTRAEATDVANAVLDGTDCVMLSGESAAGAYPEVAVKIMARICIEAESSLDHEAVFKAMIRSAPLPMSPLESLASSAVRTANKAKAALIVVLTRGGTTAKLVAKYRPRVPILSVVVPVLTTDSFDWTISSEGPARHSLIYRGLIPLLAEGSAKATDSESTEVILEAALKSAVQKQLCKPGDAIVALHRIGVASVIKICIVK

SEQ ID NO: 9221 - protein, 402 aa, Zea mays
TGRDEAAWDMDDVAGCFEYFTDQAEALDKRQNSPVSLPMETFKCHLRREPIGVVGLITPWNYPLLMATWKVAPALAAGCAAVLKPSELASVTCLELADICKEVGLPPGVLNIVTGLGPDAGAPLSAHPDVDKVAFTGSFETGKKIMAAAAPMVKPVTLELGGKSPIVVFDDVDIDKAVEWTLFGCFWTNGQICSATSRLLVHTKIAKEFNEKMVAWAKNIKVSDPLEEGCRLGPVVSEGQYEKIKKFILNAKSEGATILTGGVRPAHLEKGFFIEPTIITDITTSMEIWREEVFGPVLCVKEFSPEDEAIELANDTQYGLAGAVISGDRERCQRLSEEIDAGIIWVNCSQPCFCQAPWGGNKRSGFGRELGEGGIDNYLSVKQVTEYISDEPWGWYRSPSKL

SEQ ID NO: 9222 - protein, 505 aa, Zea mays
MASPAMVPLRQLFVDGEWRPPAQGRRLPVVNPTTEAHIGEIPAGTAEDVDAAVAAARAALKRNRGRDWARAPGAVRAKYLRAIAAKVIERKPELAKLEALDCGKPYDEAAWDMDDVAGCFEYFADQAEALDKRQNSPVSLPMETFKCHLRREPIGVVGLITPWNYPLLMATWKIAPALAAGCTAVLKPSELASVTCLELADICKEVGLPSGVLNIVTGLGPDAGAPLSAHPDVDKVAFTGSFETGKKIMASAAPMVKPVTLELGGKSPIVVFDDVDIDKAVEWTLFGCFWTNGQICSATSRLLIHTKIAKKFNERMVAWAKNIKVSDPLEEGCRLGPVVSEGQYEKIKKFISNAKSQGATILTGGVRPAHLEKGFFIEPTIITDITTSMEIWREEVFGPVLCVKEFSTEDEAIELANDTQYGLAGAVISGDRERCQRLSEEIDAGCIWVNCSQPCFCQAPWGGNKRSGFGRELGEGGIDNYLSVKQVTEYISDEPWGWYQSPSKL

SEQ ID NO: 9223 - protein, 392 aa, Zea mays
MAPTTCLRIPFLPARGRSANVNAPPSWLPRRLSLKSSATNGDNSLPNPISTSPTSPPWLTVVDVNGLRRPPAPVSAPTIPGDRGPRWLPRPFTSADVMGADWKGLKVAYQGCAGAYSEAAAKKAYPNCEAVPCEHFDTAFQAVQNWVVDRAVLPLENSLGGSIHRNYDLLVQHSLHIVGEVRLEVHHCLLANPGVKIENLKSVMSHPQALAQCEHTLTGLGIEHREAVDDTAGAAKIVAEHMVQDTGAIASSLAAKLYGLDVLAENIQDGKNNVTRFMMLARKPNILRNDRPFKTSIVFSLEEGHGQLFRALGVFAQRKINLTKIESRPHKERPLRLSDDCSSLLKNFDYLFYVDLEASMADPKIQNALGNLKEFATFLRVLGSYPTNVNEP

SEQ ID NO: 9224 - protein, 85 aa, Zea mays
SSCRALLPNGGCTGKMYSPNNNMSFPPGGCTSLRLPVVTGQEFTHVARSRRVYAHAHDYHINSISNNRLVSFMILWISNQICKKI

SEQ ID NO: 9225 - protein, 515 aa, Zea mays
  misc_feature (446)..(446): Xaa can be any naturally occurring amino acid
MEREPKSPDDRPEPAAAAAQPQPLEWRFAQVFGERAAGEDVQDVDIISAIEFDKSGNHLATGDRGGRVVLFERTDIADNACRRELERQEYLVSRHPEFRYKTEFQSHEPEFDYLKSLEIEEKINKIKWCQTTNNALFLLSTNDKTIKYWKVQEKKVKRVSVMNLDTSQSSDNGSTSSPGTSSCRALLPNGGCTGKMYSPNNNMSFPPGGCTSLRLPVVVTGQEFTHVARSRRVYAHAHDYHINSISNNSDGETFISADDLRINLWNLEISNQSFNIVDVKPANMEDLTEVITCAEFHPTHCNTLAYSSSKGTIRLIDLRQSALCDNHAKLFEEHEAPGSRSFFTEIIASVSDIKFARDGRHILSRDYMTLKLWDLNMDSGPVATFQVHEYLRPKLCDLYENDSIFDKFECCLSGDGLHVATGSYSNLFRVFGCSPESVEASTLEAXRNPMRRQVVDPARPARTLTGAVRRGGENTSVDASGNSCDLSTKLLHLAWHPTENSIACAAANSLYMYYA

SEQ ID NO: 9226 - protein, 444 aa, Zea mays
  misc_feature (134)..(134): Xaa can be any naturally occurring amino acid
  misc_feature (185)..(185): Xaa can be any naturally occurring amino acid
  misc_feature (215)..(215): Xaa can be any naturally occurring amino acid
  misc_feature (279)..(279): Xaa can be any naturally occurring amino acid
  misc_feature (348)..(348): Xaa can be any naturally occurring amino acid
  misc_feature (413)..(413): Xaa can be any naturally occurring amino acid
MSTTKVKRRVGKYELGRTIGEGTFAKVRFARDTVTGEAVAIKILDKEKVLKHKMVEQIKREISTMKLIKHPNVVRIYEVMGSKTKIYIVLEFATGGELFDTIVNHGRMREDEARRYFQQLINAVDYCHSRGCVXTRDLKPENLLLDSYGNLKVSDFGLSALSQQIKDDGLLHTTCGTPNYVAPAXSLEDQGYDGAMADLWSCGVILFVLLAGYLXPFEESNLMTLYKKISNAEFTFPPWTSFPAKRLLTRILDPNPMTRITIPEILEDEWFKKGYKRPXFDEQYDTTLDDVDAVFNDSEEHHVTEKKEEEPVALNAFELISMSAGLNLGNLFDSEQEFKRETRFTSKXPPKKFVRKIEEAAKPLGFDVQKKNYKLRLEKVKAGRKGNLNVATEILQVAPSLHMVEVRKAKGDXTLEFHKFYKNLSKTLKDVVWKSDDLQTQHAS

SEQ ID NO: 9227 - protein, 467 aa, Zea mays
MSTTKVKRRVGKYELGRTIGEGTFAKVRFARDTVTGEAVAIKILDKEKVLKHKMVEQIKREISTMKLIKHPNVVRIYEVMGSKTKVYIVLEFATGGELFDTIVNHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEESNLMTLYKKISNAEFTFPPWTSFPAKRLLTRILDPNPMTRITIPEILEDEWFKKGYKRPEFDEQYDTTLDDVDAVFNDSEEHHVTEKKEEEPVALNAFELISMSAGLNLGNLFDSEQEFKRETRFTSKCPPKEIVRKIEEAAKPLGFDVQKKNYKLRLEKVKAGRKGNINVATEILQVAPSLNTIFFCKAFCDTLLFILIQILQVAPSLHMVEVRKAKGDTLEFHKFYKNLSKTLKDVVWKSDDLQTQHAS

SEQ ID NO: 9228 - protein, 763 aa, Zea mays
LPAGTIHVKFTGSAGQSFGAFLCPGITLELEGDSNDYVGKGLSGGKIVVYPPRNSSFSPEDNIVIGNVALYGATMGEAYFNGMAAERFCVRNSGAQAVVEGIGDHGCEYMTGGTVVILGKTGRNFAAGMSGGIAYVYDVDGKFSARCNNELVDLYHVEEEDDIITLKMMIEQHRRNTESVLARDILSDFDNLLPKFVKVYPRDYKRVLESMKVEKAVAKHAKEPKMANGISVTTKKVQPDQSASRPTHVANAKKYRGFITYERESISYRDPKERVRDWKEVAIESTPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMIPRPPLQRTGRKVAIVGSGPSGLAAADQLNKMGHFVTVFERADRIGGLMMYGVPNMKTDKIGVVQRRVNLMAEEGVTFVVNANVGSDPLYSIERLRSENDAVILACGATKPRDLTIPGRELSGVHFAMEFLHANTKSLLDSNLEDGKYISARGKKVVVIGGGDTGTDCIGTSIRHGCTSLVNLELLSKPPSTRAADNPWPQWPRIFRVDYGHQEAATKFGKDPRTYEVLTKRFIGDGNGKVKALEVVRVKWEKVDGRFQLKEMEGSEEIIEADLVLLAMGFLGPEATIAEKLGLEKDNRSNFKAQFGDFATSVDGVFAAGDCRRGQSLVVWAITEGRQAAAAVDKYLSRYDQNAAATGDSTPSGTGLVQPVAA

SEQ ID NO: 9229 - protein, 341 aa, Zea mays
  misc_feature (74)..(74): Xaa can be any naturally occurring amino acid
  misc_feature (119)..(119): Xaa can be any naturally occurring amino acid
  misc_feature (133)..(133): Xaa can be any naturally occurring amino acid
  misc_feature (139)..(139): Xaa can be any naturally occurring amino acid
  misc_feature (161)..(161): Xaa can be any naturally occurring amino acid
  misc_feature (174)..(174): Xaa can be any naturally occurring amino acid
  misc_feature (187)..(187): Xaa can be any naturally occurring amino acid
  misc_feature (221)..(221): Xaa can be any naturally occurring amino acid
  misc_feature (239)..(239): Xaa can be any naturally occurring amino acid
MASAAATATMGTGKVVCVTGASGYIASWIVRLLLDRGYTVRATVRDTADPKKTLHLTALDGAKDRLHLFKASLXLEEGSFDAAVHGCDTVFHTASPFYHNVKDAKAELLDPAVKGTLNXVLGSCKKASIKKVXVTSSMXAAVAYNRRPRTPEVTVDETWVXSIHKFVETNQQWXYILSKTLAEEAAXWKFSRDNGLEIVTINPANGLLGPLLQPTLNTSAXEPILKFINGSSSTYPNFXLGWVNGQGCCPWPISFAYEVPSSNGRYCMVERVVHYSELVNIIRNMYPTLPLPDKCADDKPFVPPYQVSKEKIKSIGIELIPLETSVKETIESLKEKGFASF

SEQ ID NO: 9230 - protein, 562 aa, Zea mays
MLVLFETPAGFALFKVLDEGKLDKVEDLWKEFTTSDSARKVVELKAFNKFENTSDALSAATLIIDSKPSKGLRKFLQKHCEGETLAVADSKLGNAIKEKLKIDCLHNSAVMELMRGLRNQLTELITGLGAQDLGPMSLGLSHSLSRYKLKFSPEKVDTMIIQAIGLLDDLDKELNTYAMRVREWYGWHFPELTKIVTDNIQYAKVVKMMGNRVNAVNLDFSEILSDEELETQLKEAAVISMGTEVSDLDLSNIRELCDQVLALSEYRAQLYDYLRSRMNTIAPNLTALVGELVGARLIAHGGSLLNLAKQPGSTIQILGAEKALFRALKTKHSTPKYGLIYHASLIGKASQKHKGKISRSLAAKTALAIRYDALGDGEDNSIGTESRLKLETRLQVLEGRELGKSAGSTKGKPKIEVYEKDRKKGTGALTTPAKTYNPAADLVLTEETPKKSELASKKRKHNEVETEPLAEPAEEAIQEDGDQEDRKKKKKKNKESKEAPAGEGDGEKKKKKKSKEVEEEPVVAAASEVKKKKKKSDADGEDVAMQTEESGKKEKKKKKKAC

SEQ ID NO: 9231 - protein, 135 aa, Zea mays
  misc_feature (47)..(47): Xaa can be any naturally occurring amino acid
  misc_feature (85)..(85): Xaa can be any naturally occurring amino acid
MAAGRELVVSFGEMLIDFVPTVAGVSLAEAPAFLKAPGGAPANVAIXAVSRLGGGAAFVGKLGDDEFGRMLAAILRDNGVDDGGXVVFDSGARTALAFVTLRADGEREFMFYRNPSADMLLTADELNVELIKRVS

SEQ ID NO: 9232 - protein, 410 aa, Zea mays
  misc_feature (61)..(61): Xaa can be any naturally occurring amino acid
  misc_feature (154)..(154): Xaa can be any naturally occurring amino acid
  misc_feature (179)..(179): Xaa can be any naturally occurring amino acid
  misc_feature (204)..(204): Xaa can be any naturally occurring amino acid
  misc_feature (303)..(303): Xaa can be any naturally occurring amino acid
ALCIWCPLRSRSISAGTVPVRHGGRTGSPKPIHCKAAVCRAAGEPLTIEEIVVDPPKAYEXRIRVICTSLCHTDITFWKAKVAPVFPRILGHEAYGVVESVGEHVEGFAAGDTVVPTFLGQCERCASCASEHSNVCDGGAVRHRPRDAARRHHXRFRDRAGGAPLHDLLAVSSFSEYTXVVDVNQVVKGRTPAVPPKLACLLSXAAPAPGVGAAWRSAKVEPGSTVAIFGLGSVGLAVVQGAKMCGASKIIGVDLNPDKEEVGRSFGVTDFVNPSQLDKRSVVEVIVEMTGGGVDYSFECIGXPSVMTDAFRCTKMGKGKTIVLGLGRDSDEVCLPSLELLFGRCVMGSLFGGLKPKTHIPVLAKKCMDKELQLDALVTHELGLQDINKAFDLLLQGKSLRCILWMDKDK

SEQ ID NO: 9233 - protein, 218 aa, Zea mays
  misc_feature (43)..(43): Xaa can be any naturally occurring amino acid
IISDHSYIQHLREGAHNFFGTFIKVLRDRPAGHDWELEPVVTXGDYLFGMLRGTRSALYANDRESISATEQEVTPRAGGPLVALYERAVGLYASLVNINDYHQPGMFLAGKKAAGEVLALQKRVLTVLNEATCKDPCEPLTIDEIADRCHCPEDKHNAFPPSITHAQRLLPQIEMIYKIVQHMAANDRAIIAEGSCGSPRSVKVYLGECNVDEDLQAA

SEQ ID NO: 9234 - protein, 593 aa, Zea mays
  misc_feature (351)..(351): Xaa can be any naturally occurring amino acid
  misc_feature (376)..(376): Xaa can be any naturally occurring amino acid
MASISGAAAPPSSAVCRLRLRRHLLLRPSHLRLRAPHSIADLSRSSNSAPNPARPALGSGPENGSGGVRAVEKDPIKLWERYVEWLYQHKELGIFVDVSRMGFTEEFLRQMEPRMQQAFVDMRELEKGAIANPDEGRMVGHYWLRDPALAPNSFLRNKIETALDRILAFSQDVISGKILSPSGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLVGAALMDEETRNTVVSHYXITRTTCSDGMIIYIVSCQTCLSFYXQVKANPAALLALCWYWASEGIGKKDMVVLPYKDSLLLLSRYLQQLVMESLGKEFDLDGNRVNQGLTVYGNKGSTDQHAYIQQLREGVHNFFVTFIEVLRDRPAGHDWELEPGVTCGDYLFGMLQGTRSALYANDRESISVTVQEVTPRAVGALIALYERAVGLYASLVNINAYHQPGVEAGKKAAGEVLALQKRVLTVLKEAMYGTSDLCSFCFSVK

SEQ ID NO: 9235 - protein, 397 aa, Zea mays
MDDAGRPPPHAPVAVTASASASATAAPAPPQPSATAAVDRSSPDPDALYEEGMWQQMAMDSGATMQPGSYPERPGEPDCTYYLRTGLCRFGMSCRFNHPPDRNLAIASARMKGEYPERAGQPECQYYLKTGTCKFGPTCKFHHPREKAGIAGRVQLNTSGYPLRPNEKECAYYLKTGHCKYANTCKFHHPELFNVVPSSRGSPIYTSVHSSASAGPQSYTGTMPSWAFPRASFIPSPRWQSPSNYAPMIVPQGLVQMPSWNSYTGQLQSPGAQQTYGSSQQGEASTGNQGMLSPYRSSSFPVPQYALQRENVFPERPDEPECQYYMKTGDCKFGAVCKFHHPRVRSLPPPDCVLSPMGLPLRPGEELCKFYSRYGICKFGANCKFDHPTVVAPMVYA

SEQ ID NO: 9236 - protein, 192 aa, Zea mays
MLVKKNNSTSMAAGVLPLASLNHISIVCRSVEASLRFYADVLGFVPIRRPGSFDFDGAWLFNYGIGVHLLQSEDPGSLPENKGEINPKDNHISFQCESMVAVERRLKEMGIPYVQRCVEEGGINVDQIFFHDPDAFMIEVCNCDNLPVVPLAAAADQRAPAVLGACKRAAAVGVKQQQQQSSAGGVPSSAAP

SEQ ID NO: 9237 - protein, 221 aa, Zea mays
MVKSTTTMGAASCGGGVLPLASLNHISIVCRSVEASLRFYTDVLGFVPIRRPGSFDFGGAWLFNYGIGIHLLQSEDPGSLPPEKGEINPKDNHISFQCESMVAVERRLKEIGIPYVQRCVEEGGINVDQIFFHDPDGFMIEICNCDNLPVVPLAGDQQRAPAACRRAPAAVNTVKQQQQGSVVPASSAPVTTAAAQCMPSAATAAQAIRVAEESSSHISCA

SEQ ID NO: 9238 - protein, 451 aa, Zea mays
MDQPEENPEFPSCDAYFEAIQSKKKLPLTLQESLTAAFAQIPVSSFPEVPAGRVIEIPGDTSVIDAVRTLSEQNIRAAPVLNPEPGAPTDWQGRYLGVIDYSAIILWVLENAELAAVALSAASATAAGVGMGAVGAVGVAALGTTGPAAVAGLTAAAIGASVAGGLTAEKGVAKDGLTAADHLGEDFYKVLLQQEPFRSTTVRSIVESYRWSPFVPITLDTSMLTVLLLLSKYRLRNVPVIEPEKPIIRNFITQTGVVKGLQQCKGRDWFDYISALPLSDLGLPFMSIDEVITVNSDDLILEAFKCMKDNKIGGVPVVEGPKRKLVGSVSIRDIRFLLLRPNLFSNFRQLTVIEFMKTLGSTLPDSESNCLVKPPPTCTPDASLGSVIDSIASRITHRIYVVDDDLEVVGVVTLRDVISCFIHEPPGYCDNYLASAMEKLEGKGVRSVEKI

SEQ ID NO: 9239 - protein, 472 aa, Zea mays
MATALARRGAAALARWRGMCSSSASAPRSAAALSSEELMRMEQDCSAHNYHPIPMVFSKGEGSHIVDPEGNKYIDFLSAYSAVNQGHCHPKVLRALIEQAERLTLSSRAFYNDKFPIFAEYLTSMFGYDMMLPMNTGAEGVETAIKLARKWGYEKKHIPKNEALLVSCCGCFHGRTLGVISMSCDNDATRGFGPLVPGHLKVDFGDIDGLKKIFEELGDRICGFLFEPIQGEAGVVIPPDGYLKGARDLCSKHNVLMIADEIQTGIARTGKMLACDWENIRPDMVILGKALGAGVVPVSAVLADKDVMLCIRPGEHGSTFGGNPLASAVAVASLKVVRDEGLVERAAKLGQEFRDQLQKVQQKFPQILREVRGRGLLNAVDLNNDALSPASAYDICIKLKERGILAKPTHDTIIRLAPPLTISPEELAEASKALSDVLEHDLPQLQLQKQIKKPESEAEKPVCDRCGRDLYG

SEQ ID NO: 9240 - protein, 414 aa, Zea mays
  misc_feature (58)..(58): Xaa can be any naturally occurring amino acid
  misc_feature (168)..(168): Xaa can be any naturally occurring amino acid
MMKSNQKEQIGCASRGVNKDERARARRAAAGTTIIVVVVARMTVVDAVVSSTDAGAPXAAAATAVPAGNGQTVCVTGAAGYIASWLVKLLLEKGYTVKGTVRNPDDPKNAHLKALDGAAERLILCKADLLDYDAICRAVQGCQGVFHTASPVTDDPEQMVEPAVRGTXEYVINAAAEAGTVRRVVFTSSIGAVTMDPKRGPDVVVDESCWSDLEFCEKTRNWYCYGKAVAEQAAWETARRRGVDLVVVNPVLVVGPLLQATVNASIAHILKYLDGSARTFANAVQAYVDVRDVADAHLRVFESPRASGRHLCAERVLHREDVVRILAKLFPEYPVPARCSDEVNPRKQPYKFSNQKLRDLGLQFRPVSQSLYDTVKNLQEKGHLPVLGERTTTEAADKDAPAAEMQQGGIAIRA

SEQ ID NO: 9241 - protein, 471 aa, Zea mays
  misc_feature (99)..(99): Xaa can be any naturally occurring amino acid
MGAFLLFVCLLAPVVVLACAVRGRKRRASSAAAGGKALPLPPGSMGWPYVGETFQLYSSKNPNVFFARKQNRYGPIFKTHILGCPCVMVSSPEAARFVXLVTQAHLFKPTFPASKERMLGPQAIFFQQGDYHAHLRRLVSRAFSPEAIRGSVPAIEAIALRSLESWDGRLVNTFQEMKLYALNVALLSIFGEEEMRYIEELKQCYLTLEKGYNSMPVNLPGTLFHKAMKARKRLGAVVAHIIEARREGERQRGSDLLASFLDDREALTDAQIADNVIGVIFAARDTTASVLTWMVKFLGDHPAVLKAVIEEQQEIARSKGSSGEPLTWADTRRMRTTSRVIQETMRVASILSFTFREAVEDVEYQGYLIPKGWKVMPLFRNIHHSPDHFPCPEKFDPSRFEVAPKPNTFLPFGNGTHSCPGNELAKLEMLVLFHHLATKYRWSTSKSESGVQFGPFALPLNGLPMTFVRKD

SEQ ID NO: 9242 - protein, 478 aa, Zea mays
MAASLLRRGVVTSRRRCPVEMLRRLVSSEAAADRAPSRPPPEMPPFDHRPRPYAGLGGAEIFEKRKAVLGPSLFHYYQKPLNIVEGKMQYLYDEHGKRYLDCFGGIVTVSCGHCHPDIVNAVVEQTKLLQHTTTIYLHHTIVEFAEALTSKMPGNLKVAYFVNSGTEANELAMLMARLYSGNLSMVALRNAYHGGSAGTIGLTGLQTWKYPIPQGEIHHVMNPDPYRGTFGSDAAAYAKEVEEHITYGSSGRVAGFIAETFQGVGGAVELAPGYLKLAYDIVRKAGGVCIADEVQSGFGRTGSHYWGFQTQGVIPDIVTMAKGIGNGLPLGAVVTTPEIASVLAQKIQFNTFGGNPVCSAGGLAVLKVLDKEKRQAHCADVGSHLLERLKSLQEKHEIIGDVRGRGLMLGVELVTGRKEKTPAKSETIELFEKLRDLGVLVGKGGLHGNVFRIKPPMCFSKDDADFLVDSMDYAMSRL

SEQ ID NO: 9243 - protein, 182 aa, Zea mays
MEAGGEEFAIGVVLSAKTTLGEEFEGQIVAFDRPSNLLVIQEGVGRAESGERRNVRVLKANYIREFSVLSKGDDPLDPAGCMLDLNSIYAREDAALRQAEIEAEKIGVGVTPEAQNIFDALSKTLPVQWDKTDIVVMKEVRVRSPYLPENVSGGTAAANERVKKVIDFERKRLHSRAPGQFS

SEQ ID NO: 9244 - protein, 265 aa, Zea mays
  misc_feature (86)..(86): Xaa can be any naturally occurring amino acid
  misc_feature (112)..(113): Xaa can be any naturally occurring amino acid
MTVIRPADMDALQNALDNNNVSLFFTETPTNPFLRCIDIEHVSNMCHSKGALLCIDSTFASPINQKALTLGADLVIHSATKYIAGXNDVIGGCVSGRDELVSKVRIYHHVVXXGVLNPHAAYLILRGMKTLHLRVQCQNNTALRMAQFLEEHLKIARVYYPGLPSHPEHHIAKSQMTGFGGVVSFEVAGDFDATRKFIDSVKIPYHAPSFGGCESIIDQPAIMSYWDSKEQRDIYGIKDNLIRFSIGVEDFEDLKNDLVQALEKI

SEQ ID NO: 9245 - protein, 316 aa, Zea mays
MMTSWLLGRRGPSGFSWSSTADQVTQGISAAGLTAIVTGASSGIGAETARTLALRGAHVIMAVRSLPAAQAVKDAVLAQAPGAKLDVMELDLSSMASVRAFASQFIDRGLPLNILINNAGVMAIPFALSKDGIEMQFATNHVGHFLLTHLLLDTMKRTSHESNLEGRIVNVSSEGHRLAYREGIRFDKINDESVYSSIGAYGQSKLANILHANELARRFEEDNVNITANSLHPGSIITNLLRYHSILDVLHRTLGKLVLKNAEQGAATTCYLALHPHVKGVSGKYFCDCNLYEPSANAKDMELAKRLWDFGVELIT

SEQ ID NO: 9246 - protein, 353 aa, Zea mays
  misc_feature (100)..(100): Xaa can be any naturally occurring amino acid
  misc_feature (153)..(153): Xaa can be any naturally occurring amino acid
  misc_feature (169)..(169): Xaa can be any naturally occurring amino acid
  misc_feature (183)..(183): Xaa can be any naturally occurring amino acid
MGLDYYKILGVDKGATDDDLKKAYRKLAMKWHPDKNPNNKKEAENKFKQISEAYDVLSDPQKRAVYDQYGEEGLKGQVPPPGAGGAGSTFFSTGGDGPTXFRFNPRNADDIFAEFFGGSSPFGGMGGSGMPGMRAGGSRFSSSIFGDDMFGSXSGGGGPGRARHAHRRXGAVKAPAIERKLPXAALEELYKGTTKKMKISREIADASGKTMPVEEILTIDVKPGWKKGTKITFPEKGNETPHTIPADLVFIIDEKPHPVFTRDGNDLVVTQKVPLAEALTGHTARLTTLDGRILTVPISSVIHPGYEEVVRGEGMPVPKDPSRKGNLRIKFDIKFPARLSADQKSGVKRLLGQ

SEQ ID NO: 9247 - protein, 530 aa, Zea mays
MALEAAYDYLHVAVVQCTPTQAAAVLGVLLLLAIRLAAAARSSSATSPKWKQHRLPPTPPGKLPIIGHLHLIGSHPHVSFRDLHAKYGHNGLMLVQVGAVPTIVVSTPQAAEAVLRTHDHVLASRPRNPVADIIRYNSTDVAFAPYGEYWRTARKVVNTHLLSAKMVFSKRREREEEVRLVVARIRDAAEASPGTALDMTELLGGYASDFVCRAVLGESHRKQGRNKLFRELTETSAALLGGFNVEDYFPKLADVDLFLRIICAKAKGVSKRWDSLFNELLSEYALSGGKQGDHNSEDFVHLLLSLQKDYGLTTDNIKGILVNMFEAAIETSFLVLEYSMSELMNNRHVLAKLQKEVRTATPDGRMVMEEDLSRMPYLKATIKESMRIHPPAPFLLPHFSTHDCEINGYTIPAGTRVIVNAWALARDPTCWDKAEEFFPERFLEQGRDAEVDMYGKDIRFVPFGAGRRICAGATFAIATVEIMLANLIYHFDWEMPAEMERTGAKVDMSDQFGMTLRRTQKLYLVPRIPK

SEQ ID NO: 9248 - protein, 467 aa, Zea mays
  misc_feature (215)..(215): Xaa can be any naturally occurring amino acid
PSHSTANPNPEHRPPLSLARSLQLRTHAPAPPLSFHKARLGRRRWARKKIREYDSKRLLREHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGNTISFSECGGIEIEENWDKVKTIFLPTEKQMTPDACAPLIGHPXPLEVRTKIGGFIRAVFSVFQDLDFSFLEMNPFTLVNGEPYPLDMRGELDDTAAFKNFNKWGNIVFPLPFGRVLSPSESFIHELDEKTSASLKFTVLNPKGRIWTMVAGGGASVIYADTVGDLGYASELGNYAEYSGAPKEEEVLQYARVLLDCATSDPDGRKRALLIGGGIANFTDVASTFSGIIRALREKESKLKAARMNIYVRRGGPNYQTGLAKMRTLGAELGVPIEVYGPEATMTGICKEAIDCIMAA

SEQ ID NO: 9249 - protein, 248 aa, Zea mays
MNHIPPTELGNGGSKQLEIPQPGSFSCGLISSEARPQFRHQPSNSMAANFGNKIRNAKLVLLGDVGAGKSSLVLRFVKGQFVEFQESTIGAAFFSQTLAVNDETVKFEIWDTAGQERYHSLAPMYYRGAAAAIVVYDITNPASFTRAKKWVQELQAQGNPNTIVALAGNKADMLDARHVAVEEAKTYAQENGLFFMETSAKTAINVNDIFYEIAKRLLQGQEAPSPQAGIVLNQRPDERMVSTSSCCS

SEQ ID NO: 9250 - protein, 509 aa, Zea mays
MMIARRLLRPNAPAQATSLLKHVTGTASLQGNADSLLDGTVRHFGSAPSAQPEENGFKGHGMLAPFTAGWQSNDLHPLIIERSEGSYVYDINGNKYLDSLAGLWCTALGGSEPRLLKAATEQLNKLPFYHSFWNRTTKPSLDLAQEILSMFTAREMGKVFFTNSGSEANDSQVKLVWYYNNALGRPNKKKFIARSKAYHGSTLVSASLTGLPALHQKFDLPAPFVLHTDCPHYWRYHLPGETEEDFATRLATNLENLILKEGPETIAAFIAEPVMGAGGVIPPPKTYFDKVQAIVKKYDILFIADEVITAFGRLGTMFGCDYYNIKPDLVSLAKALSNAYVPIGATLVSPEISDVIHSQSNKLGSFAHGFTYSGHPVACAVAIEALKLYRERDIPGHVKQIAPKFQDGIRALADSPIIGEIRGLGMIMGTEFTNNKSPTDLFPAEWGVGAIFGEECQKRGMLVRVAGDAIMMSPTLIMTPGEVDELVRIYGEALKATEERVAALQSKKN

SEQ ID NO: 9251 - protein, 324 aa, Zea mays
IGYLEAGRDHIPTSRTRTNCYPLASPSPPPLQFSPTNRSSSETENGRGAVVPRVLPSLPPRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGITFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 9252 - protein, 306 aa, Zea mays
  misc_feature (44)..(44): Xaa can be any naturally occurring amino acid
  misc_feature (208)..(208): Xaa can be any naturally occurring amino acid
  misc_feature (215)..(215): Xaa can be any naturally occurring amino acid
  misc_feature (289)..(289): Xaa can be any naturally occurring amino acid
EWPRRRRPSCPPISPASPTSAARRRRPLPPSHSSFASASRAAAXQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWXDVVIAYXEPVWAIGTGKVATPEQAQEVHAAVRDWLTTNISPDVASSTRIIYGGSVNAANCAELAKKEDIDGFLVGGASLRXPDFATIINSVTAKKVAA

SEQ ID NO: 9253 - protein, 292 aa, Zea mays
  misc_feature (250)..(250): Xaa can be any naturally occurring amino acid
TIGKVTVWGAMMFVSIYVVYAFVVAANEVLRKHARRLKFDVFTPLLPVRASIFEQGAEQDESAYSSLLEEDADGEVTQMNTSVPQWMWASHVAIYSNHGNRDGSPGSSRPLWGWSEGEVDNSTFNIYKLFSFMELPLTIPRKLTIPIVEEDRWSKEYAVASSCLAPVLLAFLWSSQDTVFTKVSIAAYVMAVMLGIALAALVFLFTSNERPPRRFLFPWVFGGFVMSIIWFYIIANELVALLVALGVILXINPSILGLTVLAWGNSMGDLMSNALEAMPGGDRPANGNGGSW

SEQ ID NO: 9254 - protein, 342 aa, Zea mays
MEQAAMPPVPRVKLGTQGLVVSKLGFGCMGLTGTYNAPLGDEAVAAVVAHAFRRGITFFDTSDAYGPRTNETLLGKALKQLPREQVQVATKFGIGQGAAGMTVCGTPEYVRACCEASLRRLDAGYIDLYYQHRVDTTVPIEDTIGELKKLVEEGKVKYIGLSEASPDTIRRAHAVHPITAVQMEWSLWSRDIEPEIVPLCRELGIGIVAYSPIGRGFFGGRGVTQQVSSESSLQRHPRFTTESLEKNKQIYLKIEDLAKKYQCSPAQLALAWVLHQGDDVVPIPGTTKTKNLDANVDSLKVKLTAEDLKEIGSQIRAKNVAGGRQYNSYAHTSWKYADTPKK

SEQ ID NO: 9255 - protein, 370 aa, Zea mays
  misc_feature (76)..(76): Xaa can be any naturally occurring amino acid
MRRRRMGALHVVGEPRISFRQQPAAVVAKNGGHGAVVEEIHGLIRVYKDGHVERLPAIPAVPCTWGGTAPGRAGRXVARDVVVDPATGVWARLYAPTSAGDGARRPVVVYFHGGGFCVGSAAWSCYHEFLAQLAARAGCAVMSVDYRLAPEHRLPAAFDDGLAAVRWLRHQAAASASASACCNDDLSWWRARCGFDRVFLMGDSAGASIALHVAARLGQGQLGALPPLTVRGPVLIQPFLGGEGRTASEKNVAQPPRSALTLATSDCYWRLALPAGASREHPWCNPLSGRAAPRLETTPLPPLLVCVSETDILRDRNLELCRALREAGKRVEQAVYGGVGHAFQVLHNCHLSQPRTQEMLAHIKAFVSAR

SEQ ID NO: 9256 - protein, 495 aa, Zea mays
  misc_feature (395)..(395): Xaa can be any naturally occurring amino acid
MYEIDFFFSVRRMALTRIGLAGLAVMGQNLALNIAEKGFPISVYNRTTSKVDETVQRAKAEGNLPVYGFHDPASFVKSIQKPRVVIMLVKAGAPVDQTIATLAAHLEQGDCIIDGGNEWYENTERREKAMEERGLLYLGMGVSGGEEGARNGPSLMPGGSFEAYKYVEDIVLKVAAQVPDSGPCVTYIGKGGSGNFVKMVHNGIEYGDMQLISEAYDVLKSVGKLTNSELHQVFSEWNKGELLSFLIEITADIFGIKDEHGDGYLVDKVLDKTGMKGTGKWTVQQAAELSVAAPTIEASLDSRFLSGLKDERVEASKIFQGDYYSTGSPVDKAQLVEDVRQALYASKICSYAQGMNIIKAKSAEKGWGLNLGELARIWKGGCIIRAIFLDRIKKXAYDRNPGLASLLVDPEFAQEIMDRQAAWRRVVCLAINNGVSTPGMSASLAYFDSYRRDRLPANLVQAQRDYFGAHTYERVDMPGSFHTEWFKIARNISNN

SEQ ID NO: 9257 - protein, 635 aa, Zea mays
MSGAIGGAEVHGFRGAAAQLPRSRVLGRPIRVAPPAAARPGGASAGSIRAVSAPAKKDASEVKRSKVEIIKEKSNFLRYPLNEELVSEAPNINESAVQLIKFHGSYQQTDRDVRGQKNYSFMLRTKNPCGKVPNQLYLAMDTLADEFGIGTLRLTTRQTFQLHGVLKKNLKTVLSTVIKNMGSTLGACGDLNRNVLAPAAPYVKKDILFAQQTAENIAALLTPQSGAYYDLWVDGEKIMSAEEPPEVTKARNDNSHGTNFPDSPEPIYGTQYLPRKFKVAVTAAGDNSVDILTNDIGVVVVSDDAGEPIGFNIYVGGGMGRTHRVETTFPRLADPLGYVPKEDILYAIKAIVVTQRENGRRDDRKYSRMKYMIDRWGIDRFRAEVEKYYGKKFESFRPLPEWQFNSYLGWQEQGDGKLFYGVHVDNGRVGGQAKKTLREIIEKYNLDVSITPNQNLILCGIDQAWREPITTALAQAGLLEPKDVDPLNLTAMACPALPLCPLAQTEAERGILPILKRIRAVFNKVGIKDSESVVVRITGCPNGCARPYMAELGFVGDGPKSYQIWLGGTPNQSTLAESFMDKVKLDDIEKVLEPLFTYWNGTRQEGESFGSFTNRTGFDKLKEVVNKWAESPSAA

SEQ ID NO: 9258 - protein, 301 aa, Zea mays
  misc_feature (12)..(12): Xaa can be any naturally occurring amino acid
  misc_feature (252)..(252): Xaa can be any naturally occurring amino acid
MMLAILARRRAXEAVLRRPQAAAGAAVSAWRAYAAAGEESDVVVVGGGPGGYVAAIKAAQLGLKTTCIEKRGTLGGTCLNVGCIPSKALLHSSHMYHEAKSSFAHHGVKFSNLEVDLPGMMAQKDKAVAGLTKGIEGLFKKNKVTYVKGFGKLSSPSEVSVDLIDGGSTVVKGKNIIIATGSDVKSLPGITIDEKKVVSSTGALCLSEIPKKLVVIGAGYIGLEMGSVWNRLGSEVTGVEFAPDIVPSMDGXEVRQQFQRMLEKHKVKFMLKTKVVGCDTSGDGVKLTLTLWENPIYFWDW

SEQ ID NO: 9259 - protein, 217 aa, Zea mays
FQLGTPGGEQNILEADVVLVSAGRTPFTSGIGLETLGVETDKAGRILVDKRFMTNVKGVYAIGDAIPGPMLAHKAEKDGVACVEFIAGKEGHVDYDTVPGVVYTHPEVASVGKTEEQVTALGIPYRVGKFPLLANSRAKAIDDAEGVVKVIAEKETDKILGVHIMAPNAGEIIHEAVIALQYGASSEDVARTCHAHPTVSEALKEACLQTFDKAIHI

SEQ ID NO: 9260 - protein, 503 aa, Zea mays
MMLAILARRRAAEAVLRRPQAAAGAAVSAWRAYAAAGEESDVVVVGGGPGGYVAAIKAAQLGLKTTCIEKRGTLGGTCLNVGCIPSKALLHSSHMYHEAKSSFAHHGVKFSNLEVDLPAMMAQKDKAVAGLTKGIEGLFKKNKVTYVKGFGKLSSPSEVSVDLIDGGSTVVKGKNIIIATGSDVKSLPGITIDEKKVVSSTGALCLSEIPKKLVVIGAGYIGLEMGSVWNRLGSEVTVVEFAPDIVPSMDGEVRKQFQRMLEKQKFKFMLKTKVVGCDTSGDGVKLTLEPAAGGEQNILEADVVLVSAGRTPFTSGIGLETLGVETDKAGRILVDKRFMTNVKGVYAIGDAIPGPMLAHKAEEDGVACVEFIAGKEGHVDYDTVPGVVYTHPEVASVGKTEEQVTALGIPYRVGKFPLLANSRAKAIDDAEGVVKVIAEKETDKILGVHIMAPNAGEIIHEAVIALQYGASSEDVARTCHAHPTVSEALKEACLQTFNKAIHI

SEQ ID NO: 9261 - protein, 480 aa, Zea mays
MALTRIGLAGLAVMGQNLALNIAEKGFPISVYNRTTSKVDETVQRAKVEGNLPVFGFHDPASFVSSIQKPRVVIMLVKAGAPVDQTIATLAAHLDQGDCIVDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLIAEAYDVLKSVGKLTNSELHQVFSEWNKGELLSFLIEITADIFGIKDDKGEGYLVDKVLDKTGMKGTGKWTVQQAAELSVAAPTIEASLDSRFLSGLKDERVEASKIFQGDYSTGLPVDKAQLIEDVRQALYASKICSYAQGMNIIKAKSSEKGWGLNLGELARIWKGGCIIRAIFLDRIKKAYDRNPNLANLLVDPEFAQEIIDRQAAWRRVVCLAINNGVSTPGMSASLAYFDSYRRDRLPANLVQAQRDYFGAHTYERVDMPGSFHTEWFKIARNSKI

SEQ ID NO: 9262 - protein, 491 aa, Zea mays
MALTRIGLAGLAVMGQNLALNIAEKGFPISVYNRTTSKVDETVQRAKVEGNLPVFGFHDPASFVSSIQKPRVVIMLVKAGAPVDQTIATLAAHLDQGDCIVDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLIAEAYDVLKSVGKLTNSELHQVFSEWNKGELLSFLIEITADIFGIKDDKGEGYLVDKVLDKTGMKGTGKWTVQQAAELSVAAPTIEASLDSRFLSGLKDERVEASKIFQGDYSTGLPVDKAQLIEDVRQALYASKICSYAQGMNIIKAKSSEKGWGLNLGELARIWKGGCIIRAIFLDRIKKAYDRNPNLANLLVDPEFAQEIIDRQAAWRRVVCLAINNGVSTPGMSASLAYFDSYRRDRLPANLVQAQRDYFGAHTYERRLLRRSHVTKRFDMPGSFHTEWFKIARNSKI

SEQ ID NO: 9263 - protein, 267 aa, Zea mays
MATLSSCSRLSSGTGAAAIHRQPARAGAVLVVTCRRSSSATVRAAAAATAAAPAAVELQNKGVSLPTWAEFELGRAPVYWKTSSGLPPSPGEGLTLFYNPAATKMAPNEVFGVAFNGGFNQPIMCGGEPRQMTLQERGKADPPIYTIRIRVPQHAVSLIFSFTNGAEWDGPYTLKFRVPKPWQNKPLSFFNEGLADELNREGACDLAIYPDENIAITSCAMDGYLEEGGDRCKLDIVSGCTDPSSDMFDPLATVDDGSCPLESDSEE

SEQ ID NO: 9264 - protein, 248 aa, Zea mays
  misc_feature (40)..(40): Xaa can be any naturally occurring amino acid
  misc_feature (105)..(105): Xaa can be any naturally occurring amino acid
MAANLEDVPSLDLMHELLRRMKCSSKPDKHLILIGCVLPXGPPGSGKGTQSPLIKDEYCLCHLATGDMLRAAVAAKTTLGIKAKEAMDKGELVSDNLVVGIIDEXAMKKPSCQKGFILDGFPRTVTQAQKLDEMLAKQGANVDKVLNFAIDDAILEERITGRWIHPPSGRTYHTKFAPPKSPGVDDVTGEPLIQRRDDTAEVLKSRLEAFHKQTEPVIDYYSKKGLVVNLPAEKPPKEVTAEVLKALS

SEQ ID NO: 9265 - protein, 379 aa, Zea mays
MATAGKVIKCRAAVAWEAGKPLSIEEVEVAPPQAMEVRIKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNINAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 9266 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSVMRAALECCHKGWGTSVIVGVAASGQEIATRPFQLVTGRVWKGTAFGGFKSRTQVPWLVDKYMKKEIKVDEYITHNMNLADINDAFHLLHEGGCLRCVLAMQI

SEQ ID NO: 9267 - protein, 381 aa, Zea mays
MASPTQGQVITCKAAVAYEPNKPLVIEDVQVAPPQAGEVRVKILFTALCHTDHYTWSGKDPEGLFPCILGHEAAGIVESVGEGVTDVQPGDHVIPCYQAECKECKFCKSGKTNLCGKVRSATGVGVMMNDMKSRFSVNGKPIYHFMGTSTFSQYTVVHDVSVAKINPQAPLDKVCLLGCGVPTGLGAVWNTAKVESGSVVAVFGLGTVGLAVAEGAKAAGASRVIGIDIDNKKFDVAKNFGVTEFVNPKEHDKPIQQVLVDLTDGGVDYSFECIGNVSIMRAALECSDKGWGTSVIVGVAASGQEISTRPFQLVTGRVWKGTAFGGFKSRTQVPWLVDKYMKKEIKVDEYITHNMNLADINDAFHLLHEGGCLRCVLAMQI

SEQ ID NO: 9268 - protein, 274 aa, Zea mays
MATPSSSLCSSFASLRTASIGHPRGIASSTPRKAFHVRASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQIKSLGAKAGVVLNPATPLTAIDYVLDVVDLVLIMSVNPGFGGQSFIESQVKKIAELRRLCAEKGVNPWIEVDGGVGPKNAYKVIEAGANAIVAGSAVFGAPDYAEAIKGIKTSQRPLAVAA

SEQ ID NO: 9269 - protein, 495 aa, Zea mays
  misc_feature (184)..(184): Xaa can be any naturally occurring amino acid
MARKMLIDGEVAAVADGGHYDYDLFVIGAGSGGVRGSRTAASFGAKVAICELPFHPISSEWLGGHGGTCVIRGCVPKKILVYGASFRGEFEDSKNFGWEINGDINFNWKTLLENKTKEIVRLNGVYQRILTSAGVTMIEGAGSLVDAHTVEVSQPDGSKQRYTAKHILIATGSRAQRVNIPGKXLAITSDEALSLEELPKRAVILGGGYIAVEFASIWRGMGAEVDLFYRRDLPLRGFDDEMRAIVASNLEGRGIKLHPGTNLSELSKTADGIKVVTDKGEELIADVVLFATGRTPNSQRLNLQAAGVEIDRVGAIKVDEYSRTSAPSVWAVGDVTNRINLTPVALMEATCFAKTVFGGQQVKPDHRDVPCAVFSIPPLSVVGLSEEQALEEANGDILVFISSFNPMKNSISKRQEKTIMKLVVDAETDKVLGASMCGPDAPEIIQGIAIAVKCGATKADFDSTVGIHPSAAEEFVTMRTVTRRLSPTSKPKTNL

SEQ ID NO: 9270 - protein, 332 aa, Zea mays
MMGGFLSRVLLLAFGYAYPAYECYKTVELNKPEIAQLIFWCQYWILVALLTVLERFGDFTISWLPFYSEAKLMFFVYLWYPKTKGTTYVYGTFFKPYISQHENEIDRNLLELRARATDTVVLYFQKAALAGQSTFFDVLKYVVAQSPSQKSRQRLHQESQQPPQQQQPQVQVQQAQPQKQAAPVMRRASSIAARQAAMAQQSQETKPVSSSPKIKRQTSARSGSVASTKPPVAASALKPGGSPKKGEVKPAADPVQTPTTGADSPKPEPSVPSLPGAEGVDKMAIDEASGDAPEGAEELDPALEEETPMEETIRVTRAKLRRRTTTEDPAGN

SEQ ID NO: 9271 - protein, 270 aa, Zea mays
  misc_feature (49)..(49): Xaa can be any naturally occurring amino acid
  misc_feature (209)..(209): Xaa can be any naturally occurring amino acid
MFFLQWFLQVSPIEYGHVLLIPRVLDRLPQRIDPESFLLALQMAAEGGXPFFRLGYNSLGAFATINHLHFQAYYLSVPFPVEKAATHKIPLSEDTKKNGVTVSKLINYPVRGLVFEGGNTLDDLATVVSNACIWLQDNNVPYNVLISDCGKRVFLFPQCYAEKQALGEVSQELLDTQVNPAVWEISGHMVLKRRMDYEEAPETSAWKLXLAEVSLSEERFEEVKAYIFSAAGLVQYDEEEEEASDGEGPTTYVPVKVTPLPVAEGCLVLP

SEQ ID NO: 9272 - protein, 107 aa, Zea mays
  misc_feature (60)..(60): Xaa can be any naturally occurring amino acid
  misc_feature (68)..(68): Xaa can be any naturally occurring amino acid
LAATDGCGRVGGLAFHPLDGILQAMPHVLALFLFPTHFRTHIALVFLEGVWTTNIHDWPXLAVNAVAXRGYHTIHHTTYRHSYGHYTVWMDWMFGTLREPDDILKKA

SEQ ID NO: 9273 - protein, 212 aa, Zea mays
  misc_feature (121)..(121): Xaa can be any naturally occurring amino acid
  misc_feature (137)..(137): Xaa can be any naturally occurring amino acid
MLLNQQTLHQTLTAVAAKPAFTAEGSHTLTNPSKFLNKPQYNEASLVGKTSTDSDPKRWPSASGTTVSHVSDIVGPDGLVYAVEFSHRSGRDLVNMAKKRTNVIPIIDEARHSARYLMLAXMVDVILKSSHSASPSXVGIFKIFICSNCSYIYKTNYIDFTLPAEAVFAAEVEKLKADQFKPAEQVTLEPYERDHACVVGGYRVPKKQKATS

SEQ ID NO: 9274 - protein, 278 aa, Zea mays
  misc_feature (64)..(64): Xaa can be any naturally occurring amino acid
  misc_feature (88)..(88): Xaa can be any naturally occurring amino acid
  misc_feature (172)..(172): Xaa can be any naturally occurring amino acid
  misc_feature (194)..(194): Xaa can be any naturally occurring amino acid
RRERGQGRERWQDPQQAAVAAVAGVARGGGMKGGSKAVVVAHKHAGVFISKSKEDALCTKNMVXGESVYGEKRVSVQNEDGTKVEYRXVWNPFRSKLAAAVLGGVDNIWIAPGTRVLYLGAASGTTVSHVSDIVGPDGLVYAVEFSHRSGRDLVNMAKKRTNVIPIIEDAQXIPARYRMLVGMVDVIFSDVAQXPDQARILALNASYFLKNGGHFVISIKANCIDSTLPAEAVFAAEVEKLKADQFKPAEQVTLEPYERDHACVVGGYRVPKKQKATS

SEQ ID NO: 9275 - protein, 318 aa, Zea mays
MEAEAAAKRTRDSGEDAAAAGISAVIPGWFSEISPMWPGEAHSLKVDKVLFQGKSDYQNVMVFQSSTYGKVLVLDGVIQVTERDECAYQEMITHLPLCSIKDPKKVLVIGGGDGGVLREVSRHSSVEQIDICEIDKMVVDVSKQFFPHLAVGFEDPRVSLHIGDGVAFLKNAPEGTYDAVIVDSSDPIGPAQELFEKPFFQLVARALRPGGVVCTQAESIWLHMHIIEDIVVNCRQVFKGSVNYAWTTVPTYPSGVIGFMLCSTEGPAVDFQHPVFNIEEDEHPMKSKGPLKFYNSEIHTASFCLPSFAKRVIESKAN

SEQ ID NO: 9276 - protein, 320 aa, Zea mays
MAAAAKSVCVTGAGGFIASWLVKLLLSRGQYVVRGTVRDPGASKNAHLKELERAGERLQLLQADLLDYSSVASAIAGCEGVFHVACPVPSGRSSNPEVEVIGPAVVGTTNVLKACYEAKVKRVVVVSSVSAVFSNPNWPKDKVFDEDSWSDEDYCRKNEDWYYLSKTLSEREAFAFAAKSGLDVVTICPSLVFGPLMQSIVNTSSKVLLNYFKGDRETVENRLRNMVDVRDVADALVLAYENPEASGRYICSSHPLKVSDMINILKTLYPSYPYPKHFVETDGNITCSSEKLQKLGWTFRAIEETLRDSVESYKAFGILN

SEQ ID NO: 9277 - protein, 319 aa, Zea mays
MDPVRKSVCVTGAGGFVASELVKLLLSRGQYAVRGTVRDPGASKNAHLKVLEGAEERLQLLKADLMDYDSIASAVAGCEGVFHVASPVLSHRPSNPEVEVIAPAVIGTTNVLKACYEAKVRRVVVVSSCGAVYANPIYPKGKVFDEDCWSDEDYCRKKEDWYLVSKTLSEREALAFAAKTGLDVVTVCPSLVFGPLMQPTVNLSSEMILKYFKDLETVENVLSNMVDIRDVADALLLTYEKPEASGRYICSSHAIKISDMINILKTMYPSYPYPKNFVEDDVNSVYSSEKLQKLGWSFKPIEESLRDTVESYKAFGILN

SEQ ID NO: 9278 - protein, 523 aa, Zea mays
  misc_feature (122)..(122): Xaa can be any naturally occurring amino acid
MAGGGVAALGVKTERAAQYKGRMTLAVATTCLVAAVGGAIFGYDIGISGGVTSMDPFLEKFFPVVFHRKNSGGKNNYCKYDNQGLAAFTSSLYLAGLVASLVASPVTRNYGRKASIVCGGVXFLIGAALNVAAVNLAMLILGRIMLGVGIGFGNQAVPLYLSEMAPAHLRGGLNMMFQLATTLGIFTANLINYGTQNIKPWGWRLSLGLAAVPALLMTLGGLFLPETPNSLIERGRVEEGRRVLERIRGTADVDAEFTDMVEASELANTVEHPFRNILQPRNRPQLVMAVCMPAFQILTGINSILFYAPVLFQSMGFGGNASLYSSVLTGAVLFSSTLISIGIVDRLGRRKLLISGGIQMIVCQVIVAVILGVKFGAEKQLARSYSVAVVVVICLFVLAFGWSWGPLGWTVPSEIFPLETRSAGQSITVAVNLLFTFAIAQAFLSLLCAFKFGIFLFFAGWITVMTVFVYVFLPETKGVPIEEMVLLWRKHWFWKKVMPDMPLEDGWGAAEGHAAPASNNHKG

SEQ ID NO: 9279 - protein, 357 aa, Zea mays
MEGGAGASEKGTVLVTGASGFVGSWLVMKLLQAGYTVRATVRDPANVGKTKPLMDLPGATERLSIWKADLAEEGSFHDAIRGCTGVFHVATPMDFLSKDPENEVIKPTVEGMISIMRACKEAGTVRRIVFTSSAGTVNLEERQRPVYDEESWTDVDFCRRVKMTGWMYFVSKTLAEKAALAYAAEHGLDLVTIIPTLVVGPFISASMPPSLITALALITGNAPHYSILKQVQLIHLDDLCDAEIFLFENPAAAGRYVCSSHDVTIHGLAAMLRDRYPEYDVPQRFPGIQDDLQPVRFSSKKLQDLGFTFRYKTLEDMFDAAIRTCQEKGLIPLATAAGGDGFASVRAPGETEATIGA

SEQ ID NO: 9280 - protein, 577 aa, Zea mays
KAFFPPSRIAPSLSLRSSRRRRVRPPNPNGVRGRSSNLPLPRGPAATRAAAAAAAPLRRGGLATAGQPPWSRAFAAGATSPWATPPFGAARRAPASTEGVADAPPTSLSLAARAATRAAAAAAAPLRRGGLATACQPARSLAFAAGDARLAVHVASRCRQAFSGRGTRAMATMAKKSVGELTEADLEGKRVFVRADLNVPLDENQNITDDTRIRAAIPTIQYILSKGAKVILSSHLGRPKGFTPKFSLAPLVGRLSELLGIQVQKADDVIGPEVEKLVAALPNGGVLLLENVRFYKEEEKNDPEFAQKLASLADLYVNDAFGTAHRAHASTEGVTKFLQPSVAGFLLQKELDYLVGAVSSPKRPFAAIVGGSKVSSKIGVIESLLEKCDILLLGGGMIFTFYKAQGLPVGASLVEEDKLELATSLLAKAKEKGVSLMLPTDVVIADKFAPDANSQIVPASAIPDGWMGLDIGPDSVASFNAALDTTKTVIWNGPMGVFEFDKFAVGTEAVAKKLAELSGKGVTTIIGGGDSVAAVEKVGVADVMSHISTGGGASLELLEGKELPGVVALNEAATVTV

SEQ ID NO: 9281 - protein, 274 aa, Zea mays
  misc_feature (149)..(149): Xaa can be any naturally occurring amino acid
  misc_feature (182)..(182): Xaa can be any naturally occurring amino acid
  misc_feature (191)..(191): Xaa can be any naturally occurring amino acid
QKLASVADLYVNDAFGTAHRAHASTEGVTKFLKPSVAGFLLQKELDYLVGAVSSPTRPFAAIVGGSKVSSKIGVIESLLEKCDILLLGGGMIFTFYKAQGLSVGASLVEEDKLDLATSLLAKAKEKGVSLMLPTDVVIADKFAPDANSXQIVPASAIPDGWMGLDIGPDSIAAFNAALETTXQTVIWNGPXMGVFEYDKFAIGTEAVAKKLAELSRKGVTTIIGGGDSVAAVEKVGVADVMSHISTGGGASLELLEGKELPGVTALDEAATVTV

SEQ ID NO: 9282 - protein, 473 aa, Zea mays
TARSWTAATSPSTRPSPAAAPLRRGGLAAARQPARSLAFAAGDARLAVHVASRCRQAFSGRGTRAMATMAKKSVGELTEADLEGKRVFVRADLNVPLDENQNITDDTRIRAAIPTIQYILSKGAKVILSSHLGRPKGFTPKFSLAPLVGRLSELLGIQVQKADDVIGPEVEKLVAALPNGGVLLLENVRFYKEEEKNDPEFAQKLASLADLYVNDAFGTAHRAHASTEGVTKFLQPSVAGFLLQKELDYLVGAVSSPKRPFAAIVGGSKVSSKIGVIESLLEKCDILLLGGGMIFTFYKAQGLPVGASLVEEDKLELATSLLAKAKEKGVSLMLPTDVVIADKFAPDANSQIVPASAIPDGWMGLDIGPDSVASFNAALDTTKTVIWNGPMGVFEFDKFAVGTEAVAKKLAELSGKGVTTIIGGGDSVAAVEKVGVADVMSHISTGGGASLELLEGKELPGVVALNEAATVTV

SEQ ID NO: 9283 - protein, 406 aa, Zea mays
  misc_feature (159)..(159): Xaa can be any naturally occurring amino acid
MARKKIREYDSKRLLREHLKRLAGIDLTILSAQITQSTDFAELVSQQPWLSTMKLVVKPDMLFGKRGKSGLVALNLDFDQVKEFVKERLGVEVEMGGCKAPITTFIVEPFVPHDQEYYLSIVSERLGSTISFSECGGIEIEENWDKVKTIFLPTEKPTXATTSDSCAPLIATLPLEARGKIGDFIKGVFAVFQDLDFSFLEMNPFTMVNGEPYPLDMRGELDDTAAFKNFKKWGGIEFPLPFGRVLSPTESFIHELDEKTSASLKFTVLNPKGRIWTMVAGGGASVIYADTVGDLGYASELGNYAEYSGAPNEEEVLNYSRVVLDCATADPDGRKRALLIGGGIANFTDVATTFNGIIRALREKESKLKASRMHIYVRRGGPNYQSGLAKMRKLGAELGVPIEVLI

SEQ ID NO: 9284 - protein, 423 aa, Zea mays
MARKKIREYDSKRLLREHLKRLAGIDLTILSAQITQSTDFAELVSQQPWLSTMKLVVKPDMLFGKRGKSGLVALNLDFDQVKEFVKERLGVEVEMGGCKAPITTFIVEPFVPHDQEYYLSIVSERLGSTISFSECGGIEIEENWDKVKTIFLPTEKPMTSDSCAPLIATLPLEARGKIGDFIKGVFAVFLDLDFSFLEMNPFTMVNGEPYPLDMRGELDDTAAFKNFKKWGGIEFPLPFGRVLSPTESFIHELDEKTSASLKFTVLNPKGRIWTMVAGGGASVIYADTVGDLGYASELGNYAEYSGAPNEEEVLNYSRVVLDCATADPDGRKRALLIGGGIANFTDVATTFNGIIRALREKESKLKASRMHIYVRRGGPNYQSGLAKMRKLGAELGVPIEVYGPEATMTGICKQAIECIMAAA

SEQ ID NO: 9285 - protein, 383 aa, Zea mays
  misc_feature (106)..(106): Xaa can be any naturally occurring amino acid
  misc_feature (257)..(257): Xaa can be any naturally occurring amino acid
  misc_feature (306)..(306): Xaa can be any naturally occurring amino acid
  misc_feature (348)..(348): Xaa can be any naturally occurring amino acid
PAGGFCSPWLRIRIPPTTSIPFPSLPSCPAGSPARRLCPDPGDMPRYDDRYGGTRLYVGRLAPRTRSRDLEYLFGKYGRFFGFYREWKFQVGDAFEYLTHEGLLFXGNPFRRIREVELKRDYAFIEFSEHRDADEARYQLDGRDVDGSRIVVEFAKGVPRGPGGSREYMGRGPPPGTGRCFNCGMDGHWARDCKAGDWKNKCYRCGERGHIERNCQNSPRSVRRERSYSRSPSPRRRRDRDDRRSRSLSYSRSPRAXSPPAKEKERSPTPGGSRSPRSRSPQDQVMSPPPKDNGDRNGSDRGDSPXGREDSRSRSRSPSGGNRSPAANGRSPSPRGDRTPSPMADRGXSPMADRSPSPKGNGNNDGGDDDTGRGGSPTGSKSP

SEQ ID NO: 9286 - protein, 344 aa, Zea mays
  misc_feature (16)..(16): Xaa can be any naturally occurring amino acid
WKFQVGDAFEYLTHDXRLTVCGNPLRRIREVELKRDYAFIEFSDHRDADEARYQLDGRDVDGSRIVVEFAKGVPRGSGGSREYMGRGPPPGTGRCFNCGVDGHWARDCKAGDWKNKCYRCGERGHIERNCQNSPRSLRRERSYSRSPSPRRGRGRSRSYSRSRSRSRSYSRSRSLSRSPRGGRRDRDDRRSRSPSYSRSPMRSASPPVKEKERSPAPDGSRSPRSRSPQDQVMSPPPKDNGEGNGSDRGGSPRGRENSRSCSRSRSPSGSNRSPAANGRSRSPGGERSPSPGGERSPSPRGERSPSPRADRSPSPNGNGNNDAAADVDADAAARSGSPTGSKSP

SEQ ID NO: 9287 - protein, 495 aa, Zea mays
  misc_feature (142)..(142): Xaa can be any naturally occurring amino acid
  misc_feature (170)..(170): Xaa can be any naturally occurring amino acid
RRRRRRRRRWRRRKGGMAEETVQELRASFASGRTRGAEWRAEQLKGLIRMIDEKEAEISAALHEDLAKPHMESYLHEISITRSSCKFALDGLKSWMKPEKIPAALTTFPSSAQIVPEPLGVVLIISAWNYPFILSIDPVIGXAIAAGNAVVLKPSEIAPATSSLLAKLLXEYVDNSCIKVVEGGVAETTSLLEQRWDKIFYTGNGTVGRIVMAAAAKHLTPVALELGGKSPVVVDSNVDLHVAVKRIVVGKWGCNNGQACIAPDYIITTKSFAPELVASLKRVLERFYGEDPLQSADLSRIVNSKHFRRLTELIEEKSVADKIVYGGEVDEKQLKIAPTLLLDVPQDSAIMTGEIFGPLLPIVTVEKIEESFDLINARPKPLAAYLFTTNAWVQEEFVADVPAGGMLVNDTVLHLANPYMPFGGVGDSGMGCYHGKFGFDCFSHKKGVLVRGFGGEANARYPPYTTEKQKILRGLINGSFIALILALLGFPREKR

SEQ ID NO: 9288 - protein, 217 aa, Zea mays
MSSDELRLELDELRRLEGLAKRPRVQTLLANEIRNIEAKMAKATEPSPEPLAAASAPTAAARSDLSYATLGSFSWEQDNEKIRIYIPLEGVEQGKVEATFKPTSVDVKFHDVKGKNYRCAIPKLNKETVPDKCKVVVKPTKVIVTLFKASKGNWLDLHFKEDKFKPSMDKEKDPMSGIMDLMKNMYEDGDEDMKRTIAKAWSDARSGKTTDSLSGLR

SEQ ID NO: 9289 - protein, 375 aa, Zea mays
  misc_feature (52)..(52): Xaa can be any naturally occurring amino acid
  misc_feature (276)..(276): Xaa can be any naturally occurring amino acid
MALLKAARRRRCAHPGRGGGPRPGWRLPRRGAPRLWGGRFSVIGHRGQGDEXLASEDPRLRDVRENTVRSFNDAGRFPVDYVEFDVTKDGCPIIFHDNFIFTQDDGKISQKRVADIQLEDFLQYGLQNEQGKVGKPLLRRLKDGRMVNWDVQSEDALCTLEEAFDKVNPRLGFNVELKFDDSLEYTEEELTRILQAILKVVFEYAKDRPILFSSFQPDAAQLMRKLQGTYPVYFLTNGGTELYADVRRNSLEEAVKLCLAGGLQGIVSEARGIFRXPAAVPKIKEANLSLLTYGTLNNVPEAVYMQHLMGVNGVIVDLVPEITEAVSELIALPLPEPDLEVGSLSNQAAARGATTPNFSQREISFLLRLIPELVQ

SEQ ID NO: 9290 - protein, 218 aa, Zea mays
MAAGAGARARAKAAGALALALVLALAGANSEGDALSALRRSLRDPGGVLQSWDPTLVNPCTWFHVTCDRDNRVTRLDLGNLNLSGHLVPELGKLEHLQYLELYKNSIQGTIPSELGNLKNLISLDLYKNNISGTIPPSLGKLKSLVFLRLNGNHLTGPIPRELSGISSLKVVDVSSNDLCGTIPTSGPFEHIPLSNFEKNPRLEGPELQGLAIYDTNC

SEQ ID NO: 9291 - protein, 361 aa, Zea mays
MPCVSFRKRLSTLPLSLAFHSIPAGVRGPSTQRTTRWGICSTPTPLPLAPTPTASPPAAATRHDATRDAERYKRWTGWVAGSVVQLLPLPQHQRRTGQAEKKQTRRDLSRSVLLPAPAAVPLLPQFSRPLLPSVRVQIPPPTDPAPSSMAGAGAKAAGALALALVLALAGANSEGDALSALRRSLRDPGGVLQSWDPTLVNPCTWFHVTCDRDNRVTRLDLGNLNLSGHLVPELGKLEHLQYLELYKNNIQGTIPSELGNLKNLISFDLYKNNISGTIPPALGKLKSLVFLRLNGNHLTGPIPRELAGISSLKVVDVSSNDLCGTIPTSGPFEHIPLSNFEKNPRLEGPELQGLAIYDTNC

SEQ ID NO: 9292 - protein, 274 aa, Zea mays
  misc_feature (155)..(155): Xaa can be any naturally occurring amino acid
MAGAAVETAAAAAAANGKACCHAAKGPGYATPLEAMEKGPREKLVYVTCVYNGTGINKPDYLATVDLDPSSPTYSQVIHRLPVTHIGDELHHSGWNSCSSCHGDPSAKRRFLILPSLLSGRVYVVDTATDPRAPSLHKVVESEDIAENTGLGFPXHTSHCLASGDIMISCLGDKEGNAAGNGFLLLDSEFNVKGRWEKPGHSPLFGYDFWYQPRHKTMISSSWGAPAAFRTGFDLQHVQDGLYGRHLHVYDWPGGELKQTLDLGDTGLLPLEVI

SEQ ID NO: 9293 - protein, 498 aa, Zea mays
  misc_feature (153)..(153): Xaa can be any naturally occurring amino acid
  misc_feature (255)..(255): Xaa can be any naturally occurring amino acid
  misc_feature (305)..(305): Xaa can be any naturally occurring amino acid
  misc_feature (318)..(318): Xaa can be any naturally occurring amino acid
  misc_feature (488)..(488): Xaa can be any naturally occurring amino acid
MAGAAAVEAAAAAAVAANGKACCHAAKGPGYATPLEAMEKGPREKLVYVTCVYNGTGINKPDYLATVDLDPSSPTYSQVIHRLPVTHIGDELHHSGWNSCSSCHGDPSAKRRFLILPSLLSGRVYVVDTATNPRAPSLHKVVESEDIAENTGXLGFPHTSHWLASGDIMISCLGDKEGDAAGNGFLLVDSEFNVKGRWEKPGHSPLFGYDFWYQPRHKTMISSSWGAPAAFRTGFDLQHVQDGLYGRHLHVYDWXPGGELKQTLDLGDTGLLPLEVRFLHDPSKDTGYVGCALTSNMVRFFKTRXMGSWSHEVAISVXPLKVRNWILPEMPGLITDFVISLDDRYLYFVNWLHGDIRQYNIEDPAKPFLAGQVWVGGLLQKGSDVVYVTDDGQEQQYNVPQVKGHRLRGGPQMIQLSLDGKRIYVTNSLFSRWDEQFFGDDLVKKGSHMLQIDVDTEKGGLAVNPNFFVDFGTEPDGPALAHEMRYPXGGDCTSDIWI

SEQ ID NO: 9294 - protein, 550 aa, Zea mays
  misc_feature (115)..(115): Xaa can be any naturally occurring amino acid
MARRAASSLVSRCLLARAPAGAPPAAPSAPRRTVPADGMHRLLPGVLQRFSTAAAVEEPITPSVHVNYTKLLINGNFVDSASGKTFPTLDPRTGEVIAHVAEGDAEDINRAVAAXARKAFDEGPWPKMTAYERSRILLRFADLIEKHNDELAALETWDNGKPYEQAAQIEVPMVARLMRYYAGWADKIHGLIVPADGPHHVQILHEPIGVAGQIIPWNFPLLMYAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFNKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGIGREKGVDSLKNYLQVKAVVTPIKNAAWL

SEQ ID NO: 9295 - protein, 450 aa, Zea mays
MRGSMSNYYDDYDDIDEIEDDYDMDDPADDMVDEQRGVRDSDAEDNDYGQPNDKIPDTSSADARNGRDIQGIPWEQLNITRKKYRQSRLEQYKNYENVPNSGEEAMKDCKPTEKGGMYYEFRRNTRSIKSTILHFQLRNLVWATSKHDIYLVSHYSIRHWSALSGVDTELINVQGHVAPREKHAGSLSEGFYQTQVSTLAVKDNLLVAGGFQGELICKHLDREGISFCCRTTYDDNAITNAVEIFNTSSGAVHFIASNNDSGVRYYDMERFQLFKHLQFEWPVNHASLSPDRKTVVIVGDDPDGLLIDANSGKTLHSIKGHRDYSFASAWSPDGRTFATGNQDKTCRIWDARNLSKSVHVLRGNLGAIRSIRFTSDGQFMSMAEPADFVHVYDVKSDYNKRQELDFFGEISGTSFSPDTDALFVGVWDRMYGSLLQFGRLYNYSYLDSVF

SEQ ID NO: 9296 - protein, 160 aa, Zea mays
MDAGAKVVKKAAAGRRGGGGPKKKPVSRSVKAGLQFPVGRIGRYLKQGRYSQRVGTGAPVYLAAVLEYLAAELLELAGNAARDNKKNRIIPRHVLLAIPNDEELGKLLAGVTIAHGGVLPNINPVLLPKKTAVAAAKEGKEKKSPKKAAAAKSPKKVAAS

SEQ ID NO: 9297 - protein, 167 aa, Zea mays
MATPSSSLCSSFASLRTASIGHPRGIASSTPRKAFHVRASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQVISVPPYIYKLMLR

SEQ ID NO: 9298 - protein, 274 aa, Zea mays
MATPSSSLCSSFASLRTASIGHPRGIASSTPRKAFQVRASARVDKFSKSDIIVSPSILSANFAKLGDQVKAVEVAGCDWIHVDVMDGRFVPNITIGPFVVDALRPVTDLPLDVHLMIVEPEQRVPDFIKAGADIVSVHCEQTSTIHLHRTVNQIKSLGAKAGVVLNPATPLTAIDYILDVVDLVLIMSVNPGFGGQSFIESQVRKIAELRRLCAEKGVNPWIEVDGGVGPKNAYKVIEAGANAIVAGSAVFGAPDYAEAIKGIKTSQRPAAVHA

SEQ ID NO: 9299 - protein, 271 aa, Zea mays
MSSLDSGSNGLTGYVTLMSLMEELISLEMKAFHVRASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQIKSLGAKAGVVLNPATPLTAIDYVLDVVDLVLIMSVNPGFGGQSFIESQVKKIAELRRLCAEKGVNPWIEVDGGVGPKNAYKVIEAGANAIVAGSAVFGAPDYAEAIKGIKTSQRPLAVAA

SEQ ID NO: 9300 - protein, 278 aa, Zea mays
  misc_feature (161)..(161): Xaa can be any naturally occurring amino acid
MATPSSSLCSSFASLRTASIGHPRGIASSTPRKAFHVRASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQIKSLDKKXGAKAGVVLNPATPLTAIDYVLDVVDLVLIMSVNPGFGGQSFIESQVKKIAELRRLCAEKGVNPWIEVDGGVGPKNAYKVIEAGANAIVAGSAVFGAPDYAEAIKGIKTSQRPLAVAA

SEQ ID NO: 9301 - protein, 269 aa, Zea mays
FGTRRPLPLRRIRSDPRPPPRPRRNIIRKPSRRGERSPSHTLAPQHPQSAPACLHDLSCSCATLLECGAGARGHLMAAAAEIGGFTAAALRPVAHPAPAAAPRRAVAAQSLRTTATETLTADLAASTTNGVVHAQMYSEASSEIPSQSAIANSRRKTKIVCTIGPSTNTREMIWKLAETGMNVARLNMSHGDHQSHQKVIDLVKEYNAQNTDGNVIAIMLDTKGPEVRSGDVPEPLSSVVYTICVYKRGTSEATAGTLPGGHPYSHAVL

SEQ ID NO: 9302 - protein, 294 aa, Zea mays
FGSRKDAKVIHELKDYLKGVNADIHVIPKIESADSIPNLQSIIAASDGAMVARGDLGAELPIEDVPLLQAEIVQTCRNMEKPVIVATNMLESMIDHPTPTRAEVSDIAIAVREGADAIMLSGETAHGKYPLKAVKVMHTVALRTESSIYNPTTSPSVIASAQGLQNEEFSPSQLSKMFGSHATMMANTLRTPIIVFTQTGSMAVLLSHYRPSSTIFAFTNEERVKLRLALYQGVIPIHMEFSDDAEETFSRAISSLLKAQYVKKGDYVTLVQSGVTSIWREESTHNIQVRRAQV

SEQ ID NO: 9303 - protein, 569 aa, Zea mays
  misc_feature (149)..(149): Xaa can be any naturally occurring amino acid
MAAAAEIGGFAAARVAVATLRPAAHPAPAAAPQQPRRAVAAQSLRTTATEALTADLAGTTNGAVHARMNSKATSEITSQAVTANSRRKTKIVCTIGPSTNTREMIWKLAETGMNVARLNMSHGDHQSHQKVIDLVKEYNAQNTDGNVIXAIMLDTKGPEVRSGDVPEPIMLKEGQEFNFTIKRGVSTEDTVSVNYDDFINDVEAGDILLVDGGMMSLAVKSKTTDTVKCKVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEDVPLLQAEIVQTCRSMEKPVIVATNMLESMIDHPTPTRAEVSDIAIAVREGADAIMLSGETAHGKYPLKAVKVMHTVALRTESSLYNPTTSPSLVASAQGLQNEDFSPSQLSKMFGSHATMMANTLRTPIIVFTQTGSMAVLLSHYRPSSTLFAFTNEERVKQRLALYQGVIPIHMQFSDDAEETFSRAISSLLKAQYVKKGDYVTLVQSGVTSIWREESTHHIQVRKVQV

SEQ ID NO: 9304 - protein, 666 aa, Zea mays
MATPNGLARIETTGKKKQDNGVWYDDSSAPVRAQTIDELHSLQRKRSAPTTPNRSAPTTPIKGGAHSPFAVAISEEERHTQQMQSISASLASLTRETGPKVVKGDPAAKGEAAAQGAPSTPRAHQQHRHPAAPAIAVSDSSLKFTHVLNNLSPAELYEQAIKYEKGSFITSTGALATLSGAKTGRSPRDKRVVKDEVTAQDLWWGKGSPNIEMDEKTFLINRERAVDYLNSLKVVRQRQLLNWDPENRIKVRIISARAYHSLFMHNMCIRPTDEELEDFGTPDFTIYNAGQFPCNRYTHYMTSSTSIDLNLARREMVIMGTQYAGEMKKGLFGVMHYLMPKRGILSLHSGCNMGKDGDVALFFGLSGTGKTTLSTDHNGLLIGDDEHCWSDNGVSNIEGGCYAKCIDLAQEKEPDIWNAIKFGTVLENVVFDEHTREVDYADYSVTENTRAAYPIEYIPIAKIPCVGPHPKNVILLACDAFGVLPPVSKLILAQTMYHFISGYTALVAGTEDGIKEPQATFSACFGAAFIMLHPTKYAAMLAEKMQKYGATGWLVNTGWSGGRYGVGKRIRLPYTRKIIDAIHSGELLTANYQKTEVFGLEIPTEINGVPSEILDPIYTWTDKAAYKENLLRLGGLFKNNFEVFASYKIGDDSSLTDEILAAGPNF

SEQ ID NO: 9305 - protein, 246 aa, Zea mays
MEVVLGSAARRCLASTAVAAARALLHLVPRGRPGLNEHHQFLVRSERSAAAAAIGREERVCRIQQAEEGVSGGPENMSGNGAKKVVDAAVKAGRTIIDWDGMAKLLVTDEARKEFAALRRAFDDVNHQLQTKFSQEPQPIDWEYYRKGIGSKVVDMYKEAFESIEIPKYVDTVTPQYKPKFDAVIAELKEAEKEHQKESERIEKELAEMEEMRKKISTMTADDYFEKYPELRKKFDDEIRNDNWGY

SEQ ID NO: 9306 - protein, 74 aa, Zea mays
  misc_feature (11)..(11): Xaa can be any naturally occurring amino acid
MIEVVLNDRLXGKKVRVKCNEDDTIGDLKKLVAAQTGTRPEKIRIQKWYNIYKDHITLKDYEIHDGMGLELYYN

SEQ ID NO: 9307 - protein, 75 aa, Zea mays
  misc_feature (10)..(10): Xaa can be any naturally occurring amino acid
  misc_feature (39)..(39): Xaa can be any naturally occurring amino acid
MIEVVLNDRXLGKKVRVKCNEDDTIGDLKKLVAAQTGTXRPEKIRIQKWYNIYKDHITLKDYEIHDGMGLELYYN

SEQ ID NO: 9308 - protein, 595 aa, Zea mays
MAAMNGEVLGECGRNINSLKRKRESPAAYAADVFCTSELHQHTVNDSAVRFHLDKDRKAKIVCHFNKQVLQSYKNFMSSAPPKRILLRKGAVWKDFPEKIVKLAQADFRAKKIITETGYQNQLFLLDFAHMTFIDTKTGLQRPIAWIDENGNRYFPESFVQDQKIFMKKDFGNGYHDYISVESNGTREMNDQLGTSESSAESSNFGSSTEDVSSPKRARAENNSIIKKYCDMGEAIGENEPCTLLPTACNLLPRQANLGEVSRAQRTIEAVEKLLLQGMGSVIESKDIIGIYRTPLLDDHGQVRYHNHEKHVQVTRCHRGNANVRYAWLPCSKSTVHEMMLNSSLQVHKPPIKCAAYGEGTFLTPANRSDACVKFSAVDENGIVHMMLCRVIMGNVEIVHPGSKQHQPSSDYFDSGVDDLKNPQHYIVWDMNLNSHIYSEFVVTVKLPSKTKDSFVSQENCQNSSDLSLVLNSSSPDCISQEMNLEAPPALGGGCAAPMLGDSMEKAPSSPWMPFSMLFAAISTKVSPQIMDVVIGCYEEFKSKKISRCELIKELRHVVGDRVLISTIMRLQDKLPPVERREGPGASAAKMVAKP

SEQ ID NO: 9309 - protein, 600 aa, Zea mays
  misc_feature (86)..(86): Xaa can be any naturally occurring amino acid
  misc_feature (91)..(91): Xaa can be any naturally occurring amino acid
  misc_feature (168)..(168): Xaa can be any naturally occurring amino acid
  misc_feature (211)..(211): Xaa can be any naturally occurring amino acid
  misc_feature (235)..(235): Xaa can be any naturally occurring amino acid
MAAMNGEVLGECGRNINSLKRKREGPAAYAAGVFCTSELHQHTVNDSAVRFHVDKDRKAKFVCHLNKQVLHSFNNFMSSAPPKRIXLRIGXVWKDFPEKIVKLAQADFRAKKTITETGYQNQLFLLDFAHMTFIDTKTGLQRPIAWIDENGNRYFPESFVQESENIYXEKDFGNGYHDYISVESNGTREMNDQLATSESSAESTHFGSSTXNMFSSPYTRAIAENNSIIKKYCDXGEKAIGENEPCTLLPTACNLLPRQANLGEVSRAQRTIEAVEKLLLQGMGSVIESKDIIGIYRTPLLDDHGQVRYHNHEKHVQVTRCHRGNANVRYAWLPCSKSTVHEMMLNSSLQVHKPPIKCAAYGEGTFLTPANRSDACVKFSAVDENGIVHMMLCRVIMGNVEIVHPGSKQHQPSSDYFDSGVDDLKNPQHYIVWDMNLNRHIYPEFVVTVKLPSKTKDSFVSQDNCQNSSDLSLVLNSSSPDCISQEMNLEAPPALGGGCAAPMLGDSMEKAPSSPWMPFSMLFAAISTKVSPENMDVIIGCYEEFKSKKISRGELVKKLRHVVGDRVLISTIMRLQDKQLPPVDKREEPDTSASKVVAEP

SEQ ID NO: 9310 - protein, 595 aa, Zea mays
MAAMNGEVLGECGRNINSLKRKRESPAAYAAGVFCTSELHQHTVNDSAVRFHLDKDRKAKIVCHFNKQVLQSYKKFMSSAPPKRILLRQGAVWKDFPEKIVKLAQADFRAKKMITETGYQNQLFLLDFAHMTFIDTKTGFQRPIAWIDENEKCYFPESFIQDQKLFMKKDFGNGNHEYISEERNGTRETNHQFGASESSAESSNFESSIGDVSSPKRARAEKNFIVKKYCDMGEAIGENEPCTLLPTACNLLPHQANLGEVSRAQRTIEAVEKLLLQGMGSVIESKDIIGIYRTPLLDDHGQVRYHIHQKQVQVTGCHRGNANVRYAWLPCSKSTVHVMMLNGVWQVDKPPNKCAAYGEGTLLTPANRSDACVKYSDVDENGIVRMMLCRVIMGNVEIVHPGSKQCQPSNKYFDSGVDDLKNPRHYVVWDMNLNSHIYSEFVVTVKLPSKTKDSFVSQENCQNSSDLSLVLNSSSPDCISQEMNLEAPPALGGGCAAPMLGDSMEKAPSSPWMPFSMLFAAISTKVSPENMDVIIGCYEEFKSKKISRGELVKKLRHVVGDRVLISTIMRLQDKLPPVDKREEPDTSASKVVAEP

SEQ ID NO: 9311 - protein, 206 aa, Zea mays
PVGGAEAAAVDGLGGAGAADAAPAGEAAAARVRPVETLLRAAPLGLCVAAMTVMLRDQQSNEYGTVAYSDLGGFKYLVYANGLCAAYSLVSAFYTAVPRPATVSRSWVVFLLDQVFTYLILAAGAAAAELLYLAYNGDKEVTWSEACGVFGSFCRQARTSVAITFGTVLCFILLSLISSYRLFSAYEAPPSSALGSKGVEIAAYPR

SEQ ID NO: 9312 - protein, 210 aa, Zea mays
  misc_feature (173)..(173): Xaa can be any naturally occurring amino acid
  misc_feature (192)..(192): Xaa can be any naturally occurring amino acid
MSKTAGVGRLGGAGAADAAQQQQLAAGDAAVARAARPIETLLRAAPLVLCVAAMTLMLRDQQSNEYGTVAYSDLGGFKYLVYANGLCAAYSLASAFYTAVPRPATVSRSWVVFLLDQVFTYLILAAGAAAAELLYLAYNGDKEVTWSEACGVFGSFCRQARTSVAITFGAVAXCFILLSLLSSYRLFSAYEXPPPSALGSKGVEIAAYPR

SEQ ID NO: 9313 - protein, 456 aa, Zea mays
  misc_feature (414)..(414): Xaa can be any naturally occurring amino acid
MSYHCRVLVPVPFHHPPATDLSGEAATVMSYHCRVLVPVPFHYPPGAGARVGAGAGSPFPSASRALRLPRPRASVEKREQVAAMEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFVGSCRSCDSCGKGDDNYCAGIVLTSNGVDHAHGGAPTRGGFSDVLVASEHYVVRVPDGLALDRTAPLLCAGVTVYSPMMRHGLNEPGKHLGVVGLGGLGHVAVKFGKAFGMKVTVISTSASKRQEAIENLGADEFLISRDEDQMKAATGTMDGIIDTVSAWHPITPLLALLKPLGQMVVVGAPSKPLELPAYAIVPGGKGVAGNNVGSVRDCQAMLEFAGKHGIGAEVEVIKMDYXQHGHGAAREERRPLPLRHRRRRQPRLCRLGMAAKVSIRAQPQ

SEQ ID NO: 9314 - protein, 428 aa, Zea mays
  misc_feature (386)..(386): Xaa can be any naturally occurring amino acid
MSYHCRVLVPVPFHYPPGAGARVGAGAGSPFPSASRALRLPRPRASVEKREQVAAMEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFVGSCRSCDSCGKGDDNYCAGIVLTSNGVDHAHGGAPTRGGFSDVLVASEHYVVRVPDGLALDRTAPLLCAGVTVYSPMMRHGLNEPGKHLGVVGLGGLGHVAVKFGKAFGMKVTVISTSASKRQEAIENLGADEFLISRDKDQMKAATGTMDGIIDTVSAWHPITPLLALLKPLGQMVVVGAPSKPLELPAYAIVPGGKGVAGNNVGSVRDCQAMLEFAGKHGIGAEVEVIKMDYXQHGHGAAREERRPLPLRHRRRRQPRLCRLGMAAKVSIRAQPQ

SEQ ID NO: 9315 - protein, 275 aa, Zea mays
MYKQGGAGVGAGLDRKRISDALDKHLEKAVASPSTSRGSAGGGGVRDHHRLIVPSSVSSIPKGRCSEGESDSDSEASDVSGSDGEDTSWISWYCNLRGNEFFCEVDDDYIQDDFNLCGLSSQVPYYDYALDLILDIESSHGDMFTEEQNELVESAAEMLYGLIHARYILTSKGLAAMLEKYRNYDFGRCPRVYCCGQPCLPVGQSDIHRSSTVKIYCPKCEDIYYPRSKYQGNIDGAYFGTTFPHLFLMTYEHLKLQKPLQRYVPRVFGFKLHKP

SEQ ID NO: 9316 - protein, 283 aa, Zea mays
  misc_feature (12)..(12): Xaa can be any naturally occurring amino acid
  misc_feature (143)..(143): Xaa can be any naturally occurring amino acid
  misc_feature (176)..(176): Xaa can be any naturally occurring amino acid
  misc_feature (181)..(181): Xaa can be any naturally occurring amino acid
  misc_feature (196)..(196): Xaa can be any naturally occurring amino acid
  misc_feature (251)..(251): Xaa can be any naturally occurring amino acid
MYKQGGAGGGAXGLDRKRINDALDKHLEKGGRVAVHGRGGPAGGGRDHHRLVVPSSVSSIPKGRCSEGESDSDSEASDVSGSDGEDTSWISWYCNLRGNEFFCEVDDDYIQDDFNLCGLSSQVPYYDYALDLILDIESSHVMXCVGDMFTEEQNELVESAAEMLYGLIHARYILTXSKGLXAAMLEKYKNYDFGRXPRVYCCGQPCLPVGQSDIHRSSTVKIYCPKCEDIYYPRSKYQGNIDGAYFGTTFXPHLFLMTYEHLKPQKLSQRYVPRVFGFKLHKP

SEQ ID NO: 9317 - protein, 460 aa, Zea mays
  misc_feature (27)..(27): Xaa can be any naturally occurring amino acid
  misc_feature (79)..(79): Xaa can be any naturally occurring amino acid
  misc_feature (205)..(205): Xaa can be any naturally occurring amino acid
  misc_feature (285)..(285): Xaa can be any naturally occurring amino acid
  misc_feature (320)..(320): Xaa can be any naturally occurring amino acid
  misc_feature (337)..(337): Xaa can be any naturally occurring amino acid
  misc_feature (360)..(360): Xaa can be any naturally occurring amino acid
CRSTPCARTATRSTGARAVEASLAALXAPGVEGIMVDVWWGIAEADGPGQYNFNGYMELMEMAKKTGLKVQAVMSFHQXCGGNVGDSVTIPLPGWVLEEMDKDQDLAYTDRSGRRNYEYVSLGCDAMPVLKGRTPIQCYADFMRAFRDHFATFMGNTIVEIQVGMGPAGELRYPSYPESDGTWSFPGIGEFQCYDRFMLSSLKAXAEAVGKPEWGNAGPGDSGSYKDWPEDTGFFRREGGWSTEYGEFFMSWYSQMLLEHGERILSAATGVFTGSPGVKISVKVXGIHWHYGTRSHAAELTAGYYNTRSHDGYAPIARMXARHGAVLNFTCVEMRDXEQPQDAQCRPEALVQQVAAAARXAGVGLAGENALPRYDDTAHDQVVATAADRAAEDRMVAFTYLRMGPDLFQPDNWRRFAAFVKRMTEPGAREACREQVEREAEGVAHATQPLVHEAAVALTN

SEQ ID NO: 9318 - protein, 498 aa, Zea mays
  misc_feature (57)..(57): Xaa can be any naturally occurring amino acid
SRTSPWRARRWWRPRPRRSTPTWPPSSGAGPGVPVFVMMPLDTVRKDGNSLNRRKAXVEASLAALKSAGVEGIMVDVWWGIAEADGPGQYNFNGYMELMEMAKKTGLKVQAVMSFHQCGGNVGDSVTIPLPGWVLEEMDKDQDLAYTDRSGRRNYEYVSLGCDAMPVLKGRTPIQCYADFMRAFRDHFATFMGNTIVEIQVGMGPAGELRYPSYPESDGTWSFPGIGEFQCYDRFMLSSLKAAAEAVGKPEWGNAGPGDSGSYKDWPEDTGFFRREGGWSTEYGEFFMSWYSQMLLEHGERILSAATGVFTGSPGVKISVKVAGIHWHYGTRSHAAELTAGYYNTRSHDGYAPIARMLARHGAVLNFTCVEMRDHEQPQDAQCRPEALVQQVAAAAREAGVGLAGENALPRYDDTAHDQVVATAADRAAEDRMVAFTYLRMGPDLFQPDNWRRFAAFVKRMTEPGAREACREQVEREAEGVAHATQPLVHEAAVALTN

SEQ ID NO: 9319 - protein, 559 aa, Zea mays
MGSSGFSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFESGTLHLIGLLSDGGVHSRLDQLQILLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVFDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDATKEEYVEIPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 9320 - protein, 560 aa, Zea mays
  misc_feature (471)..(471): Xaa can be any naturally occurring amino acid
  misc_feature (486)..(486): Xaa can be any naturally occurring amino acid
  misc_feature (532)..(532): Xaa can be any naturally occurring amino acid
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLLLKGVSERGAKKIRVHILTDGRDVLDGSSVGFVETLENDLLELRGKGIDAQIASGGGRMYVTMDRYENDWDVVKRGWDAQVLGEAPYKFKSALEAVKTLRAQPNANDQYLPPFVIVDDSGKAVGPVLDGDAVVTINFRADRMVMLAKALEYADFNNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILNAVEQVGGIYLVTADHGXMAEDMVKRNKSGKPXLLDKNGGIQILTSHTLQRGARLPLGGPGLHPGVKFRNDIQIPGLAXNVAATVMNLHGFEAPADYEQTLIEVADN

SEQ ID NO: 9321 - protein, 379 aa, Zea mays
  misc_feature (168)..(168): Xaa can be any naturally occurring amino acid
MATLNPFELLGADDNDDPTQLIAAAAAAAQKAEAKKSAVAPAGKAAQPAATTKFPTKPAPPSQTVRDARGGGSSARGGFGRGERGRGRGGRGYGQNRGFSGDNGNEFQGGYGGGGYGDGAVTGGSEGERERETRPPYRGGGRRGGYRNVEFADDSERPPRRNYERHSXGTGHGYEMKRDGAGRGNWGTATDELIAQDAEDSPKMEEAAPVAEKQGEQNDAPAADENKDNKDATANEEEEKEEDKEMTLEEFEKIREEKRKALLALKAEERKVEVDKDLQSLQPLSNKKENDEVFIKLGSDKDKKKENAERDERAKKSVSINEFLKPAEGERYYGGRGRGRGRGDRGGFRGGYRGGYSRGPAAAAPSIEDQAQFPSLGGK

SEQ ID NO: 9322 - protein, 200 aa, Zea mays
  misc_feature (18)..(18): Xaa can be any naturally occurring amino acid
  misc_feature (33)..(33): Xaa can be any naturally occurring amino acid
  misc_feature (50)..(50): Xaa can be any naturally occurring amino acid
  misc_feature (62)..(62): Xaa can be any naturally occurring amino acid
  misc_feature (67)..(67): Xaa can be any naturally occurring amino acid
  misc_feature (89)..(89): Xaa can be any naturally occurring amino acid
MGPITCVLDHIREKDGIXAALAWLSIIAFKNKXDNLGGNKLVTVEDICRXHCATYGRHYYTXRYDLXNVDAGAAKELMANLVSMQSSLXSDGNKVVKEIRSDVSEVVAADEFEYKDPVDGSVSKHQGIRYLFGDGSRLVFRLSGTGSVGATIRVYIEQYEKDSSKIGRDSQDALAPLVDVALKLSKMQEYTGRSAPTVIT

SEQ ID NO: 9323 - protein, 258 aa, Zea mays
  misc_feature (79)..(79): Xaa can be any naturally occurring amino acid
  misc_feature (101)..(101): Xaa can be any naturally occurring amino acid
  misc_feature (164)..(164): Xaa can be any naturally occurring amino acid
  misc_feature (189)..(189): Xaa can be any naturally occurring amino acid
MGANGHPPLASTRAHNGSHSGGSGGGGGGGGGANPSNGGTAAALRHDPGLAREWLTEEHAILDELLVKYASDLPVVRYXKIAMKLPEKTVRDVALRCRWMXKKESAKRKKEDHYSSKKSKDKKEKVSDSSSKPPVLMADRPTVPPYPLPVLPVDDDEISSKACXIGGPTGEILETNSQVLSQISTNLSXHIQNNISLLCQTRDNILRILKEINDAPETMKQMPSLPVKINEDADAPATQMINEDLVNSLLPRPTVPMQ

SEQ ID NO: 9324 - protein, 271 aa, Zea mays
CVDVIKMGRKVSCMITHGPWVLIGIPKFVEAWNTKTGMKLRFQGPSSLVCSMAITDEMLFAGTGDGRIMAWRFPAKDSNTEPVLILSGHQRPVISLSISARRLYSGSLDKTIKAWGLTTRQCVQTLSEHKATVTSVLCWDEKLLSCSLDKTIKLWTQSESGNLQVKYAHAEENGLCTLFGMHQVGKTPVLFCSLHNSNCVRLLDLPSNAGCQEANSCHWITGVGAHCMWQGNSNSTDDNLQNEDANDVSRWPISLVLCSLMLMEYPTEHLV

SEQ ID NO: 9325 - protein, 315 aa, Zea mays
MMKLQVNVFEYFDSRQLIVCGNHFRRIREVELKRDYAFIEFSDPRDADDAQYNLDGRDVDGSRIIVEFAKGVPRGSGGSRDYNGRGPPPGTGRCFNCGVDGHWARDCQAGDWKNKCYRCGERGHIERNCQNSPRNLRRERSYSRSPSPRRGRGRSRSYSRSRSYSRSRSPSGSPRGGRRDRDERRSRSLSYSRSASPRRSVSPVKEKERSRTPDGSRSPSPRDKVSPPPKDNGAHNGSDREDSPGGREMSKRSRSPSDGYRSPVGNGRSPSRSPSPKVNNGDDPSPKGNNGDDPSPKGNNGDDEHRGSPRGSQSP

SEQ ID NO: 9326 - protein, 195 aa, Zea mays
  misc_feature (71)..(71): Xaa can be any naturally occurring amino acid
VLDSCQQLTVCGNYLRRIREVELKRDWKNKCYRCGESGHIERNCQNSPRNLRRDKSYSRSPSGSPRGGRRXRDERRSRSLSYSRSASPRRSVSPAKEKERSRTPNGSRSPRSPSPRAEVSPPLKDNGARNGSDHEGNPGGGENSKRSRSPSDGYRSPVANGRSPSPRDDRSPSPKGNNEDDERRGSPRGSQSPLN

SEQ ID NO: 9327 - protein, 300 aa, Zea mays
MPRNDDRYGNTRLYVGRLSPRTRSRDLEYLFSKYGRIREVELKRDYAFIEFSDPRDADDAQYNLDGRDVDGSRIIVEFAKGVPRGSGGSRDYNGRGPPPGTGRCFNCGVDGHWARDCQAGDWKNKCYRCGERGHIERNCQNSPRNLRRERSYSRSPSPRRGRGRSRSYSRSRSYSRSRSPPRRSVSPVKEKERSRTPDGSRSPSPRDKVSPPPKDNGAHNGSDREDSPGGREMSKRSRSSSDGYRSPVGNGRSPSRSPSPKVNNGDDPSPKGNNGDDPSPKGNNGDDDEHRGSPRGSQSP

SEQ ID NO: 9328 - protein, 289 aa, Zea mays
MEIEKTFILHVTFFILSDVLIAKQEFSDPRDADDAQYNLDGREVDGSRIIVEFAKGVPRGSGGSREYMGRGPPPGTGRCFNCGMDGHWARDCKAGDWKNKCYRCGESGHIERNCQNSPRNLRRDKSYSRSPSPRGGRGRSRSYSRSRSYSRSRSPSGSPRGGRRERDERRSRSLSYSRSASPRRSVSPAKEKERSRTPNGSRSPRSPSPRAEVSPPLKDNGARNGSDHEGSPGGGENSKRSRSPSDGYRSPVANGRSPSPRDDRSPSPKGNNEDDERRGSPRGSQSPLN

SEQ ID NO: 9329 - protein, 159 aa, Zea mays
MDATGTGAGGKAKKGAAGRKAGGPRKKSVTRSVKAGLQFPVGRIGRYLKKGRYAQRVGSGAPVYLAAVLEYLAAEVLELAGNAAKDNKKTRIVPRHVLLAIRNDEELGKLLTGVTIAHGGVLPNINPVLLPKKTAEKASSGGSKEAKSPKKAAKSPKKA

SEQ ID NO: 9330 - protein, 380 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 9331 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 9332 - protein, 380 aa, Zea mays
  misc_feature (84)..(84): Xaa can be any naturally occurring amino acid
  misc_feature (89)..(89): Xaa can be any naturally occurring amino acid
  misc_feature (194)..(194): Xaa can be any naturally occurring amino acid
MATAGKVIKCKAAVAWEAGKPLSIEEVEVAPPQAMEVRVKILFTSLCHTDVYFWEAKGQTPVFPRIFGHEAGGIIESVGEGVNXVAPGXDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPXKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 9333 - protein, 386 aa, Zea mays
  misc_feature (33)..(33): Xaa can be any naturally occurring amino acid
  misc_feature (125)..(125): Xaa can be any naturally occurring amino acid
  misc_feature (152)..(152): Xaa can be any naturally occurring amino acid
  misc_feature (196)..(196): Xaa can be any naturally occurring amino acid
  misc_feature (273)..(273): Xaa can be any naturally occurring amino acid
  misc_feature (305)..(305): Xaa can be any naturally occurring amino acid
  misc_feature (373)..(373): Xaa can be any naturally occurring amino acid
MATAGKVIKCKAAVAWEAGKPLSIEEVEVAPPXAMEVRVKILFTSLCHTDVYFWEAKGQTPVFPRIFGHEAGGIIESVGEGVTDVAPGDHVLPVFTGECKECAHCKSAESNMCDLLRINTDRGVXMIADGKSRFSINGKPIYHFVGTSTFSXEYTAHAWWGCVAKINPQAPLDKVCVLSCGISTGLGASINVAKPXPKGPTVAVFGLGAVGLAAAEGARICWSVRGIIGVDLNPSRFEEARKFGCTEFVNPKDHNKPVQEVLAEMTNGGVDRXSVECTGNINAMIQAFECVHDGWGVAVLVGVPXKDAEFKTHPMNFLNERTLKGTFFGNYKPRTDLPNVVELYMKKELEVEKFITHSVPFAEINKAFDLMAXKGEGIRCIIRMEN

SEQ ID NO: 9334 - protein, 160 aa, Zea mays
  misc_feature (57)..(57): Xaa can be any naturally occurring amino acid
  misc_feature (120)..(120): Xaa can be any naturally occurring amino acid
MDSTGTGAGGKGKKGAAGRKVGGPRKKSVSRSVKAGLQFPVGRIGRYLKKGRYAQLXVAPAAPVYLAAVLEYLAAEVLELAGNAARDNKKTRIIPRHVLLAIRNDEELGKLLGGVTIAHXGVLPNINPVLLPKKTAEKASSGGSKEAKSPKKAAKSPKKA

SEQ ID NO: 9335 - protein, 159 aa, Zea mays
MDSTGTGAGGKGKKGAAGRKVGGPRKKSVSRSVKAGLQFPVGRIGRYLKKGRYAQRVGTGAPVYLAAVLEYLAAEVLELAGNAARDNKKTRIIPRHVLLAIRNDEELGKLLGGVTIAHGGVLPNINPVLLPKKTAEKASSVGSKEAKSPKKAAKSPKKA

SEQ ID NO: 9336 - protein, 243 aa, Zea mays
  misc_feature (223)..(223): Xaa can be any naturally occurring amino acid
VLIGSNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFXLVGGASLKPEFIDIINAAAV

SEQ ID NO: 9337 - protein, 250 aa, Zea mays
MGRKFFVGGNWKCNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 9338 - protein, 102 aa, Zea mays
YRTTVYRISIAEIISKLEGVDGSTVSKQGLRFVFTDGSRIIFRLSGTGSAGATIRLYIEQFESDISKHSLDAQTALKPLIDLALSVSKLKDFTGREKPTVIT

SEQ ID NO: 9339 - protein, 694 aa, Zea mays
MAALEAAREWAGSVIPPELAAAAGGDPLAALAATAAALVAGLLIIAVWFRSGGGTPSKPVATPVRPPPVKVDADADVDDGRKRVTIFFGTQTGTAEGFAKSMAEEARARYEKAVFKVVDLDDYAQEDEEYEEKLKKETVVLFFLATYGDGEPTDNAARFYKWFTEGKEKEVWLKDLKYGIFGLGNRQYEHFNKVAKVVDELVEEQGGKRLVPVGLGDDDQCIEDDFTAWKELVWPELDQLLRDEDDTTGASTPYTAAIPEYRVVFIDKSDLSFQDRSWTLANGTGVIDIQHPCRSNVAVRKELHKPASDRSCIHLEFDISGTGLVYETGDHVGVYAENSVQTVEEVERLLDLSPDTFFSIHADAEDGSPRKGGGSLAPPFPSPCTLRTALLRYADLLNPPKKAALLALASHASDPAEAERLRFLASPSGKDEYSQWITASQRSLLEVMAAFPSAKPPLGVFFAAIAPRLQPRYYSISSSPKMAPSRIHVTCALVYGPSPTGRIHQGVCSTWMKNTIPLEYSEECSWAPIFVRQSNFKLPADPSTPIIMIGPGTGLAPFRGFLQERLALKQSGAELGTSILFFGCRNRNMDYIYEDELQTFLEEGALSELIVAFSREGPTKEYVQHKMVEKATDIWNIISNGGYLYVCGDAKGMARDVHKMLHTIVQEQGSLDNSKTESYVKSLQMEGRYLRDVW

SEQ ID NO: 9340 - protein, 446 aa, Zea mays
MAATIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 9341 - protein, 389 aa, Zea mays
  misc_feature (156)..(156): Xaa can be any naturally occurring amino acid
  misc_feature (365)..(365): Xaa can be any naturally occurring amino acid
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILVEQGIVPGIKVDKGLVPLAGSNNESWCQGXDGLASREAAYYQQGARVAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQXLGKYTSDGEAAEAKEGMFVKNYSY

SEQ ID NO: 9342 - protein, 348 aa, Zea mays
FSSAPPQPGAPLDRDPGDMPRYDDRHGNTRLYVGRLAPRTRSRDLEYLFSKYGRFSVFYPTMEMMKLQVNVFEYFDSRQLIVCGNHFRRIREVELKRDYAFIEFSDPRDADDAQYNLDGREVDGSRIIVEFAKGVPRGSGGSRDYNGRGPPPGTGRCFNCGVDGHWARDCQAGDWKNKCYRCGERGHIERNCQNSPRNLRRERSYSRSPSGSPRGERRDRDERRSRSLSYSRSASPRRSVSPAKEKERSRTPDGSRSPSPRDKVSPPPKDNGAHNGSDREDSPGGREMSKRSRSPSDGYRSPVGNGRSPSPRDDRSPSPKVNNGDDPSPKGNNGDDEHRGSPRGSQSP

SEQ ID NO: 9343 - protein, 473 aa, Zea mays
  misc_feature (374)..(374): Xaa can be any naturally occurring amino acid
MRNEAKSKAPGATSTPKTPPPPPPPTKPTSSLNKGQSSGQPPLPPPLPVQLQVGTDGLPLPRLKPLHWDKVRAAPNRSMVWNDIKSNSFAFEFDEQMIESLFAYNFQGQTKNEDPKSKILVTSKHVIEHHKLQNTTILLKTLNASTEQVCNSITEGAGLSTQQLEALVKTRPSEEEEKKLLDYGGDTNTLDPAENFVKVLLTIPMSFPRIEAMLYKETFDDEVAHLRMSFALIRGACSELRSSKLFLRLLEAVLKTGNRMNVGTIRGGANAFRLDALLKLSDIRGADGKTTLLHFVVQEMERSQGSKASDKPSGTSGSCQATLAEREGCSEMGTEFVSELSNELGNVKKVASIDLDTLKSSISNLSRGLARLIXLSGRTLPCNDRNKNFLQCMRSFQTHAENTMLELKVDEAEVLQQVRELTEYYHGEVGKNECNLLHIFVIMRDFLGLLDRVCREMRGSKHMQPLNIVLPLR

SEQ ID NO: 9344 - protein, 305 aa, Zea mays
  misc_feature (196)..(196): Xaa can be any naturally occurring amino acid
MSGGTPAASSSLRAALSYCVRQVRAYDYHHYLCLLHLAPAMRKAAFTFRAFNIETARAMDVVSDPRTCLMRLLWWKEAVDKVFGNKLVEHPVAQALSSVIADHKVSKHWLKRSVEARINDANREEGTIPGTSAELERYAEDTQSTILYMTLQAGGIQSTVGDHAGYNIGKGRGLLLLVKALPHHVNKQGTVHYIPXASVAEECGLLITREGGRSEVRAGERLPDAVFKVASVAEAHLHKARELAPSVPKEAIPVLLPALPAQVLLDTLRRCEFNVFDPRLSRGVHGVSPLWYQLKLNWNAWRSRY

SEQ ID NO: 9345 - protein, 580 aa, Zea mays
  misc_feature (137)..(137): Xaa can be any naturally occurring amino acid
  misc_feature (237)..(237): Xaa can be any naturally occurring amino acid
  misc_feature (266)..(266): Xaa can be any naturally occurring amino acid
  misc_feature (440)..(440): Xaa can be any naturally occurring amino acid
  misc_feature (519)..(519): Xaa can be any naturally occurring amino acid
MIESSGSLEAGRAGEIPSTEEESFSTPPPFILGGQEERAVQKRNKGKGRGSQTNPSTCLSFACADLAMAAGGELAWGEEPVARRRPKTKIVCTLGPASRSVEMISRLLRAGMCVARFNFSHGSHEYHQETLDNLHAXAMELTGILCAVMLDTKGPEIRTGFLKDGKPIQLIKGQEITISTDYSIQGDEKMISMSYKKLAVDLKPGSVILCADGTITLTVLHCDKEQGLVRCRCENTXSLGERKNVNLPGVIVDLPTLTDKDKEDIXLKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTDCVMLSGETAAGAYPELAVQTMAKICLQAESCVDHAAIFKSIMASXAPIPMSPLESLASSAVRTANSARAALILVLTRGGTTARLVAKYRPSMPILSVVVPELKTDSFDWACSDEGPARHSPHCXRGVIPMLSAATAKAFDNEATDEAIGFAIENAKTMGLCNTDQSVVALHRIGISSVIKLLTVK

SEQ ID NO: 9346 - protein, 283 aa, Zea mays
MVVAAMRDEGEEGRRRAVVAIRDYDPKTDRDGTEAVERECEVGPAAAAGGMSLHADLLGDPVARIRHSPHYLMLVAETSGPDGRIVALVRGTVKSVASGKSRPGAPAFARVGYILGLRVAPSHRRMGIARQLVHRLEQWFELMGAEYAYMATDRSNEASLRLFTGRCGYSKFRTPSLLVHPVHSHRLRAPRRATVVRLGARDAERLYRSRLAHVEFFPADIGAVLGNALSRGTFLATVGGYEWGGVDRFLACPPASWAVASAWDCGGVFRLQVRGASRLRRAA

SEQ ID NO: 9347 - protein, 180 aa, Zea mays
  misc_feature (158)..(158): Xaa can be any naturally occurring amino acid
MEYGQQGQRGHGATGHVDQYGNPVGGVEHGTGGMRHGTGTTGGMGQLGEHGGAGMGGGQFQPAREEHKTGGILHRSGSSSSSSVITTLDTSFFCSEDDGMGGRRKKGIKEKIKEKLPGGHKDDQHATATTGGAYGQQGHTGSAYGQQGHTGGAYATGXTEGTGEKKGIMDKIKEKLPGQH

SEQ ID NO: 9348 - protein, 169 aa, Zea mays
  misc_feature (72)..(72): Xaa can be any naturally occurring amino acid
MEYGQQGQRGHGATGHVDQYGNPVGGVEHGTGGMRHGTGTAGGMGQLGEHGGAGMGGGQFQPAREEHKTGGXILHRSGSSSSSSSEDDGMGGRRKKGIKEKIKEKLPGGHKDDQHATATTGGAYGQQGHTGSAYGQQGHTGGSYATGTEGTGEKKGIMDKIKEKLPGQH

SEQ ID NO: 9349 - protein, 167 aa, Zea mays
MEYGQQGQHGHGATGHVDQYGNPVGGVEHGTGGMRHGTGTGGMGQLGEHGGAGMGGGQFQPAREEHKTGGILHRSGSSSSSSSEDDGMGGRRKKGIKEKIKEKLPGGHKDDQHATATTGGAYGQQGHTGSAYGQQGHTGGAYATGTEGTGEKKGIMDKIKEKLPGQH

SEQ ID NO: 9350 - protein, 229 aa, Zea mays
  misc_feature (158)..(158): Xaa can be any naturally occurring amino acid
MDSEHWISRLAAAKRFYAAQLGHSDRAGMDELEMDEEVRPEFPCPYCYEDHDVGSLCAHLEEEHPFEPQAAACPVCSEMVTKDMVNHITTQHGYLFKNRRRLRRFIIPGSQALSLLSRDLREAHLQVLLGGGGQRSSDNSSSSSATNISADPLLSSFXLGFPTSDAEQASKSTVSIPDDATTVKEAPAQARKLSIDSSLTSEERELKRKQARVRATFVQDLLLSTLFGD

SEQ ID NO: 9351 - protein, 410 aa, Zea mays
MACTNNAMRALFLLVLFCIVHGEKEESKGIDAKASGPGGSFDITKLGASGNGKTDSTKAVQEAWASACGGTGKQTILIPKGDFLVGQLNFTGPCKGDVTIQVDGNLLATTDLSQYKDHGNWIEILRVDNLVITGKGNLDGQGPAVWSKNSCTKKYDCKILPNSLVMDFVNNGEVSGVTLLNSKFFHMNMYRCKDMLIKDVTVTAPGDSPNTDGIHMGDSSGITITNTVIGVGDDCISIGPGTSKVNITGVTCGPGHGISIGSLGRYKDEKDVTDINVKDCTLKKTMFGVRIKAYEDAASVLTVSKIHYENIKMEDSANPIFIDMKYCPNKLCTANGASKVTVKDVTFKNITGTSSTPEAVSLLCTAKVPCTGVTMDDVNVEYSGTNNKTMAICTNAKGSTKGCLKELACF

SEQ ID NO: 9352 - protein, 478 aa, Zea mays
MSKSPVASHPTTTHLVVRRFDPVLPTQGESPDPSPSGIRVLSSPSPSPPSDCPPRLPRRRVSGAAAAAAAAACRAVMATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSSKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFNEALDTTKTVIWNGPMGVFEFEKFAAGTEAIAKKLAELTTTKGVTTIIGGGDSVAAVEKAGLADKMSHISTGGGASLELLEGKTLPGVLALDDA

SEQ ID NO: 9353 - protein, 157 aa, Zea mays
MDASGAGSKGKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLAGVTIAHGGVLPNIHSVLLPKKAAEKAASAGSKEPKSPKKGAKSPKKA

SEQ ID NO: 9354 - protein, 165 aa, Zea mays
  misc_feature (75)..(75): Xaa can be any naturally occurring amino acid
MDASGAGSKAKKGAAGRKAGGPRKKSVSRSVKAGLQFPVGRIGRYLKKGRYAQRVGTGAPVYLAAVLEYLAAEVXLELAGNAAKDNKKTRIVPRHLLLAIRNDVELGKLLSGVTIAHGGVLPNINPVLLPKKVAEKASSGGSKESKSPKKAAKSPKKAAKSPKKA

SEQ ID NO: 9355 - protein, 541 aa, Zea mays
MATANGSWVPRGRAGIHLSITTTSSFPRLPSALRVARGSMATANGSSKGSFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGVVGHIVPWNYPTTMFFFKVGPALAAGCAVVVKPAEQTPLSALFYAHLAREAGVPAGVLNVVPGFGPTAGAAVAAHMDVDKVSFTGSTEVGRLVMRAAAESNLKPVSLELGGKSPVIVFDDADLDMAVNLVNFATYTNKGEICVAGTRIYVQEGIYDEFVKKAAELASKSVVGDPFNPSVSQGPQVDKDQYEKVLRYIDIGKREGATLVTGGKPCGDKGYYIEPTIFTDVKDDMTIAQDEIFGPVMALMKFKTVEEVIQKANNTRYGLAAGIVTKNIDVANTVSRSIRAGAIWINCYFAFDPDAPFGGYKMSGFGKDMGMDALDKYLQTKTVVTPLYNTPWL

SEQ ID NO: 9356 - protein, 153 aa, Zea mays
  misc_feature (63)..(63): Xaa can be any naturally occurring amino acid
MEVPMNTTQSGPHFPVQHRSLSLDVRGNKTENYPHAYEDTFLVIVTQIGCMGTILAAKKDESXFSDPTYNVYVLFGKRDEPLLLACARQLIGHISGSGSARSLVISLGLKDHSQWQWLSPVIGDFSGSERSFSGNAEGYYCSCDRESPLVMIE

SEQ ID NO: 9357 - protein, 130 aa, Zea mays
MEVPMNTTQSGPHFPVQHRSLSLDIKGNKTDIVINKYEDTFLVIVTQIGCMGTILAAKKDESVFSDPTYNVSVLFGKRDEPLLLACARQLIEHISGSGSARSLVISLGLKDHSQGTLKDITVAVIENRLW

SEQ ID NO: 9358 - protein, 412 aa, Zea mays
MASAATTLLKSSFLPKKAEWGSKHQLVAAHPRPATVVVSMVARASAYADELVQTAFAILLIIFLQKTIASPGRGILAMDESNATCGKRLDSIGLENTEANRQAYRTLLVSAPGLGQYISGAILFEETLYQSTVDGKKIVDVLSEQGIVPGIKVDKGLVPLAGSNNESWCQGLDGLASREAAYYQAGARFAKWRTVVSIPNGPSQLAVKEAAWGLARYAAISQENGLVPIVEPEILLDGEHGIERTFEVAQKVWAETFFYMAENSVMFEGILLKPSMVTPGAECEEKATPEQVAEYTLRLLRTRIPPAVPGIMLLFCASMQFLSGGQSEVEATQNLNAMNQSPNPWHVSFSYARALQNTCLKTWGGRPENVKAAQDALLLRAKANSLAQLGKYTGDGEAAAAKEGMFVKNYSY

SEQ ID NO: 9359 - protein, 520 aa, Zea mays
  misc_feature (76)..(76): Xaa can be any naturally occurring amino acid
  misc_feature (261)..(261): Xaa can be any naturally occurring amino acid
MAAITPPTQSEPSPQTGRPASSAAAAAKRGGGGAGAAGGPLMGKYELGRLLGHGTFAKVYHARHVDTGDNVAIKVXLDKEKAVKSGLVPHIKREIAVLRRVRHPNIVHLFEVMATKTKIYFVMELVRGGELFSRVSKGRLREDTARRYFQQLVSAVGFCHARGVFHRDLKPENLLVDEQGNLKVSDFGLSAVAEQFRPDGLLHTFCGTPAYVAPEVLGRRGYDGAKADVWSCGVILFVLMAGYLPFHDKNIMAMYKKIYKXGEFRCARWFSKDLTSLLMRILHTNPNTRITLPEIMESRWFKKGFKPVKFYIEDDQLHNVIDDEDGLLDMGPAGPVPPPLPPPPPPLPPPKVDGDESGSDSDSSISSCPASMLSDESQRPRGSLPRPASLNAFDIISFSRGFNLSGLFEEKGDEVRFISAEPMSDIITKLEDIAKLKSFKLRRKDWRICLEGTREGVKGPLTIGAEIFELTPPLVMVEVKKKAGDNEEYENFCDKELKPGMQHLVHHMVRAPSMLLTDAK

SEQ ID NO: 9360 - protein, 77 aa, Zea mays
  misc_feature (21)..(21): Xaa can be any naturally occurring amino acid
GIPGSTHAFGGAKSGCIWYYXPENHWWISEGIKKRPESSGTNPALHSNHLYLATTSTDCKFQMVSTFIKGVNPKGSP

SEQ ID NO: 9361 - protein, 140 aa, Zea mays
SLIAAAARHYLLQPIIADHKTLERLDLTDADGQGVLTMDKCQLQELRVRPVSTSRGSHRTLMPELSMWLWYAPCIELPGGLVLNGATLVAIKPSEEGTGDTVWNGAAGAAWVLDAFEEPYRTAVRMLLKQRTYSLEMNSF

SEQ ID NO: 9362 - protein, 106 aa, Zea mays
MSSPDIVSILDNSKELDRVRKEQEDILSEINKLHKKLQATPEVVEKPGDNSLARLKFLYTQAKELSESEASISNLLINQIDALLPTGPQGQTRRRIGKGNEQKRKR

SEQ ID NO: 9363 - protein, 395 aa, Zea mays
MNNLRKRMISLLLRAPGSPYVPCPHFFPLFYPHRLLSAIKCVATKPFAVEDYLVATCGLTQAQALKASKHVSHLKDPSKADAVVAFLSNLGLSSAEITDVVTRDPKVLCSDVERSLTARVAELTDLGFSRPEIVRLLIVGMNHFRHSSLRLNLEFWISVFGSLDELIRALRINAALLSTRIEEVCKPNLELLQECGINVSDISNSFMSRVLTRDPKSLQEALARLHEFRIQPGSQPFFRGLYTFAILGSGKITKSIQLFEKLGWSKDHIVSAVKRDPTILGFTEERVRRNMEFLIRVVGLEVPYIARRPALINYSIDRRLLPRNCLINFLRAKGLFNDEASFLSVAAIGDEKFRRRYVHPYEEDFPGLAAAFASSCAGEHQWERLYKMTGENKES

SEQ ID NO: 9364 - protein, 245 aa, Zea mays
MSSSVGGGSAGGGGVDMVSLLEKAKELDQLKKEQDEIVADINKIHKKLLASPEMVDKPVDTILLKLRGLYARAKELSENEISASNALIGLLDGLLQSGASTAQKKKIVAFYISEVGEQKKKRIKSDTDSARFSAASMRNQLDQAASLKGEQVAARVKSDDEKDEWFVVKVIHFDKETKEGEVLDEEPGDDKESTQKKYMLPMSYIFSFSKKGDPSSAPYFGQGIQVLAVFPGTTALYRASVSLLF

SEQ ID NO: 9365 - protein, 316 aa, Zea mays
  misc_feature (104)..(104): Xaa can be any naturally occurring amino acid
MDLASSDLAALGAAELVRVSASIPRAAPRTFALLTACLVFPLTFAVLAHSLFTHPILLRIQRATHSELAQWLRLFAYQFLYLIVLFTVASLYANKPASISSSLXALPPILPRLLRTFLWVSLLMLAYHLVFALTVLLLIVVFIPNASESESAPPSLAFVLFLVVVVFVFLGIHVYISALWHLASVISVLEPLCGLAAMAKGRQLLQGRTGTAATLVVSYFAVCGATSLLFRAAVVKGRTEEGSFGLALPGRLLVGAVLVCVLVSVNLLGLLVQSVFYYACKAFHSQQIDRTALYEHLGGYLGEYVPLKSNIQMENL

SEQ ID NO: 9366 - protein, 367 aa, Zea mays
MGGVTSSVAAKMAFFPPTPPSYALVEDAGAGVTTLSGQPHRENVELLRFRTRKGNTLAAMYVRHPDAASTVLYSHGNAADLGHLYQLFLHLSFNLRVNILGYDYSGYGQSSGKPSEHNTYADIEAAYKCLIEKFGAKEEEIILYGQSVGSGPTVDLASRLSQLRAVVLHSPILSGLRVMYPVKRTYWFDIYKNIDKIPQVTCPVLIIHGTADEVVDWSHGKQLWELCKDKYEPLWLRGGKHCDLELFPEYIRHLKNFFHSLEKSPSHRQAWRENVDRIEPSRKSTDFFEPSRKSTDQRKKSRSTRDKTRNTEHRYSNVEKVDKLKISFDQFEKSRRSVDIFERPKRNIEQLDCGRKSVDRLDRIWAS

SEQ ID NO: 9367 - protein, 55 aa, Zea mays
MIQVGLNDRLAIKGQLKCNDDDTIGDLKKAGVVHTVTRPEKIRIQMCYNIYTDHI

SEQ ID NO: 9368 - protein, 156 aa, Zea mays
MDASAAGAGGKAKKGAAGRKAGGPRKKSVTRSVKAGLQFPVGRIGRYLKKGRYAQRVGTGAPVYLAAVLEYLAAEVLELAGNAAKDNKKTRIIPRHVLLAIRNDEELGKLLSGVTIAHGGVLPNINPVLLPKKTAEKAAAKEAKSPKKAAKSPKKA

SEQ ID NO: 9369 - protein, 123 aa, Zea mays
AGGGAGASTLGGGGPSGSGSGGPGAGGIGVGGGAGGPCGACKFLRRKCVSGCIFAPYFDSEQGAAHFAAVHKVFGASNVSKLLLQIPPHKRLDAVVTICYEAQARLRDPVYGCVAHIFALQQQ

SEQ ID NO: 9370 - protein, 544 aa, Zea mays
MACNLAQCATAAAATVAPRTPRPAASASVSFSARKPAGGSLRLQRQACCEPSVAPSRAVFACRAAASGSAADLASGGRRSSGVPVFVMMPLDTVKECGTALHRRKAVQASLSALKSAGVEGVMVDVWWGIAERDGPGRYNFAGYAELMEMARKAGLKVQAVMSFHQCGGNVGDSVSIPLPRWAAEEMEKDQDLCYTDQWGRRNYEYVSLGCDALPVLKGRTPVECYTDFMRAFRDHFADYLGNTIPELPVGMGPAGELRYPSYPESNGTWKFPGIGAFQCNDRYMRSRLQAAAEAAGKPEWGHGGPTDAGGYNNWPEDTVFFRGDNGGWSTEYGDFFLSWYSQMLLEHGDLILSGATSVFGAAPVEVSVKVAGIHWHYGSRSHAPELTAGYYNTRRHDGYLTIARLLARHGAVLNFTCVEMRDHEQPQEARCMPEALVRQVGAAARAAGVGLAGENALPRYDGTAHDQVVTTAAERAAEDRMVAFTYLRMGPDLFHPDNWRRFAAFVRRMNGAGSCREAAEREAHGVAQATGSLVHEAAVALRS

SEQ ID NO: 9371 - protein, 108 aa, Zea mays
  misc_feature (71)..(71): Xaa can be any naturally occurring amino acid
RTRGLSERSASAAAIGREERVCTIQHAEGGVSGGPENISGNCAKKVVDAAVKAGRTIIDWDSMAKLLVTDXARKEFAVLRRAFYDVNHHLQTKFFHEPQPIEWEFYIN

SEQ ID NO: 9372 - protein, 251 aa, Zea mays
  misc_feature (65)..(65): Xaa can be any naturally occurring amino acid
MATVSLTPQAVFSTESGGALASATILRFPPNFVRQLSTKARRNCSNIGVAQIVAAAWSDCPAARXASAAAEVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAVAMLSALVPAGGHIVTTTDCYRKTRIYMETELPKRGISMTVIRPADMDALQNALDNNNVSLFFTETPHN

SEQ ID NO: 9373 - protein, 557 aa, Zea mays
  misc_feature (295)..(295): Xaa can be any naturally occurring amino acid
LRSVDRSIDRSAIMAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPADELKVSKAEFIDLARKSGKFDEDSLAFQSRLLAKSGIGDESYMPRCVFEPNASCATMKEGRAEASTAMFAALDELFDKCRVRPKDVGVLVVNCSLFNPTPSLSAMIVNHYKMRGNILSYNLGGMGCSAGVIAIDLARDMLQASGAGLXAVVVSTEAVSFTWYPGKRRSMLIPNAFFRAGCAAVLLSNRRRDFHRAKYQLEHVVRTHKGADDRAFRSVYQEEDEQRIKGLSISRDLLEVGGHALKTNITTLGPLVLPFSEQLLFFAGVLFRHLFPSKASTPAPPTTPGDASAAAPYIPDFKRAFEHFCMHAASRDVLEHLQSNLGLRDADLEASRAALHRFGNTSSSSIWYELAYLEAKGRVRRGDRVWQLAFGSGFKCNSAVWRAVRRVRRPARSPWLDCIDQYPARMDA

SEQ ID NO: 9374 - protein, 137 aa, Zea mays
LSSHSLAVLAGGALLGLLLAALAVATTDARSPPRGRRRRVPWLAAGFVMSVLWAYTLARELVALLVAIGYVVGIKPSVLGVTVLAWGDSLGDLVSNVAMAVHGGPGGAQTVVSGCYAGPLFNTVVGLGLSLALAAGA

SEQ ID NO: 9375 - protein, 381 aa, Zea mays
  misc_feature (221)..(221): Xaa can be any naturally occurring amino acid
MALLKAARVADVPTLDVVVAPGLVAVAKARSAAAVGGRFSVIGHRGKGMNALASEDPRLRDVRENTVRSFNDAGRFPVDYVEFDVQVTKDGCPIIFHDNFIFTQDDVSSCGKISQKRVADIQLEDFLQYGLQNEQGKVGKPLLRRLKDGRMVNWNVQSEDALCTLEEAFEKVNPRLGFNVELKFDDSLEYTEEELTRILQAILKVVFEYAKDRPILFSSFXAPTLAQLMRKLQGTYPVYFLTNGGTELYADVRRNSLEEAVKLCLAGGLQGIVSEARGIFRHPAAVPKIKEANLSLLTYGTLNNVPEAVYMQHLMGVNGVIVDLVPEITEAVSELIALPEPDLDLEVGSLSNQAAARGATTPNFSQREISFLLRLIPELVQ

SEQ ID NO: 9376 - protein, 576 aa, Zea mays
RPTRPGDLPLGYHQKDLVIYEMHLRGFTKHNSSKTKHPGTYIGAVSKLDHLKELGVNCIELMPCHEFNELEYFSSSSKMNFWGYSTINFFSPMARYSSSGIRDSGCGAINEFKAFVREAHKRGIEVIMDVVFNHTAEGNEKGPILSFRGIDNSTYYMLAPKGEFYNYSGCGNTFNCNHPVVREFIVDCLRYWVTEMHVDGFRFDLASILTRGCSLWDPVNVYGSPMEGDMITTGTPLVAPPLIDMISNDPILGNVKLIAEAWDAGGLYQVGQFPHWNVWSEWNGKYRDTVRQFIKGTDGFAGAFAECLCGSPQLYQAGGRKPWHSINFVCAHDGFTLADLVTYNSKYNLSNGEDNRDGENHNLSWNCGEEGEFASLSVRRLRKRQMRNFFVCLMVSQGVPMFYMGDEYGHTKGGNNNTYCHDHYVNYFRWDKKEEQSSDLYRFCRLMTEFRKECESLGLEDFPTSERLKWHGHQPGKPDWSEASRFVAFTMKDETKGEIYVAFNTSHLPVVVGLPERSGFRWEPVVDTGKEAPYDFLTDGLPDRAVTVYQFSHFLNSNLYPMLSYSSIILVLRPDV

SEQ ID NO: 9377 - protein, 87 aa, Zea mays
  misc_feature (47)..(47): Xaa can be any naturally occurring amino acid
  misc_feature (70)..(70): Xaa can be any naturally occurring amino acid
KLEGLHVDHEMTINDPKLLMEMMDIQDAVNDPSDAQTLETIQSQVNXKALKHDADSFQEAYYKKDLDRAXETTQRMTYYERALEETV

SEQ ID NO: 9378 - protein, 178 aa, Zea mays
LYRIPLKSLQAKRRGRRALEVLKKLARRQMMYHSYALQVHGYIAPCNAVEEEDVPLVLVHGYHGSHSLRHWLQLSDWIPTLEATLALDKEQVRRVGDDSVGGPAVTRQLRLIRILMRDLLIGVNYLHSHGLAHTELRIENVHVSPIDKHVKVSSLFFCLCKIVVFYPYNHALVVYHVH

SEQ ID NO: 9379 - protein, 400 aa, Zea mays
MVDIDHRMAGLAPSVAHTAALRRLSTRAAAGPSSASASPRHGLHSFHAVAAGVLSHLRESGVAVLPGLSDAELVRAEAEFGFTFPPDLRAVLALGVPSGPGFPDWRGRAGLRAAFDLPAAAASLQVARGALWPRCWGRRPADPGRALRLARSAVRRAPPLVPLFDRCYLPCRPCLAGNPVFFVADDRVLCCGLDLLYFFTRDSSFQPADRAVVSSSSPLSAGASRPSCTRRSLDAVQAPRWIEFWSDAASDRRRRDSSSSEASTASSSSSSSSSSGCPSPPRRPTPRWVDSYLDELGSMLKKGGWRDREVDEMVEVTASGFLDDGEEAPTPDSEAILDALVLKTDRCSDSLRRAGWTAEDVSDALGLDFRRGEERSRSAVRIPPEIAAKVQRLAQALARP

SEQ ID NO: 9380 - protein, 176 aa, Zea mays
PTRPPTRLSIRPPTRPAPPRDTLRKPGVLQCSAKEKVLDPKKAQNIAILLRALNVTPEEVSDALLDGNTECLGADLLETLVKMAPTKEEELKLRNFTGDSSKLGSAERFLKAVLDIPFSFKRVDAMLYRANFESEINYLRKSFETLEGACDDLKSSRLFLKLLEAVLRTGNRMNVG

SEQ ID NO: 9381 - protein, 89 aa, Zea mays
MNVLTSGRGMSGREAEMIDVVLNDRLGKKVRVKCNDDDTICDLKKLVAAHTVTRPEKILIHKLYNIYNDHITLNDYYVHYSMVLELYYN

SEQ ID NO: 9382 - protein, 59 aa, Zea mays
MIDVVLNDRLLKNVRFKCNYDDTICYLNNLFTSHTVTRPYNILIHNCYNIYNYHITLKD

SEQ ID NO: 9383 - protein, 593 aa, Zea mays
  misc_feature (203)..(203): Xaa can be any naturally occurring amino acid
MGTLGDRLRAFSTNRWLVFVAAMWLQSMAGIGYLFGTISPVIKAALGYNQRQVAALGVAKDLGDCVGFLAGSLSAVLPSWAMLLIGSVQNFLGYGWLWLIVTRQAPALPLWMMCVLIYVGTNGETFFNTTALVTCIQNFPKSRGQTVGIMKGFAGLSSAILTQLYAVMHTPDHATLVFMVAVGPSLVAIGLMFIIRPVGGHRXQVRPSDKNSFLFIYTICLLLASYLVGVMLVQDFMQLSDNVVNFLTVILLILLVLPIVIPVTLTLSSKTQHPIEEALLSDPSKGETSTSQEKEDQPEVILSEVEEEKPKDIDSLPPSERRKRIEELQTKLVQAAARGGVRIRRQPRRGENFTLVQALVKADFWLIWWSLLLGSGSGLTVIDNMGQMSQAVGFKDGHIFVSLTSIWNFLGRVGGGYFSEIIVREHTYPRHIALVICQILMAVGHFLFAMAWPGTMYVGTFLVGLGYGAHWAIVPAAVSELFGVKHFGAMYNFLTVANPAGSLVFSGLIASNLYDYEAEKQAQRRQITSLTSPRLFHSMGFLADGTLKCEGAVCFFVSSLIMSAFCVVGAGLSLIVVYRTRRVYTHLYGSNRT

SEQ ID NO: 9384 - protein, 519 aa, Zea mays
MEQATWAAFLGIVLCAALFHRTFLARGRRRANNPPPGPKPWPIIGNLNLVGELPHRSMNELSKRYGPLMQLRFGSLPVVVGASVEMAKLFLKTNDAAFSDRPRFAVGKYIAYDFSDLLWAPSGPCLRQARRICATELFSATRLESFEHIRDEEVRVMLRQLRQAAGRTVRLRDYLQMLTLGVISRIVLGKKYVQEEAADGEGDSASAMTPAEFGEMVDEFLVLHGVFNIGDYIPWLDWLDLQGYVARMKRMKARFGRFLERLLDVHNERRLREGGNFVAKDMLDVLLQLADDTSLEVQLNRDNVKAITQDLIIGGTDTSAKALEWAVSELLKNPKVLAKATEELDHVIGPDRLVTESDLPRLPYIEAVLKETLRLHPAAPMLAPHVAREDTSVDGYDVLAGTVVFINVWAIGRDPALWDAPEEFRPERFFESKIGVRGQDFQLLPFGSGRRMCPGINLALKVMALSLANLLHGFKWRLPDGVTAEELSMEEAFQLTVPRKFPLEAVVEPRLPDRLYTGA

SEQ ID NO: 9385 - protein, 370 aa, Zea mays
MAAEGEASMYYTTDDALSLVGFGRFQTLVLAYSGLGWIAEAFEIMLLSFVGPAVEADWGISGAEQGLISSAVFAGMLIGSIAGGLIADRYGRRTGFLFTAVVTAVFGLLSAFSPNYASLLTLRFVVGLGLGAGHVLSTWFIEFVPAAKRGTWMVVFHACWTVGTILEALLAWAIMPVLGWRWLLALSSAPCFVLLIFFPLTPESPRYLCSRGRTMDATVILERIARMNKGTLPPGVLIFRPEKHVDNNLGTSETALLIAEDNTGIEEDTSSKSSGIVAFQALWSYDLIRSTFLLWFIYLANYFTYYGVILLTSELSNGKRRCASVRTHLMQPNSGNLYRDVLVTSLAALPCTVSEHRVLGSLLLLVGLAA

SEQ ID NO: 9386 - protein, 90 aa, Zea mays
  misc_feature (15)..(15): Xaa can be any naturally occurring amino acid
  misc_feature (24)..(24): Xaa can be any naturally occurring amino acid
KKQIKLKLKPTNIKXLTKIITIFXFHPTHCHTFPYIHSHGFIQLVYLQLITLYNNNSQISKPHYAPCSISFLTHLISPISNIPFSPDLIH

SEQ ID NO: 9387 - protein, 229 aa, Zea mays
MAVLLRRAAALLVVAAVCADGASTFYSSDPNLGSARVVFQTNFGDIEFGFFPHVAPKTVEHIFKLVRLGCYNTNHFFRVDKGFVAQVADVMSGRTAPMNEEQKKEAEKTIVGEFSSVKHVRGILSMGRHSDPDSAGSSFSILLGNSPHLDGQYAVFGRVTKGDDTLSKLERLPTRREGIFVMPIERINILSTYYYDIDLESCEAEKSILRRRLSESASEVERWRRKCFA

SEQ ID NO: 9388 - protein, 89 aa, Zea mays
MANTNLEDVPSLDLMTELLRRLTCSSKPDKRLILIGPPGSGKGTQPPIIKDEYCLCHLATGDMLRAAVAAKTPLGVKANEAMDHGELDS

SEQ ID NO: 9389 - protein, 429 aa, Zea mays
  misc_feature (20)..(20): Xaa can be any naturally occurring amino acid
  misc_feature (78)..(78): Xaa can be any naturally occurring amino acid
MDIEADGRFGNKRVHNRLGXGSGGAPPSTNGKVCNYWRAGRCNRFPCPFLHSELPEAAPAQAPHWTRGERMAQPQHRXGRGGGHHNRWGKGPGGGSGIASHKPPERPCKYFLAGTECSYGERCRYPHSYCISDSIAMLTLLKGHEQGVTGIALPAGSDKLYSGSKDGTVRMWDCQTGQCAGVITMGREVGCMIIEGPWLFVGIPDAVKVWNMQTAAEMSLTGPTGQVYALAVASELLFAATQAGRILAWRFSAATNCFEPAASLDGHKLAVVSLIVGGMRLYSASMDKTIRVWDLATLQCIQTLSDHTDVVMSVLCWDQFLLSCSLDQTIKVIWAATESGNLEVTYTHKEDQGALALSGMPDAQSKPVLLCSLNDNTVRLYDLPSFSDRGRLFSKKEIRAIQMGPGGLFFTGDGTGELKVWQWVDLAQT

SEQ ID NO: 9390 - protein, 70 aa, Zea mays
MLTRAREGLIQAERTAVAAADIACTKDEITYNEPLDLIRLSLDERIYVNLRLYRQLRDKPHANDQHLNMI

SEQ ID NO: 9391 - protein, 155 aa, Zea mays
MDGSKAKKVAAKKFGGPRKKSVTKSIKAGLQFPVGRIGRYLKKGRYAQRVGSGAPVYLAAVLEYLAAEVLELAGNAAKDNKKSRIVPRHLLLAIRNDQELGRLLSGVTIAHGGVIPNINPVLLPKKAAEKAEKAEKTATKSPKKATKSPKKATKA

SEQ ID NO: 9392 - protein, 118 aa, Zea mays
  misc_feature (5)..(5): Xaa can be any naturally occurring amino acid
  misc_feature (47)..(47): Xaa can be any naturally occurring amino acid
  misc_feature (66)..(66): Xaa can be any naturally occurring amino acid
  misc_feature (72)..(72): Xaa can be any naturally occurring amino acid
  misc_feature (76)..(76): Xaa can be any naturally occurring amino acid
  misc_feature (79)..(79): Xaa can be any naturally occurring amino acid
  misc_feature (81)..(81): Xaa can be any naturally occurring amino acid
  misc_feature (114)..(114): Xaa can be any naturally occurring amino acid
MKGAXATRDTGSADLYQVNNRKPYHSVNFRIAHDGSTLWDRVSHNGXHTDANGEGGREGRKDPHSXNGGTAXETNXRKXPXPRARQKKNPQAAERTAQGTPTRRTGDEDGHTRXGNNN

SEQ ID NO: 9393 - protein, 123 aa, Zea mays
  misc_feature (16)..(16): Xaa can be any naturally occurring amino acid
  misc_feature (84)..(84): Xaa can be any naturally occurring amino acid
  misc_feature (88)..(88): Xaa can be any naturally occurring amino acid
MAANPADVPSLDLMHXLLRLMKCMSLPHMRLILIGPPGCSKVTLSTIIKDEYRLCHLATGYMLRAAVSFKTPLCIQALQALDQXSLLXDDMVQGIIDEALNKPSCHKGLILDGFPRTDTQALK

SEQ ID NO: 9394 - protein, 457 aa, Zea mays
MAASARDSADAAERVVDDHDGWASDGEMGMEMDVEGEFHDRDADRRDGGVDGDDEYLLLTRIRDTSAAEARAGKDIQGIPWERIHIARQDYRKARLEQYKNYENFPQSGELMDKLCKQVEKSSKYYEFQHNTRSVKPSILHFQLRNLLWATSRHDVYFMSNSTVTHWSSLSHKLSEVLDFSGHIAPVEKHPGSLLEGFSGVQVSTLAVNEGLLVAGGFQGELIGKDLEGCNIKFCARTTLSDNAITNAIDIHRSTSGSLRITVSNNDCGVREYDMERFQLLNHYRYNWPVNHTSVSPDKKLLAVVGDDRDALLVDSRNGKVTSTLVGHLDYSFATAWHPDSRTFATGNQDKTCRIWDTRNLSTSLAVLRGNIGAIRCIRYSSDGRFLVFSEPADFVHVYSVAADYKKRQEIDFFGEVSGITLSPDDESLFVGVCDRVYASLLQYRMIHAFDYLDSYV

SEQ ID NO: 9395 - protein, 476 aa, Zea mays
PLSSGCSERPIVKALHDGVRVIELDLWPNAAKDDVEVLHGRTWTSPVELIRCLEAIKEHAFATSPYPVILTLEDHLNRDLQAKVAQMLKETFGEMLYVSESEHMAEFPSPDELKGKIVISTKAPKECFQTKSSKDPPATEQQEGVWGEEISDDKATARQAQQSSGKYTADEETAGAGAEDEMEVEAEAEAEKKSRQGTEDNEYRRLIAIQLTRRKHDIEQDLRVDPDKVTRVSLGEKAFEKAIVSHGDHVVRFTQRNLLRIFPRSTRITSSNYNPLMGWRYGVQMVAANMQGHGRKLWLTQGMFRANGGCGYVKKPDALMRSKPLDFDPRAELPVKTRLRVTVYMGDGWRFDFRKTHFDRCSPPDFYARVGVAGVAADTRMEQTRVAMDSWVPAWDHEFGLFPLAVPELALLRVEVHESDNHQKDEFGGQTCLPVWELRPGIRSVRLSDHKGQPLPSVKLLMRFDFFPASDSNSTQ

SEQ ID NO: 9396 - protein, 523 aa, Zea mays
MFNKIIKRGNRKGARGDSAEVAARPAAPSSSSGSGGGGAGGAAPVTVNHASRATAPSPSSPTSPHVAPSAFATNPAVGAASPPLLEPLPLLRDVAAADRPGLILRKLRLVAALFDLSDSLKHPREKEAKRQALLELVDYVQAPAQAAGANAPTRLPDHVQEALVLAISANIFRPLPPALHESAAAIDPGAAPDDDEEPYLDPSWPHLQLVYELLLRYVVSPDTDTKVAKRYVDHAFVLRILDLFDSEDPREREYLKTVLHRIYGKFMVHRPFIRKAINNVFYRFIFETQRHNGIGELLEILGSIINGFALPMKEEHKLFLARALIPLHKPKSVAIYHQQLSYCIVQFVEKDYKLADTVIRGLLKYWPVTNCQKEVLFLGELEEVLEATQPAEFQRCMVPLFKQIGRCLNSSHFQVAERALFLWNNDHIVSLIAQNRVVIFPIIFEALERNIQSHWNQAVHGLTANVRKMFLDMDSELFEECQQQYMEKQAKAKEIQEQRESAWRQLEAVVAAKAAGDDMVLVN

SEQ ID NO: 9397 - protein, 382 aa, Zea mays
MGKPAESSSTSWSALFGFGCFSSSHADRSGDGPGKVASAGSRPPAPPAPLLSPDDLSLSLAGSDVLAFTVEELRVATRDFSMSNFVGEGGFGPVYKGRVDERVRPGLRQPQAVAVKLLDLEGSQGHKEWLAEVIFLGQLRHPHLVKLIGYCYQDEHRLLVYEFMARGSLEKHLFKRHSASLPWSTRMRIAIGAAKGLAFLHDAAKPVIYRDFKTSNILLDSDYTAKLSDFGLAKAGPGEDETHVSTRVMGTQGYAAPEYIMTGHLTTKSDVYSFGVVLLELLTGRKALDKNRPPREQSLVEWARPCLRDARRLERVMDRRLPRPTTPTRAAQKAAGIAHQCLSVSPKSRPQMSHVVQALESLLALDDAAVEPFVYTAPPESR

SEQ ID NO: 9398 - protein, 315 aa, Zea mays
  misc_feature (225)..(226): Xaa can be any naturally occurring amino acid
  misc_feature (233)..(233): Xaa can be any naturally occurring amino acid
  misc_feature (265)..(265): Xaa can be any naturally occurring amino acid
  misc_feature (278)..(278): Xaa can be any naturally occurring amino acid
  misc_feature (283)..(283): Xaa can be any naturally occurring amino acid
  misc_feature (290)..(291): Xaa can be any naturally occurring amino acid
  misc_feature (293)..(294): Xaa can be any naturally occurring amino acid
  misc_feature (296)..(297): Xaa can be any naturally occurring amino acid
  misc_feature (300)..(301): Xaa can be any naturally occurring amino acid
  misc_feature (305)..(307): Xaa can be any naturally occurring amino acid
NLHFPYFRTGLIFSTLFTSGMGFLSALSPNYLCLVALRFLVGVGVGGSHVFMSWFLEFVPAQNRGTWMVIFSLFWTLGTILEASLAWVVLPALNWRWLLVFTALPCFLLLPFFGLTPESPRYLCAQNRMSDATSVLERMANANQSALPPGVLTYNRQTKCDHDVLAPESECLLPVREKECTVDNAKSSESGSPAALRMLLSRELLRSTLLLWFVFYANSFAYYGXXLLTSHLXDANKSCASGVSFGLRQKEINLYKDTFITSLAXIPDLFLSAVLVDXFGQKXSMWTMMXXCXXFXXPLXXNRLXXXTTNSIVPQ

SEQ ID NO: 9399 - protein, 394 aa, Zea mays
RRSIGSVSVLLFVWRKHKRRKQARAPNGCMRSESSMQSYSKDLELGGSPHIFTYEELEEATDGFSDSRELGDGGFGTVYKGKLRDGRVVAVKRLYKNNYKRVEQFINEVDILSRLLHQNLVILYGCTSRSSRDLMLVYEFIPNGTVADHVHGSRASERGLTWPRRMSIAIETAEALAYLHAVEIIHRDVKTNNILLDNSFHVKVADFGLSRLYPPEVTHVSTVPQGTPGYVDPVYHQCYKLTEKSDVYSFGVVLVELVSSKPAVDMGRSHSEINLANMALNRIQNHEVGQLVDPELGYETDGETKRSIDLVAELAFRCLQLERDSRPSMKEVVEALNRIRNGDSLENNKTDRSSSSPKEDARLLTSSIQYSPDSVIHRFHSQSTTHSAASNASG

SEQ ID NO: 9400 - protein, 366 aa, Zea mays
  misc_feature (125)..(125): Xaa can be any naturally occurring amino acid
MGSRVSGPYMDSPPPPRPPSPPRHPPHPQGERHGGGEMPYQDADHRLRALVGSVEGFGRHAIGGLYGAIHRVTSLQDDGPGSLREACRAEEPLWIVFEVSGTIHLHSYLRVSSYKTIDGRGQRVXLTGKGLQLKSCHHVIICNLVFEGGRGHDVDGIQVKPDSTNIWIDRCTLADYDDGLIDITRQSTDITVSRCHFMRHDKTMLIGADPTHVGDRCIRVTIHHCFFDGTRQRHPRLRFGKVHLYNNYTRSWGIYAVCAGVEAQIVSQCNIYEAGGGPPKKTTVFKYMPEKAGDREDVVAGSISSEGDAFLNGALPCLIDNPGSVFRPEEYYQQWTMEPASPALKDIIQLCAGWQPVPPPPRNESA

SEQ ID NO: 9401 - protein, 406 aa, Zea mays
  misc_feature (54)..(54): Xaa can be any naturally occurring amino acid
MASNGCNGNGNGNGNGKAAPAGVVVPEIKFTKLFINGEFVDAASGKTFDTRDPXYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 9402 - protein, 584 aa, Zea mays
  misc_feature (244)..(244): Xaa can be any naturally occurring amino acid
  misc_feature (328)..(328): Xaa can be any naturally occurring amino acid
MGLFTVTKKATTPFDGQKPGTSGLRKKVTVFQQPHYLQNFVQSTFNALPVDQVRGATIVVSGDGRYFSKDAVQIITKMAAANGVRRVWVGQNSLMSTPAVSAVIRERVGADGSKATGAFILTASHNPGGPKEDFGIKYNMGNGGPAPESVTDKIFSNTTTISEYLISEDLPDVDISVVGVTSFSGPEGPFDVDVFDSSVDYIKLMKTIFDFEAIKKLLTSPKFTFCYDALHGVAGAYAKHIFVXELGADESSLLNCVPKEDFGGGHPDPNLTYAKELVERMGLGKSSSNVEPPEFGAAADGDADRNMILGKRFFVTPSDSVAIIAANXAVQSIPYFASGLKGVARSMPTSAALDVVAKNLNLKFFEVPTGWKFFGNLMDAGMCSICGEESFGTGSDHIREKDGIWAVLAWLSIIAFKNKDNLGGDKLVTVEDIVRQHWATYGRHYYTRYDYENVDAGAAKELMANLVSMQSSLSDVNKLVKEIRSDVSEVVAADEFEYKDPVDGSVSKHQGIRYLFGDGSRLVFRLSGTGSVGATIRVYIEQYERDSSKTGRDSQDALAPLVDVALKLSKMQEYTGRSAPTVIT

SEQ ID NO: 9403 - protein, 110 aa, Zea mays
LGDKLNREGAWDLAFYPEENIPFPSCPMGGSLEKGGDRSNLAFFSGCPDPSSDMFDPLAPVDDGSCPLEFFSQELWWSFFSIPGREAPPPNLFPPSLISKCLSSLSSFDT

SEQ ID NO: 9404 - protein, 120 aa, Zea mays
MHDFCFTIPYGFAVLAGGVLGYLRRGSTASLAGGAGAGALLLLAGFVSLKAFQKRRNSYVALALETLCALALTSVMGQRFLETSKIMPAGAVAGLSAVMSAFYLFKIATGGNHIPPPKKE

SEQ ID NO: 9405 - protein, 434 aa, Zea mays
MAGAQSWRTYLCCVGGSAAVEDDGSTLRRRRRRGCGGGSSKDSPRSSSSRMSLTSLGSSSETLSPEDLSLTLSGSNLHAFTYAELRSATASFSRANFLGCGGFGPVYRGAVGEALRPGLRAQDVAVKYLDLEGGAQGHKEWLAEVFFLGQLRHKNLVKLIGYCYEAEHRMLVYEFMSFGSLENHLFKSTNGALPWMTRMKIAVGAAKGLAFLHDADPQVIYRDFKASNILLDSDYNTKLSDFGLAKDGPQGDETHVTTRVMGTHGYAAPEYILTGHLTAKSDVYSFGVVLLELLSGRQSVDRSRRGREQNLVDWARPYLRRADRLHRFMDPGLEMQYSARAAEKAAGVAHQCLQSVPKARPTMRDVVDALEPLLALDDDVPMGPFVFTVGGGAAEGVAGDDNADAVGGRAGRARGTSCRPCTRRAHCGAGTPAP

SEQ ID NO: 9406 - protein, 536 aa, Zea mays
MAVAAPAAVSTGAGQGKEYPGGLTLYVLLTCAVAATGGLVCGYDIGISGGVTSMDAFLHKFFPSVYRKEQTARGGGSQYCKFDSQLLTAFTSSLYLAALAASFFVASVAHSLGRKWCMFGGGVSFLAGAALNAAAQDVAMLIVGRILLGIGVGFAGLSIPIYLSEMAPHHLRGTLNIGFQLMITVGIFSANLVNYGVDKIRGGWGWRLSLGLAAVPAAVITVGSLFLPDTPNSLIRRGYHEQARQVLARIRGADVDVADEYGDLVSASEASAAVRRPWLDVLGRRYRPQLTMAVLVPFFQQLTGINVIMFYAPVLFKTIGLGGDASLMSAVITGLVNIVATFVSIATVDRLGRRSLFLQGGCQMLVCQIVIGTLIGVQFGASGDGAAIPKASAATVVAFICIYVAGFAWSWGPLGVLVPSEIFPLEIRPAGQGINVAVNMMCTFAVAQAFLPMLCHLRFGLFYFFGGWVLVMTLFVAAFLPETKGVPVEKMGTVWRTHWFWGRFVADAGMDGRAGNRDSAFHKGKDIAIESRSRPV

SEQ ID NO: 9407 - protein, 324 aa, Zea mays
MAVDRVDGEEAFEEVDPTGRFGRYADVLGLGSVKKVYRGFDQEEGIEVAWNRVRLRSLADRDPGMVERLHAEVRLLRSLSHDHIIGFHKVWLDRDAGVLNFITEVCTSGSLREYRHRHRHVSVKALKKWARQILEGLNHLHTHDPCIIHRDLNCSNVFINGNNGQVKIGDLGLAAIVDKTHVAHTILGTPEFMAPELYTETYTESVDIYSYGMCVLEMVTREVPYAECGSVVQIFHNVTRGVPPAALKRLKDAELRGFIERCIGQPRNRPSAADLLQDPFFNGVRGGDDDDDATALADASSVVAAAPVPRPRSYVDDLAGLRLD

SEQ ID NO: 9408 - protein, 456 aa, Zea mays
  misc_feature (102)..(102): Xaa can be any naturally occurring amino acid
MASLQSFLAVKPAAGWAAPSRRARVAAFLAPPPPTTAAAVGAARRELSAASLAVVDGEARYLVGTYKRSRVVFEHGRGCKLYDTDGREYLDMAAGIAVTALXGHADPDVCATIAEQAGKVVHVSNVFYTKPQVELAKRLVEVSFADRAFFASTGTEANEAAIKFSRKFQRAAHPESGDPPTEFLAFSSSFHGRTMGAVALTSKSQYREPFAPVMPGVTFVDYGDLEAAKKFVRSGRVAAVFVEPVQGEGGIHSATREFLQGLRDACDEAGALLVFDEVQCGFGRTGHLWAHEAYGVEPDIMTLAKPLANGIPIGVVLVKEKIAAAINYGDHGTTFGGGPLACQTAITVFDKITRPGFLAEVSRKGESFKQLLRAKLSGNPHVREVRGVGLLVGVELDVPAGPLVDACLDAGVVVLTAGKGNVVRLVPPLIVSEKELEHAADVIRDCLPALDVVAAA

SEQ ID NO: 9409 - protein, 447 aa, Zea mays
MALLVRRARRAATKAAVSLAGRTGSVELAIPAHFRCPISLDLMRDPVTAPAGITYDRESIEAWLDTGRATCPVTHAPLRHEDLVPNHAIRRVIQDWCVANRSRGVERIPTPKIPVTPVQASELLFDLAGSARRRDAAARCVEVVTKIKVLARDSERNRSCFASIGTGRVLAAAYESLAAAAADAAAPAGRVLEDILAALVCMMPLDEEAARTLALPTSLGSLVAIAENGSLAGRLNAVLAIKEVVSCDGAATDLSGKVDEIVDALAKIIKSPICPQATKAGMVATYHLALYDERVAARLAAAGLVPVLVEVLVDADKSMSEKALAVLDAVLASEEGRASARAHALAVPMLIKKMFRVSDLATQLAVSAMWRLGKAHSDGEDDGAVTRCLVEALGVGAFQKLLLLLQVGCRDATKEKATELLKLLNKYKSVGECVDAVDFRGLNKLSS

SEQ ID NO: 9410 - protein, 311 aa, Zea mays
FQVMIVDYKLTYPSGAATAYLINGFHAPEGSERAKKQVRTLGKYFSLSFLWAFFQWFYTAGNHCGFGSFPTLGLEAYKNRFFFDFSPTYIGVGMICPYIVNVSLLLGGIMSWGIMWPLISTKKGSWYPETLPDSSLHGLHGYRVFLTISVILGDGLYNILKVLYSTIEAFVSRYRNRKANTLPVSNDGTPADATTETESFDDKRRLELFTKDQIPKTVALGGYVVLAAITIGCLPLIIPQLKWYHILVAYIVSPALAFCNAYGCGLTNWSFASAYGKLAIFSFGAWAGASHSGVIVALAACGVMMSIVGTA

SEQ ID NO: 9411 - protein, 154 aa, Zea mays
  misc_feature (85)..(86): Xaa can be any naturally occurring amino acid
  misc_feature (94)..(94): Xaa can be any naturally occurring amino acid
  misc_feature (98)..(98): Xaa can be any naturally occurring amino acid
  misc_feature (101)..(101): Xaa can be any naturally occurring amino acid
  misc_feature (109)..(112): Xaa can be any naturally occurring amino acid
  misc_feature (114)..(115): Xaa can be any naturally occurring amino acid
  misc_feature (119)..(119): Xaa can be any naturally occurring amino acid
  misc_feature (121)..(121): Xaa can be any naturally occurring amino acid
  misc_feature (125)..(127): Xaa can be any naturally occurring amino acid
  misc_feature (130)..(133): Xaa can be any naturally occurring amino acid
  misc_feature (136)..(136): Xaa can be any naturally occurring amino acid
  misc_feature (139)..(140): Xaa can be any naturally occurring amino acid
  misc_feature (142)..(143): Xaa can be any naturally occurring amino acid
  misc_feature (146)..(146): Xaa can be any naturally occurring amino acid
  misc_feature (148)..(148): Xaa can be any naturally occurring amino acid
  misc_feature (151)..(151): Xaa can be any naturally occurring amino acid
GTQPAALPHTKPGGGLPQDRGAGEAQPPPQPPGPAADDAAASGGERQAARDRAQQHRTGGRRPAEKKAGAAETAAAAAAANGKAXXHAAKGPGXATPXEAXEKGPREKXXXXTXXNNGXGXNKPXXXATXXXXPSXPTXXQXXHRXPXTHXGDE

SEQ ID NO: 9412 - protein, 293 aa, Zea mays
MMPYGTAAEAEAALGRSMTWAEALWFRYSAGMPDLWLTWHVSLVYLVLYALVPLPVMVIQKLAPGYALRHKLQPGVPEPSPVSTYVEYIRDSRGVTLAALGPFPLIYSIAFKLFGVRTGLPLPSVWETATHLVVYSLVEDYTSYWLHRFLHTRWGYEKIHRVHHEKTAPSGFAAAYATGTELSLYLTTLFLGPAIVPSHVTTHWLLFSIRIMEAFDTHSGYHFPFSLARFIPFYGGAEFHDYHHYAGEKTRSNFSSVFTYCDYIYGTNKGYMYHKRSLAELKTKEAEHSGKED

SEQ ID NO: 9413 - protein, 345 aa, Zea mays
MSTGRTEEAAGSAETACVTGAGGYIASWLVKLLLSRGYTVHGTVRDLSDNKTAHLKRLENASENLKLFKADVLDYDAMAAAVAGCQGVFHVATPVPSGKITDPEREMLGPAVTGTINALKAASAANARRVVVVSSMVAVEINPKDWPKDKIKDENCWSDKEFCRNEENWYSVAKISSEEAALEYAKQTGLDVVTVNPAVVFGPLLQPTLNTSCQFLVYFLKGGPDRMRDKLWHIVDVRDTADALLLVYETPQASGRHICAPHFISARDLLELLKTMYPDDYPFISKESIYDMEHPAPMTSDKLKKLGWKVRPLKETIAETVEFCQHAGFLEDVEGFRFPPLYNII

SEQ ID NO: 9414 - protein, 435 aa, Zea mays
MPIQKILARTIFDSRGNPTVEVDLTTDKGLFRAAVPSGASTGIYEALELRDGDKANYHGKSVFKAVSNVNDVIAPALLAQNFNLTQQRDIDNFMLNLDGTENKSKLGANAILGVSLAVCKAGAAEAGLPLYAYIAKLAGNDKIILPVPAFNVINGGEHAGNKLPMQEFMILPTGAATFREAMKIGSEVYHHLKAVIKKRFGLDATAVGDEGGFAPNILDAKDALELIKTAVEVSGHASKIEIGMDVAASEMYKRDQKKYDLDFKNPQSDPTKWITSAELGALYQKFATEYPIVSIEDPFDQDDWEAWTALTGAVNFQIVGDDLTVTNPKRIQSAVEKKACNCLLLKVNQIGSVSESIDAHLLAKKNGWGTMVSHRSGETEDTTIADLVVGLSAGQIKTGAPCRSERLAKYNQILRIEEELGDKAIYAGKNFRHPA

SEQ ID NO: 9415 - protein, 429 aa, Zea mays
PPVQRKYRFKKKKKKKKKKKKKKKKKKKFLAAYSAGMFFAGHIGDRMDLRVFLTVGMAGTAVFTTLFGAGYWLNVHSFYYFLVIQMVSGLFQSVGWPSVVAVVGNWFGKSKRGLIMGIWNAHTSVGNIAGSLLAAFLLKFGWGWSFAVPSLIMALVGLMVYVFLPVSPEAMEIDSDGGELNCEKDAVKEPLLEPGQEVKHSAVGFLEAWRIPGVAPFALCLFFSKLVAYTFLYWLPFYISHTRIGGVYLSDAMAGSLSTIFDVGGVLGGVLAGHISDRLNARAITAASFTYCAIPALFLYRTYGSMSMAWNVSLMFVTGMFVNGPYALITTAVSADLGTHSSLNGNSRALATVTAIIDGTGSVGAAIGPLVTGYVSSRSWSAVFTMLMAAALLAGLLLSKLVCAELQGKTHSSVSKDAGGEHGAYSDEV

SEQ ID NO: 9416 - protein, 561 aa, Zea mays
  misc_feature (85)..(85): Xaa can be any naturally occurring amino acid
  misc_feature (118)..(118): Xaa can be any naturally occurring amino acid
  misc_feature (136)..(136): Xaa can be any naturally occurring amino acid
  misc_feature (549)..(549): Xaa can be any naturally occurring amino acid
LRSVDRSIDRSAIMAREEQALLSTEIVNRGVEPSGPDAGSPAFSVRVRRRLPDFLQSVNLKYVRLGYHYLISHGVYLATIPVIVXLVCGAELGSLSRDELWRKVWGEATYDLATVLAXFLAVLAFTISVYIMSRPXRPVYLIDFAWLQARPTELKVSKAEFIDLARKSGKFDEDSLAFQSRLLAKSGIGDESYMPRCVFEPNASCATMKEGRAEASTAMFAALDELFDKCRVRPKDVGVLVVNCSLFNPTPSLSAMIVNHYKMRGNILSYNLGGMGCSAGVIAIDLARDMLQASGAGLAVVVSTEAVSFTWYPGKRRSMLIPNAFFRAGCAAVLLSNRRRDFHRAKYQLEHVVRTHKGADDRAFRSVYQEEDEQRIKGLSISRDLLEVGGHALKTNITTLGPLVLPFSEQLLFFAGVLFRHLFPSKASTPAPPTTPGDASAAAPYIPDFKRAFEHFCMHAASRDVLEHLQSNLGLRNADLEASRAALHRFGNTSSSSIWYELAYLEAKGRVRRGDRVWQLAFGSGFKCNSAVWRAVRRVRRPARSPWLXDCVDQYPARMDA

SEQ ID NO: 9417 - protein, 207 aa, Zea mays
MEVEACYNYGFLPADRGRHQPPPPPHATLPHAAEDAGELWEYFPCPFCYIEVEVPFICNHLQEEHCFDTRNAVCPICANNLGKDMAAHFRLQHTHLLKRRKPYRPSSCPAAATSPATYQVNSYYEEAEPQQHYSRPYKDPAPDPLLSQFICSVDAVPGDDNAQKDDKRLKLNKGATASDDDASSKLGLEERLQRIDFLTEILMSTIL

SEQ ID NO: 9418 - protein, 304 aa, Zea mays
  misc_feature (177)..(177): Xaa can be any naturally occurring amino acid
MAAAPSSLVSSHLSRLADLRRAAAPATPTVPQQLRVGFSRRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIXELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 9419 - protein, 210 aa, Zea mays
MAKEFPVPPVVFTPSTPTHRRHPPPGMGVSPPPAFAPPRPSTSSAANPLPFMSFDVSAAAASSSSAPPLFAGPIGVGGSGASFEDEPPLLEELGINTRQIWRKTISILHPFRSTDPSLHADADLSGPFLFLLSFGLFQLLAGKFHFGIVLGWVTVASLFLYFVFSMLSGGRRGDLDLYRCVSLVGYCMLPMVIFSAVSLFLPRGGGFIFG

SEQ ID NO: 9420 - protein, 266 aa, Zea mays
NSFPPSSSNFIVFNNDVEELRSIAPADVKQSFDIRSIIARIVDGSEFDEFKKLYGTTLVTGFARICGQPVGIIGNNGILFTESALKGSHFIELCAQRHIPLIFLQNITGFMVGSKSEASGIAKAGAKMVMAVSCAKVPKITIIVGGSFGAGNYGMCGRAYSPNFLFLWPTARISVMGGIQAAGVLAQIEKNNKRRQGVEWSKDEEEAFKAKVVEAYDREGSPYYSTARLWDDGVIDPADTRRVLSLCLSASAKPVPEDTRYGVFRM

SEQ ID NO: 9421 - protein, 427 aa, Zea mays
MDIEADGRFGNKRVHNRLGPGSGGAPPSTNGKVCNYWRAGRCNRFPCPFLHSELPEAAPPKRPTGPGGNVWRNPNTGGRGGGHHNRWGKGPGGGSGIASHKPPERPCKYFLAGTECSYGERCRYPHSYCISDSIAMLTLLKGHEQGVTGIALPAGSDKLYSGSKDGTVRMWDCQTGQCAGVITMGREVGCMIIEGPWLFVGIPDAVKVWNMQTAAEMSLTGPTGQVYALAVASELLFAATQAGRILAWRFSAATNCFEPAASLDGHKLAVVSLIVGGMRLYSASMDKTIRLWDLATLQCIQTLSDHTDVVMSVLCWDQFLLSCSLDQTIKVWAATESGNLEVTYTHKEDQGALALSGMPDAQSKPVLLCSLNDNTVRLYDLPSFSDRGRLFSKKEIRAIQMGPGGLFFTGDGTGELKVWQWVDLAQT

SEQ ID NO: 9422 - protein, 253 aa, Zea mays
MGRKFFVGGNWKCNGTTDQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEQREAGSTMDVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 9423 - protein, 279 aa, Zea mays
SCEAQLRALPDHAARCRYLSWASHPACAPRGYVHYLRLFYCAFGGARWLGAAALALWLLLLFYLLGDTASQYFCAALQGLSAALRLPPAIAGVTLLSLGNGAPDVLSSVVAFAAADADAGDVGLSSVLGGALFVSTVVAGVVAIVASSSGTRGGPVEIERAGFVRDVCFLLVALCYLLAVLLTGSVTVWAAASFLSLYAAYVLLVWTSHCCAEDGTTKPAVDDVAAAGPDPDLAAPLLAEDPDEPPALPISSKHAEAAAPPRRGRSSLARHALHALQAC

SEQ ID NO: 9424 - protein, 401 aa, Zea mays
QDTFLCTDQKSNFQKILLSTIACLLLLTIGALGWACKIRGKWHKKKIQTRRMLEYLISTDEAGGKNIEFPFITFENIVTATDNFSDCNILGKGGFGKVYKGMLEGTKEVAIKRLSKSSGQGAEEFRNEVILIAKLQHKNLVKLLGCCVHEDEKLLVYEYLPNKSLDYFLFDSARKSTLQWPTRFKIIHGVARGIMYLHQDSRLTIIHRDLKASNILLDKDMSPKISDFGMARIFSSDQLHANTNRVVGTYGYMSPEYAMEGAFSVKSDTYSFGVLMLEIVSGLKISSPHLHMDFPNLRAYAWNMWKEGKIEDLVDSSVMENYSLDEVSQCVHIGLLCVQDSPSFRPLMSVVVSMLENKMTTLPTPSQPVYFALKDPYQPGKAVGNKELSIYDMSVTVPEGR

SEQ ID NO: 9425 - protein, 210 aa, Zea mays
  misc_feature (142)..(142): Xaa can be any naturally occurring amino acid
PRVRPRVRAGVFPRVRNSISNNSDGETFISADDLRINLRPGVDLEISNQSFNIVDVKPANMEDLTEVITCAEFHPTHCNTLAYSSSKGTIRLIDLRQSALCDNHAKLFEEHEAPGSRSFFTEIIASVSDIKFARDGRHILSXVDYMTLKLWDLNMDSGPVATFQVHEYLRPKLCDLYENDSTFDKFECCLSGDGLHVATGSYRYILILAL

SEQ ID NO: 9426 - protein, 282 aa, Zea mays
MDGLQQTVGLRLLRRRLYKRLRRAFTRHHHPLPTILPHLLPSLPHLRAVSCGKDPSHRQDRMQSKHRVFAEDLLLAAEGEDHFDRVPDSLVLLIFNKVADARSLGRCSAVSRRFNALVPLVDDACLRIDRVIPAGDGDGDALLGLAGAPRPRAVLSHLLKAVLLAVLKPFAHCDAKSAAAVHKHAQVQAQQQHHSPAQVLKNFSSIRNLRMELPVSDVGTDDGVVLRWKAVFGSTLQSCVILGGGGRKGLDEFAANAFDGPLREAVAALSKRRTPAGEMNGF

SEQ ID NO: 9427 - protein, 384 aa, Zea mays
MFASICRRRLLRLCQIPFGTGAIPSDALPHCHSLATIADAPVSEPCAALVSCGLSPAAAVAHRLPIRSTAKADAVRALLRSYGFTDAEVADLVRRLSQILSVDPDRIRPKLDLFASLGVKPRRLARYPALLTRSLDKHLVPCIQFLRNILSTDEDVCLAISRTPRALSAGLEKIMRPAVDTLRRLGLPDESISKLVVIEMGVLMMSPDRICQIFEALKEFGLGVTEKRFPYGIRALCCISREKWLHRVALYRSFGVSEGELQRAFKKQPNIVNFSDEIIKKKIRFFLDVLKLELSEVMEQPAIIGYSLERNIIPRCAVLSLLMREGKIGPNVKLISALLGSANMFSTRYVLRYANELPDVVKAYEGKITFDVFREQDLLVPLKL

SEQ ID NO: 9428 - protein, 375 aa, Zea mays
RLRLQFPEARIRIPPTTSIPFPSLPSCPAGSPARRLCPDPGDMPRYDDRYGGTRLYVGRLAPRTRSRDLEYLFGKYGRIREVELKRDYAFIEFSEHRDADEARYQLDGRDVDGSRIVVEFAKGVPRGPGGSREYMGRGPPPGTGRCFNCGMDGHWARDCKAGDWKNKCYRCGERGHIERNCQNSPRSVRRERSYSRSPSPRRGRGRSPSYSRSRSRSRSRSYSRSRSLSGSPRGGRRDRDDRRSRSLSYSRSPMRSPPAKEKERSPTPGGSRSPRSRSPQDQVMSPPPKDNGDRNGSDRGDSPRGRENSRSRSRSRSPSGGNRSPAANGRSPSPRGDRTPSPMADRSPSPKGNGNNDGGDDDTGRGGSPTGSKSP

SEQ ID NO: 9429 - protein, 172 aa, Zea mays
SLGGQCARRWFDEGDTSHLVNLGKYVSAMLAAGAKVAYEKDRSLASLSLLVAVSSGATVYQLYWDFVKDWGLLQPNSKNPWLRNDLILRRKSIYYLSMGLNLVLRLAWLQTIIHPNFGSLDSRVTSFFLAALEVIRRGHWNFYRLENEHLNNAGKFRAVKTVPLPFHEVDDD

SEQ ID NO: 9430 - protein, 351 aa, Zea mays
  misc_feature (119)..(119): Xaa can be any naturally occurring amino acid
  misc_feature (138)..(138): Xaa can be any naturally occurring amino acid
  misc_feature (171)..(171): Xaa can be any naturally occurring amino acid
  misc_feature (264)..(264): Xaa can be any naturally occurring amino acid
MSVTSLLAQPIPSLFAPAPAPSRARRNRTSRRRFLAATKLTMDGTSFDLTEHEGSNLSPFLLKLFNDSCETKVLPGVHNFVATLIEGRDQKKRPTEFTMNQVLQPFVSEKFNFTKVSPXKVIFRFNDTEKDPAQYFEXVPDTVSYTSGCSMAIDNCPVYCNPQSKSYISFXAYYLKVQYPVEKAITEKLKTLGNSVSIFHLVDYPVNGFVFEGGASLEDLSDVVSKVCIFLQENNRPFNVLISESGKRIFLLPQVFPCDLIMCXCLSPPKSIGQCYAEKQLLKKASQEFLDMRINPAIWELSGHLVLKRRKDYEEASEANICRFLVEAALSETEFQELNRCVLDFLTSSLG

SEQ ID NO: 9431 - protein, 257 aa, Zea mays
MASRKFFVGGNWKCNGTGEDVKKIVTVLNQAEVPSEDVVAEVVVSPPFVFLQQVKGLLRLDFAVAAQNCWVRKGGAFTGEISAEMLVNLQVPWVILGHSERRALLGESSDFVADKVAYALTQGLKVIACIGETLEQREAGTTMDVVAAQTKAIAEKISDWTNIVLAYEPVWAIGTGKVATPAQAQEVHDGLRKWLHSNVSPAVAELTRIIYGGSVNGANCKELAAQPDVDGFLVGGASLKPEFVDIIKSATVKSSSA

SEQ ID NO: 9432 - protein, 243 aa, Sulfolobus solfataricus
MGKMLVVYMTLGYPNVQSFKDFIIGAVENGADILELGIPPKYAKYDGPVIRKSYDKVKGLDIWPLIEDIRKDVGVPIIALTYLEDWVDQLENFLNMIKDVKLDGILFPDLLIDYIDDLDKIDGIIKNKGLKNVIFTSPSVPDLLIHKVSKISDLFLYYGVRPTTGVPIPVSVKQLINRVRNLVENKLIVGFGLSSESDLRDALSAGADGIAIGTVFIEEIERNGVKSAINLVKKFRAILDEYK

SEQ ID NO: 9433 - protein, 249 aa, Vitis vinifera
MPKIAFGRFDDSFSLASFKAYLAEFHPTILFVFAGVGSVMAYNKLTSDAALDPAGLVAVAVAHGFALFVAVAISANISGGHVNPAVTFGLVVGGQITILTGILYWIAQLVGSILACFLLKLVTGGLTTPVHSLGAGVGVIDAIVFEIVITFALVYTVYATAVDPKKGSLGIIAPIAIGLVVGANILAAGPFSGGSMNPARSFGPAVVSGDFKDNWIYWVGPLIGGGMGGSVYAIMYMGSDHQPLASSEF

SEQ ID NO: 9434 - protein, 354 aa, Hordeum vulgare
MDGNKGPVVVTGASGFVGSWLVMKLLQAGYTVRATVRDPANVEKTKPLLELPGAKERLSIWKADLSEDGSFNEAIAGCTGVFHVATPMDFDSQDPENEVIKPTVEGMLSIMRACKEAGTVKRIVFTSSAGSVNIEERPRPAYDQDNWSDIDYCRRVKMTGWMYFVSKALAEKAAMEYASENGLDFISIIPTLVVGPFLSAGMPPSLVTALALITGNEAHYSILKQVQLVHLDDLCDAMTFLFEHPEANGRYICSSHDATIHGLARMLQDRFPEYDIPQKFAGVDDNLQPIHFSSKKLLDHGFSFRYTTEDMFDAAIHTCRDKGLIPLGDVPAPAAGGKLGALAAGEGQAIGAET

SEQ ID NO: 9435 - protein, 467 aa, Vigna radiata
MRLLSTIATCNSHGQDSSYFLGWQEYEKNPYDELHNPKGIIQMGLAENQLSFDLLESWLAKNPDVAGFKRDGKSIFRELALFQDYHGLPSFKKALVDFMSEIRGNKVTFDPNHIVLTAGSTSANETLMFCLAEQGDAFLLPTPYYPGFDRDLKWRTGAEIVPIQCTSSNNFQITEPALKQAYEEARKRNLRVKGLLVTNPSNPLGTTMSRSELNLLVDFIKEKKDTHLISDEIYSGTVFSSPGFVSVMEILKERNDTEEIWNRVHVVYSLSKDLGLPGFRVGAIYSENDTVVAAATKMSSFGLVSSQTQYLLSAMLGDKKFARNYIVENQKRLKRRQRMMVSGLQKAGISCLESNAGLFCWVDMRHLLHSNTFEAEMELWKKIVYQVGLNISPGSSCHCTEPGWFRVCFANMSEETLTLAMKRLKNFVVESTCTQRSALFNGTSKRKSLTKWVFRLSSRDHREQEER

SEQ ID NO: 9436 - protein, 444 aa, Saccharomyces cerevisiae
MKQRFIRQFTNLMSTSRPKVVANKYFTSNTAKDVWSLTNEAAAKAANNSKNQGRELINLGQGFFSYSPPQFAIKEAQKALDIPMVNQYSPTRGRPSLINSLIKLYSPIYNTELKAENVTVTTGANEGILSCLMGLLNAGDEVIVFEPFFDQYIPNIELCGGKVVYVPINPPKELDQRNTRGEEWTIDFEQFEKAITSKTKAVIINTPHNPIGKVFTREELTTLGNICVKHNVVIISDEVYEHLYFTDSFTRIATLSPEIGQLTLTVGSAGKSFAATGWRIGWVLSLNAELLSYAAKAHTRICFASPSPLQEACANSINDALKIGYFEKMRQEYINKFKIFTSIFDELGLPYTAPEGTYFVLVDFSKVKIPEDYPYPEEILNKGKDFRISHWLINELGVVAIPPTEFYIKEHEKAAENLLRFAVCKDDAYLENAVERLKLLKDYL

SEQ ID NO: 9437 - protein, 279 aa, Saccharomyces cerevisiae
MSIVSLLGIKVLNNPAKFTDPYEFEITFECLESLKHDLEWKLTYVGSSRSLDHDQELDSILVGPVPVGVNKFVFSADPPSAELIPASELVSVTVILLSCSYDGREFVRVGYYVNNEYDEEELRENPPAKVQVDHIVRNILAEKPRVTRFNIVWDNENEGDLYPPEQPGVDDEEEEDDEEEDDDEDDEDDEDDDQEDGEGEAEEAAEEEEEEEEKTEDNETNLEEEEEDIENSDGDEEEGEEEVGSVDKNEDGNDKKRRKIEGGSTDIESTPKDAARSTN

SEQ ID NO: 9438 - protein, 498 aa, Ipomoea batatas
APIPGVMPIGNYVSLYVMLPLGVVNADNVFPDKEKVEDELKQVKAGGCDGVMVDVWWGIIEAKGPKQYDWSAYRELFQLVKKCGLKIQAIMSFHQCGGNVGDAVFIPIPQWILQIGDKNPDIFYTNRAGNRNQEYLSLGVDNQRLFQGRTALEMYRDFMESFRDNMADFLKAGDIVDIEVGCGAAGELRYPSYPETQGWVFPGIGEFQCYDKYMVADWKEAVKQAGNADWEMPGKGAGTYNDTPDKTEFFRPNGTYKTDMGKFFLTWYSNKLIIHGDQVLEEANKVFVGLRVNIAAKVSGIHWWYNHVSHAAELTAGFYNVAGRDGYRPIARMLARHHATLNFTCLEMRDSEQPAEAKSAPQELVQQVLSSGWKEYIDVAGENALPRYDATAYNQMLLKLRPNGVNLNGPPKLKMSGLTYLRLSDDLLQTDNFELFKKFVKKMHADLDPSPNAISPAVLERSNSAITIDELMEATKGSRPFPWYDVTDMPVDGSNPFD

SEQ ID NO: 9439 - protein, 214 aa, Escherichia coli
MRIILLGAPVAGKGTQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAGNTKYAKVDGTKPVAEVRADLEKILG

SEQ ID NO: 9440 - protein, 214 aa, Escherichia coli
MRIILLGALVAGKGTQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAGNTKYAKVDGTKPVAEVRADLEKILG

SEQ ID NO: 9441 - protein, 375 aa, Arabidopsis thaliana
MSASSSSFEQPQVITCNAAVAWRAGEPLVMEEVEVSPPQPLEIRIKVVCTSLCRSDLSAWESQSLLPRIFGHEAAGIVESIGEGVTEFEKGDHVLAVFTGECGSCRHCISGKSNMCQVLGMERKGLMHSDQKTRFSIKGKPVYHYCAVSSFSEYTVVHSGCAVKVDPLAPLHKICLLSCGVAAGLGAAWNVADVQKGSSVVIFGLGTVGAKLRGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 9442 - protein, 414 aa, Streptomyces coelicolor A3(2)
MTPAGSELRRTLGLGDAAVVGLGSMIGAGIFAALAPAAGAAGSGLLLALAGAAVVAYCNALSSARLAARYPASGGTYVYGRERLGEFWGYLAGWSFIVGKTASCAAMALTVGAYVWPEQAHTVAVAAVVALTAVNYGGIQKSAWLTRVIVAVVLAVLASVVVVCLGSGRSDAGRLDIGLSGGAGGVLQAAGLLFFAFAGYARIATLGEEVRDPRRTIPRAIPLALGLTLAVYGCVAVAVLSVLGPVGLGQATAPLADAVRTAGLPGLVPVVRAGAAVAALGSLLALILGVSRTTLAMARDRHLPQALAAVHPRFQVPHRAELAVGAVVAVLAATVDVRGAIGFSSFGVLVYYAVANASAWTLDPSRLSRVVPALGLIGCVVLAFSLPAVSVVVGVGVLAVGVVAYGVRGQQVPR

SEQ ID NO: 9443 - protein, 206 aa, Kluyveromyces lactis
MNSEYDYLFKLLLIGNSGVGKSCLLLRFSDDTYTNDYISTIGVDFKIKTVELDGKTVKLQIWDTAGQERFRTITSSYYRGSHGIIIVYDVTDRESFNGVKMWLQEIDRIATSTVLKLLVGNKCDLKDKRVVEYDVAKEFADANKMPFLETSALDSTNVEDAFLTMARQIKESMSQQNLNETTQKKEDKGNVNLKGQSLTNTGGGCC

SEQ ID NO: 9444 - protein, 131 aa, Oryza sativa (japonica cultivar-group)
MRRPWKHPTKARHGAADLCLREVGLLLPRRFARRAAASEDLVMRLQVHRKLNRHTGCVNTVGFNADGDTLISGSDDQMVMLWDWDTGAIKLQFPSGHSNNVFQARFMPYTNDQTIVTCAADGEVNGRIVLF

SEQ ID NO: 9445 - protein, 477 aa, Eremosyne pectinata
  misc_feature (1)..(6): Xaa can be any naturally occurring amino acid
  misc_feature (21)..(21): Xaa can be any naturally occurring amino acid
  misc_feature (388)..(388): Xaa can be any naturally occurring amino acid
XXXXXXTKASAGFKAGVKDYXLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDCFLFCAEAIYKAQAETGEIKGHYLNATAGTCEEMLKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMXALTEIFGDDSVLQFGGGTLGHPWGNAPGAVANRVALEACVQARNEGRDLASEGNEIIREACKWSPELAAACEVWKEIKFEFEAMDTLDK

SEQ ID NO: 9446 - protein, 236 aa, Saccharomyces cerevisiae
MSGENRAVVPIESNPEVFTNFAHKLGLKNEWAYFDIYSLTEPELLAFLPRPVKAIVLLFPINEDRKSSTSQQITSSYDVIWFKQSVKNACGLYAILHSLSNNQSLLEPGSDLDNFLKSQSDTSSSKNRFDDVTTDQFVLNVIKENVQTFSTGQSEAPEATADTNLHYITYVEENGGIFELDGRNLSGPLYLGKSDPTATDLIEQELVRVRVASYMENANEEDVLNFAMLGLGPNWE

SEQ ID NO: 9447 - protein, 1442 aa, Saccharomyces cerevisiae
MTASDLLTLPQLLAQYSSSAPQNKVFYTTSTKNSHSSFKGLESVATDATHLLNNQDPLNTIKDQLSKDILTTVFTDETTLVKSIHHLYSLPNKLPLVITVDLNLQDYSAIPALKDLSFPILISSDLQTAISNADSSYKIATSSLTPVFHFLNLEKIGTSTAIEQDIDFPTLEIANEETKVALSEATDSLTNFELVKGKESITTVIVNLSPYDAEFSSVLPSNVGLIKIRVYRPWNFSKFLEILPSSVTKIAVLQGVSKKSQSNEFQPFLLDFFGNFNELVSRNIEQVVLTNIGNVNDYGNVINTVISNINKKEPDNNLFLGESNEKAEEQAEVTQLISSVKKVVNLEDAYIKVLKQLFSSNLQILNQFSSETIEPSNPEFGFGRFLKQEAQREELISLAKTSLDPSLYLSEDANKIVQLLSKWLSFNGRDLDEAQLQEANATGLEIFQLLQSNQDSSTVLKFLKIAPTSDSFIFKSSWLIGSDAWSYDLGHSGIQQVLSSRKNINVLLIDSEPYDHRKQNQDRKKDVGLYAMNYYSAYVASVAVYASYTQLLTAIIEASKYNGPSIVLAYLPYNSENDTPLEVLKETKNAVESGYWPLYRFNPVYDDPSTDKEAFSLDSSVIRKQLQDFLDRENKLTLLTRKDPSLSRNLKQSAGDALTRKQEKRSKAAFDQLLEGLSGPPLHVYYASDGGNAANLAKRLAARASARGLKATVLSMDDIILEELPGEENVVFITSTAGQGEFPQDGKSFWEALKNDTDLDLASLNVAVFGLGDSEYWPRKEDKHYFNKPSQDLFKRLELLSAKALIPLGLGDDQDADGFQTAYSEWEPKLWEALGVSGAAVDDEPKPVTNEDIKRESNFLRGTISENLKDTSSGGVTHANEQLMKFHGIYTQDDRDIREIRKSQGLEPYYMFMARARLPGGKTTPQQWLALDHLSDTSGNGTLKLTTRATFQIHGVLKKNLKHTLRGMNAVLMDTLAAAGDVNRNVMVSALPTNAKVHQQIADMGKLISDHFLPKTTAYHEVWLEGPEEQDDDPSWPSIFENRKDGPRKKKTLVSGNALVDIEPIYGPTYLPRKFKFNIAVPPYNDVDVLSIDVGLVAIVNPETQIVEGYNVFVGGGMGTTHNNKKTYPRLGSCLGFVKTEDIIPPLEGIVIVQRDHGDRKDRKHARLKYTVDDMGVEGFKQKVEEYWGKKFEPERPFEFKSNIDYFGWIKDETGLNHFTAFIENGRVEDTPDLPQKTGIRKVAEYMLKTNSGHFRLTGNQHLVISNITDEHVAGIKSILKTYKLDNTDFSGLRLSSSSCVGLPTCGLAFAESERFLPDIITQLEDCLEEYGLRHDSIIMRMTGCPNGCSRPWLGELALVGKAPHTYNLMLGGGYLGQRLNKLYKANVKDEEIVDYIKPLFKRYALEREEGEHFGDFCIRVGIIKPTTEGKYFHEDVSEDAY

SEQ ID NO: 9448 - protein, 361 aa, Saccharomyces cerevisiae
MISANSLLISTLCAFAIATPLSKRDSCTLTGSSLSSLSTVKKCSSIVIKDLTVPAGQTLDLTGLSSGTTVTFEGTTTFQYKEWSGPLISISGSKISVVGASGHTIDGQGAKWWDGLGDSGKVKPKFVKLALTGTSKVTGLNIKNAPHQVFSINKCSDLTISDITIDIRDGDSAGGHNTDGFDVGSSSNVLIQGCTVYNQDDCIAVNSGSTIKFMNNYCYNGHGISVGSVGGRSDNTVNGFWAENNHVINSDNGLRIKTVEGATGTVTNVNFISNKISGIKSYGIVIEGDYLNSKTTGTATGGVPISNLVMKDITGSVNSTAKRVKILVKNATNWQWSGVSITGGSSYSGCSGIPSGSGASC

SEQ ID NO: 9449 - protein, 179 aa, Bacillus halodurans C-125
MRDEIQEILITEEEIQAKIVELGKQITEEYEGKFPLVIGVLKGAMPFMGDLTKRIDTHLEMDFMDVSSYGKGTVSSGEVKIIKDLDTSVEGRDVLIVEDIIDSGLTLSYLIELFHYRKAKSVKVVTLLDKPEGRKVDLVPDMAGFTVPDAFVVGYGLDYAERYRNLPFIGILKPEVYES

SEQ ID NO: 9450 - protein, 307 aa, Bacillus halodurans C-125
MRVANSITDLIGQTPLVKLNRLVSDKHADVYLKLEFFNPGSSVKDRIALAMIEAAEKSGALKPDDTIVEPTSGNTGIGLAMVAAAKGYKTKLVMPETMSLERRNLLRAYGAELVLTPGPEGMGGAIRKATELAQENGYFMPQQFENEANPEIHRETTGRELLEQVDGQLDGFVSGIGTGGTITGAGGLLKENFPNLHIAAVEPADSPVLSGGNPGPHKIQGIGAGFVPKILDTDIYDEVIKVSTEQAFEYARRAAKEEGILGGISSGAAIYAALQVAEKLGPGKKVVAVIPSNGERYLSTPLYQFED

SEQ ID NO: 9451 - protein, 217 aa, Bacillus halodurans C-125
MNLILMGLPGAGKGTQAEKIIEKYGIPHISTGDMFRAAMKNETELGLKAKSYMDAGELVPDEVTIGIVRDRLSQDDCQNGFLLDGFPRTVAQAEALEDILASLDKKLDYVINIDVPEQLLMDRLTGRRVSPTSGRTYHVIFNPPKVEGICDVDGSELIQRDDDKPETVKKRLEVNQKQAQPLIDFYSEKGYLQNINGDQDISRVFEDINELLKGLSS

SEQ ID NO: 9452 - protein, 247 aa, Bacillus halodurans C-125
MIAVQSLYKKFGEVEVLKGLDLTVERGKVVVVIGPSGSGKTTLLRCLNILETPTSGSVQIENQTLDFSGKVSSKEIANFRRLTGMVFQSYNLFPHMTVLQNVMEGPMTVKKEAKAQVEEKAKQLLAKVGLADKETVYPFQLSGGQQQRVGIARALAMEPKVMLFDEPTSALDPELVGEVLRVMKELAEEGMTMIVVTHEMRFAQEVADEVIFMDDGKIVERGTPDDIFKTPKVERTKQFLRLIHSRV

SEQ ID NO: 9453 - protein, 490 aa, Bacillus halodurans C-125
MKRDHYRMVINGERVDSDETFETFNPAKGEILATVAKASREHAEKAVQAARHAFDHGKWRKYPVGKRARVLNQIAAIMRERFQELVEIEVLNSGKAISAAQAQINQAIEDFEFYAGAIVGHRGTVNNVPNGFLNYTQKEPVGVCAQIIPWNYPLMMAAWKVAPALAAGCSVVVKPASLTPITAILLNEICHEAGVPEGVVNTVAGAGSVVGDYLVGHEDVNKVAFTGSTPIGKDIMEKASHTLKRVTLELGGKSPNLVFADADMEAAVAGSLFGIYFNTGQSCEARSRLFVHEEIYDEFIEEFITRAKKLQLGDPFDKGTHVGSIISRDQLEIIDSYVRSAEEEGATIALGGKERRVEGFENGHWYEPTVITNVTPDMKAVQEEIFGPVVVVETFQDEREVIKRANDTKFGLGSAIWTKDQGRATRVAHQLEAGIVMVNCPFSAFPGTPFGGYKESGFGRELCVETLDLYMEDKSILSYYGPKPINPFGV

SEQ ID NO: 9454 - protein, 473 aa, Bacillus halodurans C-125
MVVGEVAVEVDTVVVGGGPGGYTAAIRLGQLGKSVVLIEKNQLGGVCLNRGCIPSKALIQMAEKFDELTHLKEMGVELPGKPASIDLHKWQKWKQEITTKLNTGIHQLCQQNGVTVVTGEAHFLSSHRVGVETGNAFDVYKFEHAIVATGSSPRSLPFAEVDHTYILDSTSALELTEVPRSLSIVGGGYIGMELGLAFAKLGSAVTIVEMSPHILPATAPHISREVLNKAEKLGVTIKSSTSVEHLTVNDGYVELIVQSNGEQETLQSEKALMTVGRSPNTKGLGLEQVGVFFNEDGTLPINEECRTNIDHIFAIGDVTEGPALAHKASKQGIVAAEVIGGLPSAIDSSYIPYVVFTDPQIAGVGLTAKQAQEQGHRVKTARFPFQANGLALVASKPDGFAEVIVDEESHLLLGFHIVGADASNLIGEGVLALELGARVEDVALTVHPHPTFSEGWLGAAEAALGHAIHVVNK

SEQ ID NO: 9455 - protein, 312 aa, Bacillus halodurans C-125
MENRRIVIITGANSGIGKEAAQRFANEGDHVIMACRNIAFSRKVQHDIIAASGNDHVDLLELDVSSFASIRTFCTTFNSQYKRLDILIHNAAYFNHGEPYRLSPDGIELTFATNVFGPYLLTSLLRDRLKQSEDPRILHAGSNIIKHFFDPKQTFDLDLLQGNHGTKSYSVYKMYCQSKMALMLLTFQMAEVFADDGIKVNALQINGAKMSKRTIQKVKPWWRPIAWGQNLFFPPPSYMADKYFTICTSDKYKQTTGKLFNDKLEIMEPSPTHYPGFFKQMKLLLGSNVYPAYENTNIREKLWALCKELVGE

SEQ ID NO: 9456 - protein, 324 aa, Bacillus halodurans C-125
MKAIVVTAFGGPEHMMWEDVSTPVIKENEVLIKVVKTSVNFADIKARYGRKGGTLPFIPGLDAAGYVEKVGREVSDIQVGQRVIAFPKSGSYAEYVVAAESLVFPIPDEINFRTAAASPIVSFLSHRLLYNVAQMERGESVLVHAAAGGVGTTAIQMAKLLGAGTVIGTVGSADKITAAKESGADEVICYEEEDFTKSVQEMTNGVGVDIILDSVSGSVTEKSLQCLARYGRLVHFGNSSGAIGTIKTIDLHASCRSVLGFSLGTTRKCKPHLLKETARHVLPYLASGKLKVHIGHEYRLTDAANAHRLMESRLNRGKILLNVE

SEQ ID NO: 9457 - protein, 198 aa, Bacillus halodurans C-125
MGEITERRMMKAAVVDKFKQQLEIKEVPVPSLEYGEVLVKIKACGVCHTDLHAAHGDWPVKPKLPLIPGHEGVGIVEEIGEGVTSIKVGDRVGIPWLYSACGECEYCLTGRETLCPDQLNAGYSVDGGYAEYCKAPANYVVKIPEHLDFAEVSPIFCAGVTTYKALKVAEAKAGDWGRHLWNRWTRSRCSTVCKSDGL

SEQ ID NO: 9458 - protein, 498 aa, Bacillus halodurans C-125
MQKISTNDSKLNPRLVAFLNGGPKKLFINGEWVDSFSGQSFETMNPATGETLALVAEAGSEDIDFAVKAARKAFDEGPWSKMSAAERSRLIYKLADLIEDHKEALAQLETLDNGKPIRETANADIPLVIEHFRYFAGWATKIVGQTIPVQGHYFNYTRHEAIGVVGQIIPWNFPLLMAAWKLGAALATGCTVVLKPAEQTPLSALYLGELINEAGFPKGVVNIVPGFGHSAGTPLVNHPAVDKVAFTGSTDVGKLIMKQASESLKRVTLELGGKSPNIILPDADLSKAVPGSLMGIMFNQGQVCCAGSRLYVQKKQYDHVVADLVSLTNEIQQGDGLLEQTTMGPLISNQQQSRVKNYIDRGVEEGAELLTGGNIPYDQGYFVAPTIFADVDHSMTIAKEEIFGPVVAAMPFDSIDDLIDKANDSDYGLAAGVWTQDIKKAHYIAHRIKAGTIWVNCYNVFDAASPFGGYKQSGIGREMGSYALENYTEVKSVWVNMD

SEQ ID NO: 9459 - protein, 477 aa, Bacillus halodurans C-125
MSKHSFPEGFLWGGAIAANQAEGAYLEDGKGLTLVDLLPTGQKRWDVMLGKLDSFTPLEGEFYPSHEAIDFYHRYQEDVALLAEMGFKAFRLSISWARIFPNGDDPEPNEKGLQFYDDLFDELLKYNIQPVVTMAHFDVPVHLIESYGGWRSRKLVGLFETYAKTILSRYKDKVKYWMTFNEINMLLHLPFVGAGLVFKEGENKKQIQYQAAHHQLVASSLAVKACHELIPDAKIGCMLAAGATYPYTCHPNDVFEAMTKDRESFFFIDVQSRGEYPGYAKRFFRDHNIVIDMEEGDEALLKNHTVDYIGFSYYASRVTSTDPEVLKNITSGNVFGSVENPYLEKSEWGWTIDPKGFRTTANQLYDRYQKPLFVVENGLGAVDDVTLEGEINDEYRIDYLRKHIAEMAEAIADGVDIIGYTSWGPIDVVSASTGEMKKRYGYIYVDRDNEGKGSLKRMKKKSFHWYKKVIETNGEKR

SEQ ID NO: 9460 - protein, 434 aa, Bacillus halodurans C-125
MDRYFGFKEHGTTYGRESIAGLTTFLSMAYILFVNPLILGDAGMDVQAVFMATALAAAIGTLIMGILAKYPIALAPGMGLNAFFAYSVVIGMGIDWQLALFGVFVSGIIFILITVFKIREVIINAIPAELKNAAAAGIGLFIAFIGLKNAGIVVSDEATAVSLGHILNGPTLLACFGLIVTVLFMVRGIQGGIFYGMILTAIVGLISGIITYTGGGIVSTPPSLAPTFGQAFNIQMADVFSVQFLIVVLTFLFVDFFDTAGTLYGVANQAGFIKDNKLPRAGKALLADSSATSIGAILGTSTTTAYIESSAGVAAGGRTGFASIVTAGLFVLAMFFSPLLSVVTEQVTAAALIVVGILMASSLRFIDWTKLEIAIPSFLTVVAMPLTYSIATGIAFGFLFYPITMIVKGRGKEVHPIMYALFFVFLAYFIFLSE

SEQ ID NO: 9461 - protein, 507 aa, Bacillus halodurans C-125
MSLVEIFRFRNERIKILHLTWIAFFISFFTWFNMAPLATTMMESMDWLTREHIAALAIINVALTIPARLIIGMLLDRFGPRIVYSSLLVLMAIPAFMFAFGDTWTQLMISRLLLSSIGASFVVGIRMVAEWFPPKDVGFAEGIYGGWGNFGSAVAAMVLPWFAITMFGGPEGWRYAMAFTGVVCLIYGVIYYLFVRDTPEGKTFVRAKRTGAMEVSSWKDLIWLIVWTIPLHAALGVLAWRLEGMGFLSETILYTIYLVLAVALVYQVYTILKVNVPLLKKGIPEDDRYSFKNVAALNSTYFANFGAELAIISMLPMFFQLTFSLTPAQAGLIASSFAFINLFARPLGGILSDRMGSRRNIMLVYMAGITIGLVGMGFMDSNWPLVVAILITVFTSVFIQGAEGATFAVIPMIKKRMTGQVAGMAGAYGNVGATIYLTLYTFVTPQQFFFILAGGALASFVICYFWLEEPENSFASEYALSSVDEQVVQEAEVSEAEESVVVQKKVL

SEQ ID NO: 9462 - protein, 511 aa, Bacillus halodurans C-125
MKRRALVSVSNKEGIVPFAKALVEHEVEIVSTGGTKRALQEAGIPVTGISDVTGFPEILDGRVKTLHPNIHGGLLAMRERDEHLAQLNEHHIRPIDFVVVNLYPFQQTIAKPEATFADAIENIDIGGPSMLRAAAKNHQHVTVVVDPVDYETVLKELADQGNVATETKRRLAAKVFRHTAAYDAMIAEYLTDAVGEESPESLTVTFEKKQDLRYGENPHQKATFYQKPLGAKASIAHAKQLHGKELSYNNINDADAALSIVKEFKEPAAVAVKHMNPCGVGTGETIKEAFDKAYEADPVSIFGGIIALNREVDVETAKTLKEIFLEIIIAPSFSEEALDVLTSKKNLRLLTLPLNEENQAEKRITSIHGGALVQEEDTYGFEEAEIKIPTKREPTEAEWEALKLAWRVVKHVKSNAIVLADGQMTVGVGAGQMNRVGAAKIAIEQAGEKAAGSVMGSDAFFPMGDTVELAAKAGITAIIQPGGSIRDEESIENADKHGIAMVFTGVRHFKH

SEQ ID NO: 9463 - protein, 506 aa, Bacillus halodurans C-125
MVYKRPNEEGAVVSFKKRYDNYVNGEWTPPVKGQYFENVTPVTGEVFCEVARSTAEDIDLALDAAHAAKEQWGKTSPAERANLLNKIADRMEENLEKLAVAETWENGKPVRETLNADIPLAIDHFRYFAGAIRAQEGTLSQIDNDTVAYHFHEPLGVVGQIIPWNFPILMATWKLAPALAAGNCVILKPAEQTPASIFVLLELIEDLLPKGVVNIVNGFGVEAGKPLASSSRVAKVAFTGETTTGRLIMQYASENLIPVTLELGGKSPNIFFDDVMAKDDAFLNKAIEGFVLFALNQGEVCTCPSRALIQESIYDTFMERALARVQAIKQGNPLDPNTMIGAQASQEQLEKILSYLAIGKEEGAEVLAGGERNHLPGELANGYYVSPTVFKGTNDMRVFQEEIFGPVVSVTTFKDAEEALAIANDTLYGLGAGVWTRDMNKAYRFGREIQAGRVWTNCYHAYPAHAAFGGYKKSGIGRETHLMMLSHYQQTKNLLVSYSEDALGFF

SEQ ID NO: 9464 - protein, 462 aa, Bacillus halodurans C-125
MKSYDIVVIGGGPGGYVAAIKAAKLGKKVALVEAKDLGGTCLNRGCIPSKTLLHQGEIIEKIKQAKEWGIETGAVTLSLPKMLARKNEIIQKLRAGIHFLLKQGKIDVYFGYGEIERDRSVKIKMKETAEIVSVRTENMIVATGTEPTIPPVPGLAEAVVDTSDTIFELDSIPQSIVIIGGGVIGVEIACIFSSLQVDVTIVEMGKRILPQEDEEAAKVLAKALAAKGVHLLTNTKVTAVLQGDKQKVEIETSTGDRDWLEGERILLAVGRTPNLSVVKELGLGMAGPFLKVDDQMRTSDPSIYAIGDVIGGWQLAHVASAEGLVAAANASGKVEIINRQVIPRCIYTQPEIASVGLTEQEAKEKGYSYKVVKVDLRANGKAMALGETTGFVKMIADPNYGEILGVTMVGPHVTEMIGEPAAFIHLEGTVDELKAMIHPHPTVSEALYEAAASWLGQGVHQP

SEQ ID NO: 9465 - protein, 451 aa, Bacillus halodurans C-125
MTSNDLLAKSKKHLWLPFTQMSDYEKDPLIIESGNGVYLKDIEGNTYLDGYSSLWLNVHGHRKKEIDEAIEKQLQLIAHSTLLGAANIPSIQLAEKLVELAPEAITRVFYSDSGAEAVEIAVKMAYQYWQNRGYENKKSFVTLSNGYHGDTVGTMSVGSIELYHKVYTSLLFDAIVIPFPASKEEQTESDLCRESLKQLRELFEAKHEEIAGITVEALIQGAGGMNLMPKGYLKGVEQLCKEFHILLIVDEVATGFGRTGKMFAVEHENVQPDIMTVAKGITGGYLPIAATLTQEHIYEAFYGEYTDLKTFFHGHSYTGNQLGCAAALANLEIFEKENIIQQVEEKALFLEEQLKHVAELEFVGAVRQLGLMCGIQLVQHKRTSEPFPWEQRVAYRSTLKMRALGMLTRPLGDVIVLMPPLAATNDQLKQMVDIMKEGIMEAATECLEQQV

SEQ ID NO: 9466 - protein, 393 aa, Bacillus halodurans C-125
MKRDQHFETRAIHTGYKPNEHFDSLTPPIYQTSTFTFASMEQGGNRFAGEEAGYVYSRLGNPTVQILEQRIAELEGGEAALAFGSGMAAVSAILVGLTKANDHILVSNGVYGCTFGLLTMLKEKYNIDATFSPMDSVEEILANIQDNTTCIYVETPINPTMQLIDLELVVRVAKEKGIKVIVDNTFATPYLQQPIALGCDFVVHSATKYIGGHGDVVAGVLIGDKETIQLIRKTTQKDMGGVISPFDAWLLLRGLKTLAVRMDRHCENAEKLAEKLKEHPKVSTVLYPGDFEHPDHSIVAKQMKKGGGLLSFEIKGTEADIAKVVNQLKLIRIAVSLGDAETLIQHPATMTHAVVPEKRRTQMGISKKLLRMSAGLEAWQDVWADLEQALNQL

SEQ ID NO: 9467 - protein, 323 aa, Bacillus halodurans C-125
MEMLAKVSQFFSKYFAFFVIIISFVAFLSPDHFTWITPHITILLGVIMFGMGLTLKLSDFRIVLQKPIPVLVGVLAQFVIMPLVAFALAYAFNLPPELAAGLVLVGACPGGTASNVMVYLAKGNVAASVAMTSVSTMLAPIVTPFILLLLAGQWLPIDAKAMFVSILQMIIVPIALGLFVRKMAPNAVDKSTAVLPLVSIVAIMAIVSAVVGANQANLMSGAALLFLAVMLHNVFGLLLGYLTAKFVGLDESTRRAISIEVGMQNSGLGAALAGNHFSPLAALPSAIFSVWHNISGPVLVSIWSRSAKSAQKRQSDADMKVDL

SEQ ID NO: 9468 - protein, 452 aa, Bacillus halodurans C-125
MKEKVQMQRRYFHTNETKELSFRMNMLKKLKKALLDYENELLAALKEDLNKSTSEAFLTELGPLYHEITFMLKHLPTWMKRKKVKTPLTHVGSKGYIHYEPYGVVLIIAPWNYPLQLAINPLIGAIAAGNCAIVKPSELTPATSGVITKMIENTFPEEYVCSVEGGVETSQALLAEKMDYIFFTGSVGVGKHVMKAASRHLTPVTLELGGKSPAIVCEDAQIAVTAKRIAWGKFLNAGQTCVAPDYVLVHDSKKEDFLKALQTEIKTLFQRKIDRGDYPTIVSDRHFARLIRFLQDGDVVIGGQHERNKRFIAPTVLTNVSWESPVMEDEIFGPILPVFSFSELDEVIEKVRERPHPLALYLFTESKETEEKLIHSLSFGGGCINDTVMHLATPYLPFGGVGESGMGAYHGEESFYTFSHRKSVLKQPTSVDLPIRYKESKLSLKMLRKLFQ

SEQ ID NO: 9469 - protein, 454 aa, Bacillus halodurans C-125
MNNKQLDFTEGSITKKMVVFSWPIFLSNLLQTSYQITDSLWVGNLLGASALGALSISATVVFMVLSFIIGLNGATLTVLSQRQGAKDEAGLKASLNAFVFVLGLLAILLGLIGYFSASSILQLLGTPEEILPLAESYLKINFIGILFLFGYNFIGTVLRAMGDSRSPVRFIFIAVILNIILDPLMIAGFNLGIDGAAYATIVSQGTAFIYGLIYSVRKAGVPFQIPYVPEKRYFFVLFKLGLPAGLSMITISAGVTAILSVVTSFGEEAVAGFGAAQRLDSLIMLPALTLGSAVNTIAGQNIGANKWERVRATAKQGVMLIIAVTLIIGLITFIGAQFFIRLFVRDEATVAFGAMYIQTIAFFYPFLGINFVLNGIVRASGAMFPVLLLNIISFWILRYPLTYWMSDLFGERGIALGMGFAFVVSSLIATGYYFLGNWRKVGEELAQKTGHSKV

SEQ ID NO: 9470 - protein, 427 aa, Bacillus halodurans C-125
MSQTDMNVFEQLESEVRSYCRSFPTVFTKAKGYKMWDEAGKEYIDFFSGAGALNYGHNDEKMKKALVDYIMDDGITHSLDMATTPKGKFLQKFHDVILKPRNLDYKVMFPGPTGTNTVESALKLARKVTGRTDIISFTNGFHGMTIGSLSVTGNSFKRKGAGIPLTNVVTMPYDNFVSESLDTLDYLERFLEDGGSGVEIPAAMILETVQGEGGINAARTEWLQRVEKICKRWGILLIIDDVQAGVGRTGTFFSFEDAGITPDIVCLSKSIGGFGLPLAITLFRPELDIWAPGEHNGTFRGNNHAFVTATEALSYWEDDSFEKDIQEKSATISDFLVKLVTEYPEIKGEVKGKGFMVGIASDVEGFASKVTEEAFSRGLIMETSGPNDEVFKLFPPLTIDDEGLEKGLAIIEESIKALVETKELVMQ

SEQ ID NO: 9471 - protein, 322 aa, Bacillus halodurans C-125
MKAVVYEQYGDPSVLKVMDVPKPTIGPTDVLINVKASGTNPVDTYFRKGIRQVEQFPHIPHFDVAGEIVEIGSDIENWQVGDRVWATNIKGASAEYALIPEHLLFPLPKSVSYEEGAALAMTFMTAHLSLFDRGRLQKGETVLIYGGSGAVGHAAIQLAKRAGATVITTAGDREKGEIAKQAGADQVIFYKEESVVDAVGKATNGQGVPLILDMSLSENMAQDFDILTTGGRIVAIGSPVDNTPPLLWRQLNMKHASLIGVLVFTAPKNVLRQAGKEIAEGFEQGELSAYIGKVFPIDEAAHAHRALEAKTYQGRIILSHED

SEQ ID NO: 9472 - protein, 385 aa, Bacillus halodurans C-125
MIKPSRRLAPLATSVFTELANMKAAYKQDGRELIDLSIGSPDLPPPDFVVQKMNAYVSNPNQYGYAITGLAAFHEAVAQFYQRRYQVNVKPHQVLSLMGSQDGLAHLALAYVDAGDLLLAPDPGYPIYAASAHIAGAELYTYPLNEENQFMFDVETLPDDVKQKAKLMIVNYPGNPTAAMADEAYFEKLVAFGIEHNILIVHDYAYSELLFDQREALSIFSVPRAFETAIEFNSLSKSFNIAGARIGYAIGAESILQPLAALKSHLDYGVFLPVQYGAIEALEHGDAFLETQRELYEKRRNTFVEALQLNGWTVSKPGGGMFIWAKIPDDGRDAMSFVKQAMEHAGVIVTPGHAFGKEGEGYVRMALVQPETELRKAANQLAQIL

SEQ ID NO: 9473 - protein, 437 aa, Bacillus halodurans C-125
MNRSRSESLFQKAQSLIVGGVNSPSRSFKAVGGGAPVFMEKAKGAYFWDVDGNQYIDYLAAYGPIITGHAHPHITNAIQRAAENGVLYGTPTKLENQFASMLQQAIPSLEKVRFVNSGTEAVMTTIRVARAYTGRDKIIKFAGCYHGHSDLVLVAAGSGPSTLGTPDSAGVTKNIAEEVITVPFNQLDSLKEALDHWGEEVAAVLVEPIVGNFGIVEPHEGFLEGVNELAHNAGALVIYDEVITAFRFMYEGAQNYVGVEPDMTALGKIIGGGLPIGAYGGRIDIMEKVAPLGPAYQAGTMAGNPASMSAGIACLEVLQEEGLYDELDRKGAILEKGIKAHAEAHGITISINRLKGALTVYFTDETVTCYEQAERSDGEKFSLFFKEMLNQGINLAPSKYEAWFLTIAHTDEDIEKTLQAVDHAFSVMAAKGYHLKR

SEQ ID NO: 9474 - protein, 443 aa, Bacillus halodurans C-125
MSQSIQTQEEDLKSLLTRRERIVPRGVVNNIQTFAKEAKGAIVIDVEGKSYIDFAGAIGTINVGHSHPKVVQAVQQQADQFIHTGFNVMMYESYIELAERLAALAPGSFEKKVLLQNSGAEAVENAVKMARKYTGRQGIVSFSRGFHGRTLMTMTMTSKVKPYKFGFGPFAPEVYKAPYPYEYRRPEGMSEDAYHAYVLQEFIQFMNVEVAPESVAAVVMEPVQGEGGFIVPSKSFVQGVYRYCKEHGILFIADEIQTGFARTGHYFASEHFEIEPDLLTVSKSLGAGVPISGVIGRREVLDEASPGELGGTYSGSPLGCAAALAVLDIIEEEGLNERARKLGQVVMDKMAQLQEQYECIGHIRGLGAMCAMEVVKDRHTKEPDKELTAKIVSEAGNRGLLLLSAGQYGNVLRFLMPIVITDEQLNNGFAILEEALATAIVNR

SEQ ID NO: 9475 - protein, 468 aa, Bacillus halodurans C-125
MDLYINGEWMRSGKTLDVTNPATGEVIDTVPFAGKKEAELAVSAAYEAFPQWSSQTASERSRYLMRWFQLIDEQQDEIGEIMTKEQGKPLREAIGEVQYANSFIQWYAEEAKRIYGDTIPASAINKRILVQKQPVGVIAAITPWNFPAAMITRKVAPALAAGCTAIVKPAEQTPLTALKLAQLAEEAGIPAGVLNVITGNAQDIGEAWLEDSRVRKITFTGSTEVGKLLMRGAAQTVKKISLELGGHAPFIIMDDANLEEAVDQVIASKFRNAGQTCVCANRIYVAREIAEAFTEKFAAKVNELKVGNGLEEGVTIGPLIDKAAVEKVEAHIHDALKKGGQVTVGGRWTNHFFEPTIITGATDEMLCMNEETFGPLAPVATFDTEEEVIERANHTPYGLAAYVFTENIGRAIRLSEKLEYGIVGVNDGMPSVAQAPFGGWKESGLGREGGKYGIEEYLEVKYVSVAFK

SEQ ID NO: 9476 - protein, 485 aa, Bacillus halodurans C-125
MFNIQDLNKQYIDGEWRDGKSPRVLRDRNPYNQEVLAEFQIATDSDVDAAYHAALKAQNEWATVNPYRKREILERAVTYIEEHEEEIVAIIIDELGGTRLKAAFEIGLVKNMIKEASTFPLRMEGKILPSTENGKENRLYRVPAGVVGVISPFNFPFFLSVKSVAPALGAGNGVVLKPHEETPITGGTLIAKIFEEAGVPKGLLNVVVTEIDEIGNAFVEHPIPRIISFTGSTNVGSHIGQLAVKHFKKPLLELGGNSAFLIFADADLDYAVQAATFSRFTHQGQICMSANRIFVQRDVYDEFVERYVTKVASLKVGDPRDPETVIGPVMNSRQAETLKQAIESGIAAGAKPVLHGAISGNMVEPTILIDASPEMAIAQEELFGPVVCVIPFDTEEEAVEMANDTKYGLSGAIHTANVERGVEIAKRIQTGMIHVNDITINDEPIVAFGGEKHSGLGRLNGEWSLEEFTTLKWVSVHYSQRVFPY

SEQ ID NO: 9477 - protein, 434 aa, Bacillus halodurans C-125
MKKNDETSRNLIGLDQQHFIHPTSSMQQQQQHGPAHIFVRGKGVYLYDHDGKAYLDGMSSLWNVNVGHGRRELGEVAKKQMDTLAFSSCFATFSNKPAIELAAKLARVSPPSLRATFFTSGGSEANDTAFKLARHYWKVKDQPKKRKIIARMKSYHGVAMGATSATGLKPFRDFAPSLAPDFLHVDHMSIEALRALIDREGPETIAAFVCEPIQGAGGVHVAPDSYLCDIRSICDEYELLFIADEVITGFGRTGAYFGCDHANISPDMMCIAKGITSGYAPLGGVMLSKSLHEQLTAHSHGTLLHGYTYSGHPTSCAVALKNIQIIEEENLIDHAATMGEKLLLGFRTIQEQYSEIHDARGRGLMAALAFSHNGKNEPLAPKVVQAADQRGLILRAVTFDQQDVLVCAPPLIINEEELNQLLSILESSVQAVVS

SEQ ID NO: 9478 - protein, 395 aa, Bacillus halodurans C-125
MKTFEQAKMMKRLPEQFFAKLVEQVQEVKKDHDDIINLGQGSPDLPTPEHIVEKLQEAAENPLYHRYAPFSGYPFLKEAVSKYYEREYGVSVDPKTEVAVLGGAKTGLVEVSQCFLNPGDMALVPDPGYPDYWSGIAIAGGSMYGMPLKKELGFHPDLRGIPAPVLYEAKLMFLNYPNNPTGAVATEELFAEAIELAEEYDICVVHDFAYSAIGFDGQKPLSFLQVEGAKNVGIEMITLSKNYNMAGWRIGFAVGNPSVIKAIETLQDHYFCSLFGGIQAAAAHALLSDQSNVTTLVQTYEERRNALVKAARAIGWDVEAPKGSFFAWFPVPSGFTSEEFATYLLKKARVVVAPGKGFGEHGEGYVRVALLADIAKLEEAMGRVGKLDVFSNKRG

SEQ ID NO: 9479 - protein, 276 aa, Bacillus halodurans C-125
MSPFLGEVIGTMILIILGGGVVAGVVLKGTKSENGGWIVITAAWGLAVATAVYCVGQISGAHLNPAVTIGLALVGAFEWSQVAGYIVAQMLGAMIGATLVFLHYYPHFKATEDQGAKLAVFSTDPAIKHLPANFFSEVLGTFVLVLGILAIGANEFTEGLNPLIVGLLIVVIGLSLGGTTGYAINPARDLGPRIAHFLLPIPGKGSSNWSYAWIPIVGPIIGGGIGALTYAALFEGIVYSALWLFLAAFALVLLYASFIEKKHEAKGKDQPVAMAK

SEQ ID NO: 9480 - protein, 504 aa, Bacillus halodurans C-125
MFEETVEKLKRGGSEKYHEANQQKGKLFARKRLELLFDDGLAAEDGLFANCQVDGLPADGVITGIGKINGQTVCVMANDSTVKAGSWGARTVEKIIRIQETAEKLNVPMLYLVDSAGARITDQVEMFPGRRGAGRIFYNQVKLSGRVPQVCILFGPSAAGGAYIPAFCDVVIMVDGNASMYLGSPRMAEMVIGEKVSLEEMGGAKMHCSVSGCGDILAPSEEEAIGLARDYLRYFPSSYSKRPPIEDGREPKSFTKTIEEILPKNQNAPFNMYDLIDRVIDEDSFFEIKKLFAPELITGLARIDGKPIGIIANQPKMKGGVLFHDSADKAAKFITLCDAYHIPLLFLADIPGFMIGTKVERAGIIRHGAKMISAMSEATVPKISIIVRKAYGAGLYAMAGPAFEPDVCLAFPNAQIAVMGPEAAVNAVYANKIAELPEEERAAFIAEKREEYKQDIDVYRLASELVIDGIIQGNQLREELKTRLTAYASKELTFTTRKHPVYPV

SEQ ID NO: 9481 - protein, 292 aa, Bacillus halodurans C-125
MKIGYLGPRGTFTEMAVQTLFDDKNVLKPYRTIPDCMDSVANGDMDAAVVPVENAIEGSVNVTLDYLIHKQRLEIVADIVVPISQHFLVHPNQRDNEIKKILSHPHAVAQCHEFLRSSYPGVEIEYMTSTAAAAQWVADHPNEPVAAIANEQAATSYQLDMLEKDIHDYDENRTRFAVLAKGKLSLPPYQVEPYTKKTTMMVTLSSDFSGALHQVLSAFAWRKLNLTKIESRPMKTGLGNYFFIIDVDCEADDVLIPGVMQELEALGCGVELLGSYPCFFHTSLKLTEASSV

SEQ ID NO: 9482 - protein, 240 aa, Bacillus halodurans C-125
MINVKDLHKSFGSLEVLKGITTEIQKGDVVAVIGPSGSGKSTFLRCLNLLEVPTSGHVWIDDEEITHPKTNVGKLRTKIGMVFQHFHLFPHMTVMENLTFAPMKVKGVSKAEAIAKGESLLQKVGLLEKRDEYPSRLSGGQKQRVAIARALAMDPEVMLFDEPTSALDPEMVKEVLAVMKDLAETGMTMVIVTHEMGFAKEVADRVLFLDQGILLEDLPPKQFFAAPKSERARDFLEKVL

SEQ ID NO: 9483 - protein, 338 aa, Bacillus halodurans C-125
MEHKLFSSYVVKGVTLKNRIVMSPMCMYSSDQKDGKIRPFHISHYESRAAGQVGLIIVEATAVTPQGRISPYDLGIWSDDHISGLTETVERIHAHGAKAAIQLAHAGRKAELDGPIIAPSAISYDKMKTPDAMTEEQISETIEAFKLGALRAKKAGFDIIEIHGAHGYLINEFLSPLTNKRTDAYGGSLENRYRLLREIISEIQTVWDGPLFVRISAAEYAEGGNELSDFITLAKWMKKQGIDLIDCSSGAVVPAPIPVYPGYQVPLAEAIRHEANIATGAVGLITSGIQAEEILQNERADLIFVARELLRNPYWPREAALELGTTISGPSQYDRAWL

SEQ ID NO: 9484 - protein, 265 aa, Bacillus halodurans C-125
MSRLEAAVNGKKNLFIPFITAGDPNPEVTIELALTLEEAGADILELGIPYSDPLADGPVIQAASKRALKHEMTLEKALSLVPKMRAQGLTIPVIVFTYVNPLLQYGEEQFVKRAADYQVDGILVPDMPFEEGEVLQAACQEHNLSLISLVAPTSNKRIEKIAARAQGFVYCVSSLGVTGLRDELDPRVHEFLQTVKTHASVPVVVGFGISRREQVEALAENADGVVVGSAIVKLVGELEDELNDPEKLEDGLFKIKRFVSELISS

SEQ ID NO: 9485 - protein, 495 aa, Bacillus halodurans C-125; identical to SEQ ID NO: 480

SEQ ID NO: 9486 - protein, 398 aa, Bacillus halodurans C-125
MNPHMMMNDKALGTKAVWAGERSFLAHGATQVPVVHSVSFGYDDVDEWYEVATGKKDGHIYGRNTNPTVQAFEEKVRELEFAEAATSFATGMAAISNSLLTVLKPGDRVVSIKDTYGGTNKIFSEFLPRLKIEVTLCETGDHEALEREITKGCTLVYLETPTNPTVKITDLERITSFAHEHNALVFVDNTFATPINQNPLLTGADLVVHSATKFLGGHADALGGVACGNKELVSAIYHYREINGATLDPMAAYLLLRGMKTLKLRVEKQQENAMKVARFLTEHDKVRAVYYPGLETHPHHEVAKRQMRGFGGMLSFALKGEMEAVRKFLPALTYANRAANLGAVETTVGPARTTSHVENTPEERAALGIPEGLVRYSAGIEDAVDLIEDLSQALDSIT

SEQ ID NO: 9487 - protein, 482 aa, Bacillus halodurans C-125
MHTQVVQERMLISDQWQHGQQSIEVIDPGTNHVIATVPAATEADAKAAIEAAKEGAEIARQMPIHERAAILKRTAEIVTRDRELFAQTIAKEGSKTIREARSEVRRCIETLTLSGEEAKRLHGETIPFSQMPGHERRVGYFYRFPIGIIVAITPFNDPLNLVAHKIGPAIAAGNSLIIKPSSFTPLSALRLVKALEEAGLPKKIVQVITGHGSVIGPTLTKHRDVRLISFTGGYETGEKIARSAGVKKLAMELGSNSPTIVLQDAELMEAVASCVSGAFCAAGQNCIGVQRIYVEQSVFNSFIQSFVAQTKQLRLGDKQSEETDIGPMISEKEAKRIERWVEEAKEEGARVLTGGRRTGAYFEPTVLTNVSPSSRLAKEEAFAPIVIIEGVHSLTEAIARANDVDFGLQAGLFTNNLTAAFSAIEKLEVGGIMVNDSSDVRIDAMPFGGIKKSGLGREGVRYAIEEMTEQKVVAFHLPEHKI

SEQ ID NO: 9488 - protein, 459 aa, Bacillus halodurans C-125
MDRVAIVGGGPAGYVAAITAAHRGKQVTLIEQKKLGGTCLNEGCMPTKSLLESAATYDKVKHASDYGIKGPVDEMRIEWGQVQARKNQIVHQLVKGIDYLLKKHKIELLEGTASFQSAHELLVQTERGQQTIEANRIIIATGSEPTPLPFAPFDREWVISSEQAMSLPIQPESMIIVGGGVIGCEFASIYGRMGTKVTIIEMADRLLFGEDHDICKVLMEELKRQGVEIYPSTVIKEMQRDRKQVVVERDGQVEVLTGDYVLVAIGRKPRLQEIGLERIGVDFTSRGITVNEHMQTTIPHIYACGDVIGGIQLAHVAFHEGSVAAKHLCGEPIQVRYEAVPRCIYTSPEIATVGLTETQARENYGHVRIGEYPFAANGKALIVNETIGKVKVVVEPEYEAIVGLTIVGPHATELIAQGTLMVHNELTLDSLESFIAAHPTVSEAVHEAVLQALGQAVHV

SEQ ID NO: 9489 - protein, 319 aa, Bacillus halodurans C-125
MNRGVICLGEALIDFIPMDSTNEIYQKSPGGAPANVAVGLAKLGAKSTFVGKVGDDLLGRFLKETLTKANVNTEHMLFSKEVRTGATFVTLAANGERSFDFYINPSADRFLEKGEIAPTLFEEHGVLHFGSISLISEPARTATRHAVSLAKKNGLMISYDPNLRLNLWEDEEQARLLITSMLGEADVLKISEEELAFITGEQTIEAGLDQLVAYNIPLVFVTLGEKGSIVSYNGIQRKIPAMAVQTVDTTGAGDAFVSAILFKLQEERKQVAELSIKEVEQMARFASVSGGLAAATKGAMTALPTLEKVNDILRNEQME

SEQ ID NO: 9490 - protein, 447 aa, Bacillus halodurans C-125
MSIIQFPKEMKWGVATASYQIEGAINAGGRGASIWDVFAKTPGKVKNGDNGDVACDSYHRYEEDIEIMKDLGVDMYRFSVAWPRIFPNGTGEVSREGLDYYHRLVDRLTENGIQPMCTLYHWDLPQALQEKGGWDNRDTIDAFVRYAEVMFKEFGDKINHWITFNELWCVSFLSNYIGVHAPGNTDLQLATNVAHHLLVAHGKAVQSYRKMGLDGQIGYAPNVEWNEPFSNQMEDAEACKRGNGWFIEWFMDPVFKGAYPSFLVEWFEKKGITVPIEAGDMETIQQPIDFLGINYYTGSVARYKENEGLFDLEKVDAGYEKTDIGWNIYPEGFYKVLYYITEQYGQIPIYITENGSCYNDEPVNGQVKDEGRIRYLSQHLTALKRSMESGVNIKGYMAWSLLDNFEWAEGYSMRFGIVHVNYRTLERTKKDSFYWYKQMIANQFFEL

SEQ ID NO: 9491 - protein, 319 aa, Bacillus halodurans C-125
MKGYPFLDKANAPFVDRHVTKAGEIFYPWDGKRIDGFGLIGAPLSKSSISHSGASFAPTVIRKCLHAFSTYSVEEDLDLAQLKLTDLGDITMHVTDIVGSQARIEETMTKLLENEQNWQPIVLGGDHSISFPSIKAFASAKGTIGVIQFDAHHDLRNLEDGGPCNGTPFRSLLETGSLVGEHLVQIGIRDFSNSYPYRKYAEKHGVKVYTMKDVNARGLLTILDEAVAKLKRSVDVIYVSVDMDVLDQAHAPGCPAIGPGGMDSTTLLQGIFHLGKDSLVQGMDIVEVDPTLDFREMTSRAAAHVILNYLKGKCIKSIG

SEQ ID NO: 9492 - protein, 485 aa, Bacillus halodurans C-125
MEAIYTRQFLAGEWIEGASTQTITNYNPYTGEKIHEIKGASLDDLDQAYRAAKNAQKEWEQTLPAQKQEVLEKAAALLAERKDEVIERLVNEAGSSIIKASIEWGATLQTIKVAATFPLRMEGKILPSNIPGKENRIYRSAKGVIGVISPFNFPLVLAMRSVAPALATGNAVVLKCSSDAPITSGLLIAELFEEAGLPKGVLNVVVGKAAEIGDAFVTHPIPKLISFTGSTEVGRHIAQLAARELKETALELGGNNVMIVLDDADIEKAAEKAAVGKFLHQGQICMALNRIIVDASIYDSFVEVFKEKVSQLQTGNPAEPATLIGPLINYKQIGRIQQLVKESVAQGAVKVLEGHVQGNLMSPTILSEVTNDMPVAKEEIFGPIAPIIKAKDEAEAIAIANDSPYGLSGSIFTGSLHRGVQVAKQIDTGMIHVNDQPVNEEAHISFGGEKDSGIGRFGGEWVLDKFTTVKWISIQEKERVYPFWG

SEQ ID NO: 9493 - protein, 366 aa, Bacillus halodurans C-125
MKIQAAVLHNKGEPFSIEEVELAEPKADEILVKIVASGVCHTDAVAREQLIPIPLPAVLGHEGSGVVEAVGTHVTSVKPGDHVVLTFTTCGECENCQSGHPSFCTEFAPLNFFGKMSDRTNRIQQNGKDVSTFFGQASFGTYAIANARNVVKVDPDVDLALLGPLACGIQTGAGTVLNKLRPEFGSSVAIFGCGAVGLSAVMAAKIVGCQKIIAIDIHDSRLALAKELGATHVFNGNDSRLVEAIQAVTNGGTNYAVETTGISHVFHQSIKALTTLGVVAVVGVGGDVTVNMNDDILSQGKTITGVIEGDVVPQLFIPKLIDYYKAGHFPFDRLVKLYELDEINQAFEDSKNGSAVKPIIKMNHHI

SEQ ID NO: 9494 - protein, 432 aa, Bacillus halodurans C-125
MMVKWMKNYFDLPGHETTLKREFLAGLISFITIVYIIAVNGAILSESGIPLEAAIIATIITSFVGCWLMGFWANAPIILVPGMGINAMFSYTLVHSMGLTWQEALAVVVISGLIVTIISFTQLAQLLLDSIPSSLKHGITVGLGLFLALIGLEKGGLITRGENSLLALGDLSSPFVIATLMSVVLAVALFMRNVPGNFLISIIAGTSIAAVLGVISFDELSTWTVPLDQYPSLFGAISFSGFSSFSFFVAVFSLTMVLLFENIGLINGHLNMTNRPEKFSRSFQANGVSIFTSGIFGTSPTVATVETTAGIAAGGRTGVTAIVTGSLFLLSLFAIPLVKLIPGSAIAPVLMIIGGLMVQQVKQIDFQDFSEGFPAFLVIVMIPFSYSIADGIAFGFIAYPLVKFALGKAKEVPIPLYVIATLFFLTFVAHVY

SEQ ID NO: 9495 - protein, 455 aa, Bacillus halodurans C-125
MKASQAESEKMLKWWELSLLGVGCIIGTGFFLGSSIAIQMAGPSVLLAFILAGIGTYIVFDALAQMTSADPEKGSFRSYAKKAYGRWAGFTSGWVYWASEMLIMGSQLTALSIFSRFWFPDVPLWIFASGFAVLGIIVILTGSKGFDRIENLFAVMKVAAIVMFIALAILALFGVFRAGPEGAGIPRTWNGLFPEGFLGLWPALIFGFYAFGGIEIMGLLANRLEEKGDAAKSGRAMLLLLTFLYVVSVGLALILVPLNRFNTETSPFITALKPYGLPIVSHLFNGVLIIAGFSTMVASLFAVTSILVTLAADKDAPNLFAKKVKNKIALPAIGLTAIGMALSVVLSLLIPGRIYEYFTTAAGLMLLYNWLFIIASSGKLIQYRLTKRWIGTLFILLAVIGTLFHRTSRPGFLFSLGFLVVIGIVTLMMKKRWKQEEGDGKKRPSIFVKLKPNSE

SEQ ID NO: 9496 - protein, 481 aa, Bacillus halodurans C-125
MALQTEQFNANILRNGEWVESRTGERISISAPASGVALGSIPALSQEEVNDAIQGAKDAQKIWKIRPIHERVDLLYAWADLLEERKEIIGELIMHEVAKPKKSAIGEVSRTADIIRHTADEALRLNGETLKGDQFKGGSSKKIALVEREPLGVVLAISPFNYPVNLAAAKIAPALVTGNTVVFKPATQGSLSGIKMVEALADAGAPEGIIQVVTGRGSVIGDHLVEHPGIDMITFTGGTTTGERISEKAKMIPVVLELGGKDPAIVLDDADLKLTASQIVSGAFSYSGQRCTAIKRVFVQDSVADQLVANIKELVEQLTVGSPEDDADITPVIDEKSAAFIQGLIDDALENGATLLSGNKRQGNLLSPTLLDDVTPAMRVAWEEPFGPVLPIIRVKDANEAISLSNQSDYGLQASIFTKDTDRAINIGKHLEVGTVHINAKTERGPDHFPFLGVKKSGLGVQGIKPSLLSMTRERVTVLNL

SEQ ID NO: 9497 - protein, 385 aa, Bacillus halodurans C-125
MIRIFQTVLLAIVSAIVGFMIISITFVEYWSHTEAGKVPPKTAVLLHAIHHNLVTPDMRPPKFLTQSNGHSRFKTELIQIPVSDGASIPARVYQPKASGPHPIILYYHGGAFLEGYGDINTHDNIVRALAVRTGSIVVAVGYRVAPGHPFPTAIEDSYDALDWISKNAELFNGDPANVAVVGDSAGGNIATVVSLMARDREGPEISAQVLLYPLTTFQDVAFPSRDHYDSGYYLLSRAVMVQAREKYTPQQESWLNPYTSPLNADLEGVPPAFVVTAEFDPLRDEGEMYAQSLADAGVPVQAIRYNGVMHGFVSFYEVMERGDDALHQASMFLKKSFYDDMDAKPYELVIDDVPSAQVAIKDRLEAYAIGGFLIGKQSLSLFSGW

SEQ ID NO: 9498 - protein, 225 aa, Bacillus halodurans C-125
MSKQMSKHDVLERFKDGMSIMYGGFGGIGTPPTLVKWLKESKTKNLTLIGNDAGFPTIGIGPVVCSQQAERLITSHIGSNPIAGELMQAGKLEVEFSPQGTLMERIRAGGVGLGGILIDVGMDTIVAEGKESVVVDGTSYLLEKPVRADLSLIYAKKADPFGNLVYDQSARNTNPLMAMAGRYTIAEVEELVPLGQLDPEEVVTAGAFVDGLVESEGVDWKWMWE

SEQ ID NO: 9499 - protein, 445 aa, Bacillus halodurans C-125
MAKDESYLIKPLLDRNYPCVSYGKGAALYDMDGKRYLDACSGAVTASIGHGVDEVVQAMYEQARKVSFVYRSQFTNEPAERLAMKLAEQLPGQLNHSFFVNSGSEATETAIKISIQYWQERGRPEKTLILSRWMSYHGITQGALSLSGHYERRQRFEGMLDRLPFLSPPYPYRQVREMSGVDYAEELDHLIEQIGPHRIAAFIAEPIVGAAGTALVPGEWYYEALKQVLDQHDILFICDEVMTGMGRTGKDLAIEHWDATPDIVTLGKGLSAGYAPLAATVVADHVLEPIQAGSNLIMSGHTFSANPLSCAAGLAVLHYVKKHDLVKRAATIGEKLIEDLQEIQTASAIVGDVRGKGLLIGLEFVKNKATKAPFPKDAQVAAVIVNEAQRQGLLLYPSAAGLKGEGAGCLIAPPFTLTKEERCELLGKLARTLERVEKQLLGAEK

SEQ ID NO: 9500 - protein, 485 aa, Bacillus halodurans C-125
MANLATGEKLKNFIGGQWVESDSGKTEAVPNPATGEILAHVPISNREDLDRAVSVAKEAFKTWGKTPVPRRARVLFKYQQLLVENWEELARLVTLENGKSYKEAYGEVQRGIECVEFAAGAPSLMMGKQLPDIATNIESGMYRYPIGVVGGITPFNFPMMVPCWMFPLAIACGNTFVLKPSERTPLLANRLAELFTEAGLPEGVLNIVHGAHDVVNGLLEHPDVKAISFVGSQPVAEYVYKTASQHGKRVQALAGAKNHSIVMPDADLDGAVNQIVNAAYGSAGERCMAAAVVVAVGEVAEPLMEKLQKAVNEITIGNGLDDDVFLGPVIRESHKQKTENYIELGEKEGATLVRDGRKDNVSKDGYFLGPTLFDNVTTEMTIWKEEIFAPVLSVVRVESLDEAIQLTNQSEFANGACLYTTNGSSVRKFREEIDAGMLGINLGVPAPMAFFPFSGWKNSFYGDLHANGTDGVEFYTRKKMITARW

SEQ ID NO: 9501 - protein, 331 aa, Bacillus halodurans C-125
MTYELSTDREFDLIAIGRACIDLNAVEYNRPMEETMTFSKYVGGSPANIVIGSSKLGLKAGFIGKIADDQHGRFIESYMRGVGVDTSNLVVDQEGHKTGLAFTEIKSPEECSILMYRQDVADLYLSPEEVNEAYIRRSKLLLVSGTALSKSPSREAVLKAIRLAKRNDVKVVFELDYRPYSWETPEETAVYYSLVAEQSDIVIGTREEFDVLENRTEKGDNDETIRYLFKHSPELIVIKHGVEGSFAYTKAGEAYRGYAYKTKVLKTFGAGDSYASAFLYALISGKGIETALKYGSASASIVVSKHSSSDAMPSVEEIEALIEKDETITIA

SEQ ID NO: 9502 - protein, 449 aa, Bacillus halodurans C-125
MAKFTREDILRIAQEDNVRFIRLQFTDLLGTIKNVEIPVDQLPKALDNKMMFDGSSIEGFVRIEESDMYLYPDLDTWVIFPWTPEKGKVARLICDVYQPGKPGEEPKPFLGDPRGILKRVLKEAEALGFTAFNIGPEPEFFLFKNDESGEPTLELNDKGGYFDLAPTDLGENCRRDIVLELEDMGFEIEASHHEVAPGQHEIDFKYADAVTTCDNIQTFKLVVKTIARKHGLHATFMPKPLFGVNGSGMHCNMSLFRGKENAFFDESTESQLSGTAMQFLAGILKHADSFTAITNPIVNSYKRLVPGYEAPVYVAWSMRNRSPLVRIPSSRGLSTRIEVRSPDPAANPYLAMAAMLAAGLDGIKRKLTPPAATDRNIYVMSKEERDEEGIRDLPSTLKEAVDNFLKNDVLVEAIGEHAVEHFVEAKEIEWDMFRTQVHPWERDQYMQTY

SEQ ID NO: 9503 - protein, 216 aa, Bacillus halodurans C-125
MIKIAPSILSADFANLGNEIQDVERGGADYIHVDVMDGHFVPNITIGPLIVDAIRPVTTLPLDVHLMIEQPDGYIPAFAKAGADIITVHVEACPHLHRTLHLIKESGVKAGVVLNPATPVSSIQHVLSDVDMVLFMTVNPGFGGQRFIPSVLPKLKELASLKKEQGLTFEIEVDGGVNEETAKQCVEAGANVLVAGSAVFNEEDRAAAIKGIRGSI

SEQ ID NO: 9504 - protein, 454 aa, Bacillus halodurans C-125
MDVIAQVTATNQQFLSQQEKRESSARSYPRRLPLAIQKAEGICVTDMNGKQFIDCLAGAGTLALGHNHPVIRQAIEGVLASYVPLHSLDLTTPVKEAFVDEVFASLPESFAKKAKIHFCGPTGADAVEAAVKLVKTATGNRAMLSFQGGYHGSTHGALSLTGTTDPKKRIHALIPDTHFLPYPYEYRCPFGIGKDGHRVNSTYLESLLDDPESGLVKPAGIIVEVVQGEGGSIPAPVEWLKELRRMTSERNIPLIIDEVQTGIGRTGKMFAFEHAGIEPDVLVLSKAIGGSLPLSVVLYDRKLDQWEPGAHIGTFRGNQMAMATGRATLQYIKENQVPKHVHELGQYVKDQLSSIQSSMRSIGDVRGRGLMIGVEIIDPRKQPNAIGSYPAYGELAKAIQRHCFERGLILEVGGRFSSVIRFLPPLIITREQLDDVLERFYDATVQAEIEFGIR

SEQ ID NO: 9505 - protein, 308 aa, Bacillus halodurans C-125
MWKQDETLEQIVLECKKYTEEGTVASYIPALAKADVSTLGIAIYRGGDEQVIAGDADEKFTLQSISKVIALALALLDVGEEAVFSKVGMEPTGDPFNSISKLETSVPSKPLNPMINAGALAVTNMIIGETTEQSLGRLLSFIHELTKNPTITYNLEVAQSEFDTAFLNRSLSYFLKQHGVIQADVEQLLDLYTKQCAIEMCCSDLARIGYVFANEGRDPDTGQRIVPLHVARIIKTFMVTCGMYNASGEFAIRVGIPAKSGVSGAILALVPNKYGIAVYSPALDEKGNSLAGIKLLETLSCREEWSIF

SEQ ID NO: 9506 - protein, 299 aa, Bacillus halodurans C-125
MSQKVGFVGLGTMGLPMTKHLVDKGFETYVKSRSRGPIEEAIQYGAIEVESYKELMETADIVMTCLPLPETVIDVYEGEDGLIAGLSQGKILIDHSTVDRETNVRVAEQIKEKGGAFLDAPVSGGPMGAKAGTLTIMCGGEADSFERSKEVLGAYGDYIVHVGPIGSGTVVKLANNMVIGVHQAVLGECYLFVEKAGVDPAIAYEIIKRSAGFSKSMEWSVDAILDRAFDPRFSINLLHKDIGLALKLGEQLGIPLEMVEKGEERVRAAKEQYGHEDVSAIIRPLEEKLGLELRRKSSS

SEQ ID NO: 9507 - protein, 469 aa, Bacillus halodurans C-125
MVVGDFAKEVDTLVIGSGPGGYVAAIRAAQLGQSVTIVEKGTLGGVCLNVGCIPSKALISAGHRYHNALHSDDLGIKAENVTLDFSKVQEWKASVVNKLTGGVEGLLKGNKVEIIKGEAYFASEDSVRIMDEKNATTYKFKNCIIATGSRPIELPNFKYSKRIINSTGALALEEVPKKLVVIGGGYIGIELTGAYSNLGSDVVVLEGGKQILPGFEKQMAKLVERKLKKNGVSFHTEAMAKGVEETEDGVKVTAEIKGKEEVFEADYVLVTVGRKPNTDELGLEQIGVELTERGLIKVDKQCRTNLSNIYAIGDVIEGPALAHKASYEGKIAAEAIAGEKSEIDYLAIPAVVFSDPELATVGYTETEAKEAGYDVTAAKFPFAANGRALSLNDADGFMKLITRKEDGLVIGAQIAGPNASDMIAELGLAIETGMTAEDIALTIHAHPSLGEITMEAAEVALGTPIHIVK

SEQ ID NO: 9508 - protein, 298 aa, Bacillus halodurans C-125
MEIGLIGLGRMGYNLGLNILDHEHQLVAYDVNREAVKEIGLAGAKEADSLEELVSKLSAPRKIWVMVPAGDITENVVSQLSSLLDEGDVVIDGGNANYKDTLRRAKQYEAKGLHFVDAGTSGGIDGAREGACLMVGGTKEVVESLAPLLKEIAVEDGYLYTGPVGSGHFLKMIHNGIEYGMMQAIAEGFDLLENSPFDYDYEAVAKVWNNGSVIRSWLMELTESAFSKDANLEKIRGVMHSSGEGKWTVETALDLQIEAPVIALSLMMRYRSLRDDTFSGKVVAALRNEFGGHAVVKS

SEQ ID NO: 9509 - protein, 324 aa, Bacillus halodurans C-125
MLQQKQSLLEHKPVLSKELEKLVNHYRTLSLNGQCAQYIPALREANQTYLGLYVVHSNGIEIKSGDWQVPFTLQSISKIINFIAACLDRGITYVLDRVDVEPTGDPFNSMVRLEMRKTGKPFNPMINAGAITVASLLSGKSPTEKLESVYSLVEKMLGRRASANEAVFHSEWQTAHRNRSLAYYLKDTGYLESEVDDALHVYFTLCAIEVATKDIAKIGLILANNGYDPLSHQQIFPKEVAKLTKALMLTCGMYNASGTFAAHIGIPAKSGVSGGIMAAVPARGRSDEAMGIGIYGPAIDDFGNSVAGVALLKHLSHMWDLSIF

SEQ ID NO: 9510 - protein, 474 aa, Bacillus halodurans C-125
MAEEYDLVILGGGTGGYVAAIRATQLDLKVALVEKGKLGGTCLHKGCIPSKALLRSAEVFSTVQKADQFGVKIDGAALDFTSVQNRKEQIVTQLHRGVEMLMKKGKIDVYKGHGRILGPSIFSPTPGTISVEMNNGEDNMMLIPRNVIIATGSSPRVLPGMEIDGEAVLTSDEALKMEQLPKSMLIVGGGVIGIEWASMLNDFGVDVTVIEYGPRILPTEDADIAKEAERLLKKRGVTFKTNAKVLAETLEKGDNSVVIEAEVGGVSERFTAEKMLVSVGRTPNVNDIGLENTDIEVIDGAIAVNEWYQTKESHIYAIGDVIGGMQLAHVASHEGILAVEHMTDHKPEPLNYLTVARCVYSHPEMASIGLSEAEAKEKGYEVKVGTFPFQAIGKALVYGESDGFVKILSDKKTDDLLGVHMIGPHVTDMISEAALAKVLDAAHWEVAHTIHPHPTLSEVVGEAALAVDGKAIHF

SEQ ID NO: 9511 - protein, 157 aa, Bacillus halodurans C-125
MSIHEFSARLINGEEKALSDYKDQVLLIVNTASKCGLTPQYEELQILYETYKDQGFTVLGFPSNQFMNQEPGDHNEIAAFCERNYGVSFPIFEKVKVNGKEAHPLFQYLTSQQGGLFTEKIKWNFTKFLIDRSGNVVKRYAPSTSPIKIKDDIEELL

SEQ ID NO: 9512 - protein, 384 aa, Bacillus halodurans C-125
MSHLFPTYAKWDVTITSGKGTKLYDNQGNEYLDFVSGIAVCNLGHCHPKVVAAVEEQLHSFWHVSNLFHIPIQENVAALLTEQSGMDAVFFCNSGAEANEAAIKLARKATGKHEIVTFTQSFHGRTLGTMSATGQDKIKTGFGPMLETFHHVPFNDIAALKQVVNEQTAAIVLEVIQGEGGVNLIDPEFAASVNHVCQEHGILLIIDEIQTGIGRTGTAFAFQQYELTPDIITVAKGLGNGFPVGAMLGKQHLIDAFSAGSHGSTFGGNPLAMAAAQAVLTEVFQPNFLQAVQEKGKQLLSGLNEALSGLEIVKEIRGNGLLVGIELQEEGAPFIKQLREKGLLVLNAGPNVIRLLPPLVVTSEELHEAVTQLKEVLDQASVHA

SEQ ID NO: 9513 - protein, 461 aa, Bacillus halodurans C-125
MAMVEDTRPEHTYAEQTPRSKSWIEQAKKVMPGGITANIKHFAPYPIVMKKGCGAFITDVDNHQYVDYLLAYGALMLGHGHPEVKQAIDEMFADSGTLLFGAPHPLEVTFGHEIQQLYPSMERLRYTNSGTEATLLAMRIAQAYTNKKRIAKFEGHYHGGYNDVLYSVSPTLSEAGPADAPIPVKESKGMHVTDGEEPLILPFNNLTACERLLRAQQDSIAAVMIEPLQGGFIPATDTFIAGLRELTEELGIVLIFDEVKTGFRIRLGGAQEWYGVSPDLTTLGKVIGAGFPFGIVGGRKDIMEVTSPTTGSDVFDQSQSTFSRAKDVVFHSGTYNGHPLILAAGLKTVDVLKRDIKDVFARTDMLKDELEALFVRKGVPMKAVGIGSIFSVVLTEEDIFNYRDLQASDLQTRKLIDLHLLNEGIYTKPLNRYSLSTAHTEREVERTISAYDRVLSRLFGG

SEQ ID NO: 9514 - protein, 300 aa, Bacillus halodurans C-125
MDRKKIAVIGAPMDLGQNRRGVDMGPSALRYAGLIERLQSIGYHVDDMGDIPIDRPGEVSEEKTNLKNLGEVIKANELLCLHVEKAVANGYFPLVLGGDHSIAIGTLAGVAKRRHQLGVIWYDAHGDLNTAETSPSGNIHGMPLAVSLGIGHEKLTSIGGFAPKIKPENVVIIGARSLDEGEKAYIREHGMKIFTMHEVDRLGMTRVMEEAIAHVSNGTDGVHLSLDLDGLDPNDAPGVGTPVLGGISYRESHLAMEMLAEAEIVTSAEFVEVNPILDERNKTAEVAVELMGSLFGEKLL

SEQ ID NO: 9515 - protein, 429 aa, Bacillus halodurans C-125
MKTFEKSSAAFNRAKPLMPGGVNSPVRAFKSVNMDPVFMERGKGANIYDIDGNEYIDYVLSWGPLILGHADDQVVEKLKETTEKGTSFGAPSELETKLAELVIERVPSIEVVRMVNSGTEATMSALRLARGYTGRNKILKFEGCYHGHGDSLLIKAGSGVATLGLPDSPGVPETVAQNTLTVPYNDLESVRYAFEQFGDDLAGVIVEPVAGNMGVVPPEPGFLEELRRLTEENGTLLIFDEVMTGFRVGYHCAQGAFGITPDLTCLGKVIGGGLPVGAYGGKREIMEQIAPSGPIYQAGTLSGNPLAMTAGYETLVQLTEANYEYFDRLGDRLAEGLSAVAKEYDIPHYTSRAGSMVGFFFTDKKVKNFADASSSDLEFFAKYFKEMLHLGVSLPPSQFEGMFLSTKHTEADIDFTVDAARQAFKRLKK

SEQ ID NO: 9516 - protein, 357 aa, Bacillus halodurans C-125
MSIVIQNVSKSFGSFQALADINLSIETGELVALLGPSGSGKTSLLRIIAGLEAADQGDIYFHKDKVTQTHAASRQVGFVFQHYALFPHMTVADNISYGLRVKPRKERPSKKEIAEKVRELLALVKLEGMDDRYPAQLSGGQRQRIALARALAVEPKVLLLDEPFGALDAKVRKDLRKWLRKLHNEFQVTSVFVTHDQEEALDVSDRVVVMNQGKIEQVGSPDEVYEQPKSPFVYDFLGNVNVFTGRVKQGFVQLDKHQLKTPTISKDIHDQEAVVYTRPHHMEISRKKQKDAIPAVIEHIHMVGPIAFLELNWKDDEEVLQVELAKDRFHELDLKKGETVFVVPKNLTLFFPEEFTI

SEQ ID NO: 9517 - protein, 282 aa, Bacillus halodurans C-125
MLKDFFSKKKRYATIPSERAKHDIPEGIMTKCPSCRTIMYTKELKKNLYVCDSCGFHHRMNAFDRIESLLDPGTFVELDKGMTTEDPLSFPTYREKVEADRKKTNLNEAIVTGEGTMNGFPLVIGVMDARFRMGSMGSVVGEKITRAIERAIENKQPFLLFSASGGARMQEGVLSLMQMAKTSAALERLDRVGGLFISVMTHPTTGGVSASFASLGDYNFAEPGALIGFAGRRIIEQTIREELPNDFQTAEFLLKHGQLDRVIPRSEMKDTLTKILDIHHVS

SEQ ID NO: 9518 - protein, 385 aa, Bacillus halodurans C-125; identical to SEQ ID NO: 849

SEQ ID NO: 9519 - protein, 389 aa, Bacillus halodurans C-125
MKKASFVYSENQLSYQFHSTHPFNHQRLRLTYDLLKSMDALDDSEIVAPRVATEAELRLIHDQAFIDAVKAAGNGTLSDGVALNYGLGTEDTPIFKNMHEAAALLVGGTLTAVDQVMEGHAEHACHLGGGLHHGFRGKASGFCVYNDSSIAIEYMRRKFGARVLYIDTDAHHGDGVQWAFYEEDDVCTLSIHETGRYLFPGTGNFNEKGQGEGYGYSINIPLDAFTEDDSFLFAYEQAVTNVVKFFKPDVILTQNGADAHFHDPLTHLCASMRTFRYIPQLAHALAHEYCEGRWIAVGGGGYDIWRVVPRAWAMIWLEMTDQLQKANGPLPERWLSKWTTYAQHPLPSHWEDENEELPTIPRRDEITEKNKKIVEKALYHIYTELKTQT

SEQ ID NO: 9520 - protein, 312 aa, Bacillus halodurans C-125
MKIVNNIAELIGDTPLVRLNRLPNPKGAAVYLKMEMFNPSGSVKDRAAYQMIVQAEKDGYLKPGSTIIEPTSGNTGIGLAMNAAARGYRAILTMPDTMSEERINLLKAYGAEVVLTEGEKKMPGAIEKAHELVREIPNSFMPMQFENSANPDAHRFTTAVEIKKALDSIGKKLSAFVAASGTGGTITGTGEELKKFYPNVEIHVVEPFGSPVLSGGKPGPHKLVGTSPGFVPPILNQDVYDVIDKIKDEDAYEAARNLARLEGILVGPSSGAACYAAMKVAERLAPDEVVVCIACDTGERYLSTDLFDFESQ

SEQ ID NO: 9521 - protein, 324 aa, Bacillus halodurans C-125
MRLLFTRALDPEWIEPLKDEHDIRMWTEENIPMPRELFLKELEEADGVFTNLTDRFDVEAFERAKRLKVVSTMAVGYDNIDIKEATKRGVSVGHTPGVLTEATADLTFALLMATGRRLRESIDYVRNDQWKSWGPFMLTGQAIYGTTLGIIGMGRIGQAVAKRAKGFNMTLLYHNRSRNEQAEKELGATYCSLDHLLARSDYVVLLAPSTDETRKMMGPAQFQKMKSTAHFINTSRGTNVDEQALYRALTEGWIAGAGLDVYEKEPISADHPLVQLPNVVALPHIGSAEVGTRREMVRLAIENLLLGIKGKSLTHIANPEVLEK

SEQ ID NO: 9522 - protein, 475 aa, Bacillus halodurans C-125
MFRGKLYIDGTWTGDLLDTFDVKNPATGEVVGVMPNGGKAEAAAAIEAAQRAFLKWRKYTAAERANFLMTWHDLLLQQKEEIAEMLTMEMGKPLAEARGEIEYSASFIRWFAEEGKRVYGRTVPASAENKRIHVQKQPVGVVAAITPWNFPAAMIVRKMAPALAAGCTFVGKPAELTPLTAVKIVELCEEAGFPKGVVNLVCGDAKEIGEEMTSHEHVRKLTFTGSTAVGKLLMKQSAGRMLNLSLELGGQAPMIICDDADLDKAVAGVVASKYRNAGQTCVCGNRIYVQETIVDEFVKRLTGKVVQLKVGNGLEEGVHIGPLIEKKGYEKVKAHVDDAVAKGARVVIGGKGQEGNDSYFYDPTILTDVHDEMLVMQEETFGPVAPIQTFATDEDVIEKANGTRYGLAAYFFTENYARGIRLSEALDFGIVGWNDGAPSIAQAPFGGMKESGLGREGGQEGIEAFLETKFVSIGL

SEQ ID NO: 9523 - protein, 450 aa, Bacillus halodurans C-125
MSGKVCFDYSKALDFIQEHELDNLQDQVHAAHRALHDGTGAGNDFLGWIDLPVNYDREEFSRIQKAAEKIRNDSDVLLVIGIGGSYLGAKATLEALNHSFYNIVDKSERKGPQIFFVGHHISSTYVQELFDVLEGKDVSINVISKSGTTTEPAIAFRIFRDYLEKKYGKEESRKRIYATTDRERGALKTLANEEGYESFIIPDDVGGRFSVLTAVGLLPIAASGLDIEAMMKGAADARDAFRNSDLKENPAYQYAVVRNALYNKGKTIELMVNYEPALQYFSEWWKQLYGESEGKDGKGIFPASVNFSTDLHSMGQYVQDGRRDLFETIIQVEKPKKNMTIEKADQDLDGLNYLAGETMDFVNKKAFEGTLLAHVDGGVPNLVVSVPELDEYYMGYLMYFFEKACGLSGYLLGVNPFDQPGVEAYKKNMFALLGKPGFEEQKAALEKRLK

SEQ ID NO: 9524 - protein, 429 aa, Bacillus halodurans C-125 [sequence omitted]

SEQ ID NO: 9525 - protein, 510 aa, Bacillus halodurans C-125
MSKKPVALIILDGFAMRDEAKGNAVAQANKPNFDRYWNQYPHALLKADGEAVGLPEGQMGNSEVGHLNIGAGRIVYQSLTRVNLSIREGEFFENETFLNAMNHVKEKGSSLHIYGLVSDGGIHSHINHLYALLELAKREQVERVYIHGFLDGRDVGPTSAESYLVDLEAKMKELGVGELATLHGRYYAMDRDKRWDRVEKSYRAMVYGEGPAYSSALDVIKDSYENSIHDEFVIPSVITNEDGSPVATIEDDDAIIFFNFRPDRAIQMSQVFTNKDFRGFDRGEKLPQNVYYVCLTHFSETVQGDVAFKPTNLDNTLGEVLAQQNYKQLRIAETEKYPHVTFFFSGGREEPFPGEERILIDSPKVATYDLKPEMSAYEVTDALLNEIEADKHDVIILNFANPDMVGHSGMLEPTIKAVEAVDECLGKVVDAILAKGGAAVITADHGNADEVVTLEGKPMTAHTTNKVPVIVTEEGLNLREDGILADLSPTVLDLLGGKQPAEMTGKTLIK

SEQ ID NO: 9526 - protein, 251 aa, Bacillus halodurans C-125
MRKPIIAGNWKMNKTVGEAKAFVEEVKGAIPSSDKVDSVVCSPALFLEGLVQKAEGTELRIGAQNMHFEESGAFTGEISPVALSDMKVDYVILGHSERRDMFAETDELVNKKTHAAFAHGLTPIVCVGETLEEREANQTYDVVKTQVEKGLEGLTDEQVKVTVIAYEPVWAIGTGKSSSAEDANDVCSYIRKVVTEKFSQEAADAVRIQYGGSVKPANIAEYMAQSDIDGALVGGASLDPQSFLQLLEAVK

SEQ ID NO: 9527 - protein, 394 aa, Bacillus halodurans C-125
MNKQSVRDVELQGKKVFCRVDFNVPMKDGVVTDDTRIRAALPTIQLLAEKGARIILASHLGRPKGEVVEELRLDPVAARLQELLGKPVAKVNVAHGPEAEQAANELKDGDVLLLENVRFYPGEEKNDPELAKAFASLADVYVNDAFGAAHRAHASTEGIAHHVTAVAGLLMEKELEVLGKALSNPERPFTAIIGGAKVKDKIGVIENLLDKVDNLIIGGGLAYTFIKAQGHEIGKSLLEADKMDLALSFMEKAKEKGVNFYVPQDAIVADDFSNDANTKAVDIDQIPADWEALDIGPKTRETYRNVIQSSKLVIWNGPMGVFELDAFAGGTKAVAEALADANDTYSVIGGGDSAAAVEKFGLANQMSHISTGGGASLEFMEGKALPGVVALNDK

SEQ ID NO: 9528 - protein, 350 aa, Bacillus halodurans C-125
MESIKVVIVGGGQAGIAMGYYLVKEKVPFMILDANEQVGDSWRNRYDSLVLFTPRTYSQLPGFPMDGAPNGFPTKDEMASYLQQYANHFNLPMRHHTKVDRVTRQQNGRFHLKTTNGWIEAEKVVIATGAFQKPYLPPVLDSANNEMSQVHSSAYRNPAQIPGKSVLVVGGGNSGAQIAVELAKERNVTMAISHPFRFLPLKLLNKSMFSWLEWGGLLYAGIDTTRGRWFKKQKDPIFGKELKSLIKKGQIHLKPRVMNVQGKEVEFADHSRLSFDRIIWSTGFSPSYEWIDIDGVIATNGWPIHNRGITNIRGLYFLGLPWQYQRGSALVCGVGRDAEYLVPFIKHGDK

SEQ ID NO: 9529 - protein, 1072 aa, Bacillus halodurans C-125
MRKNKASKVSVLFMIVLLVLSLFTPIMPMHEANADTEADTLRIHYQRSDQQFENLGLWLWGDVRYPSENWPSGGTPFEPEKMTDYGAYVDIELKENAENIGFLVLNTATGDKDGNDKHVQLLSPEMKEIWIKEGSDDVFLYEPVDLPDHTVRIHYERSDQSYHHWGLWTWKDVASPSEHWPSGANPFSDEQTSRYGAYLDVELADDANEIGFLVVNRENGDKDGDDKTFADLANHPQLFIRQGDDTVYTNPYYQTIEGLVSGELISLTEMELRFTSTIWLSEDDLAEQIHLTDTNGASVAFDHVTIHDEKTVILHGSFDAELAPYHVTFADKTVVARAGWRLIDALYGYDGELGAVLHEDGSSTLTFWSPLADHVSVVLYDKDDQYRIIKDDIDMTKGDQGVWQVTLHSENTGLDNLAGYYYHYKIERDGDTKLGLDPYAKSMAAWNNEGSYSIGKAAIVDPSSIGPELDFAEIEGFEKREDAIIYEVHVRDFTSDPGIEEELTAQFGTFASFVDKLDYIEDLGVTHIQLLPVMSYYWGDELANHERELAYSSSGNNYNWGYDPHSYFSLSGMYSENPEDPELRIKEFKHLIDEIHRRGMGVILDVVYNHTAAVEIFEDLMPNYYHFMDADGTPRTSFGGGRLGTTHKMSRRILVDSITYWVEEYKVDGFRFDMMGDHDAETIQIAYDRAKELNPNIVMIGEGWRTYVGDEHGGDIMPADQDWMQHTESVGVFSDEFRNELKSGFGSEGQPRFITGGARNIEQIFDNLTAQPHNFTATNPGDVVPYIEAHDNLTLHDVIAQSIRKDPEYHQEEIHKRIRLGNTMVLTAQGTAFLHAGQEFGRTKQFRADTGGQAPYKSTYMTDENGKPFVYPYFIHDSYDSSDAINKFDWGKATNKEKYPIHHLTRTYTAGLIELRRSTNAFTHGTLVDVQANVRLLDIPEISETDLVIGYRATSTDNTGTYYVFVNADTKERTLSLTDDLTEGVVIVDSDEAGIVAVSDPSGFDLTPNEITIDPLTAVIIRVGGDFQENPHDGHPGKGGGKAKGRPDHAGQPGPPPHAGEKGKPDHASKKK

SEQ ID NO: 9530 - protein, 317 aa, Bacillus halodurans C-125
MDVVTFGETMVVFEPVEMGALRYVDRFKKGVGGAESNVAIGVAKLGHSVGWVSKVGNDELGKYVISAIRGEGVDTSQVVLDDGAPTGLYLKEKLRDDFNRVYYYRAGSAASRLGVEDINWAYMKQAKIIHITGITPLLSDSCYELCHAVLDFAKENGIFASFDPNLRMKLLANVPDGKERLLALASKADLVMPGRDEAAFLFDTDELAQMFSRLLTGRTTSVVIKDGAKGAHFMEEGKEPQFVPSCPVDKVVDPVGAGDGFAAGVLASLLEGKSMEEAVSVGTQIGALVVMAKGDMEGLPEREQLEAFSQARSDVLR

SEQ ID NO: 9531 - protein, 436 aa, Bacillus halodurans C-125
MKYVIIGGDAAGMSAAMEIVRNEEAANITTLEMGSIYSYAQCGLPYVVGGVIPQTEKLIARTIETFRNKYGIDARTNHEVTKIDPDSKHVYGANFEIPYDKLLIATGARPLVPNWPGRTLAGIHTIKTIPDTEVLLADLKGEIKNVVIVGGGYIGLEMAENLALTGKNVTIVEANAQLAAIFDQEMGEIIHQEAERKGVTLRLKEEVKGFEGTDRVQAVVTSSATVPAELVIIAIGVVPNTTFLEGQPFHRHENSALKVNAYMETNLPDIYAAGDCATQYHRIKKLDDYIPLGTHANKQGRLAGLNMVGKRRAFAGVVGTSIIKFFDLSLGRTGLSEKETRDARLPASSITFDGRDIAGYYPGAEPLKIKLVYHSETNQLLGGQVIGTNGVAKRVDVLATALYQQLTLEELLDLDLSYAPPFNGVWDPIQQAARRA

SEQ ID NO: 9532 - protein, 275 aa, Bacillus halodurans C-125
MELWYTEKQTEHFGITAKIKRTLHTEKTDFQQLDVIETEEFGNMLVLDGMVMTTEKDEFVYHEMVAHVPLFTHPNPKHVLVVGGGDGGVIREVLKHPSVEKATLVEIDGKVIEYSKKYLPSIATALNDPRVDVQVDDGFLHIAKAESAYDVIMVDSTEPVGPAVKLFEKGFYQGIAKALKEDGIFVAQTDNPWFHGELIRKVYADVQEIFPITRLYTANIPTYPSGLWTFTIGSKTYDPLHVEPSRFYDIETKYFTKDLHKAAFALPRFVDDLIK

SEQ ID NO: 9533 - protein, 333 aa, Bacillus halodurans C-125
MMRSSIVKLVAFSVVVMLWLGVSFQTAEANTPNFNLQGFATLNGGTTGGAGGDVVTVRTGNEFINALKSKNPNRPLTIYVNGTITPSNTSDSKIDIKDVSNVSILGVGTNGRLNGIGIKVWRANNIIIRNLTIHEVHTGDKDAISIEGPSRNIWVDHNELYASLNVHKDHYDGLFDVKRDAYNITFSWNYVHDGWKAMLMGNSDSDNYDRNITFHHNYFKNLNSRVPAYRFGKAHLFSNYFENILETGINSRMGAEMLVEHNVFENATNPLGFWHSSRTGYWNVANNRYINSTGSMPTTSTTNYRPPYPYTVTPVGDVKSVVTRYAGVGVIQP

SEQ ID NO: 9534 - protein, 421 aa, Bacillus halodurans C-125
MDSIALMDNVWIMLCAVLVLLMQGGFILLEAGSTRMKNAGHIAGKTIFTVGIASLVYWAVGWGFTYGEGNAFIGLSDFFFGDYSTAEEGLVGSVDFFFQLMFAAIALTIAFGGFAERAKLSVYILFAVLFSAFVYPIVAHWIWGDGWLADLGKQDFAGSTVVHLTGAMGALAATILLKPRLGKYNKDGSMNDIQGHNQVYTALGVLLLWVGWFGFNAGSTLEVADAFFGYVALNTQLAAAAGAVAAMFIAWALSGKADVPTTLNGALAGLVAITASCAFVAPWAAVVIGIVGGLIVYFSMKFFDKAKIDDPIFALSVHGVAGVWGTLSTGFFATPELAEMNGGQAGLFYGGGFAQLGVQTLSVVACGVFAFIASYVLLLVCKSVLGGLRVTEEEEIIGLDLSEHGSYGYPESMPGSEKSGA

SEQ ID NO: 9535 - protein, 455 aa, Bacillus halodurans C-125
MKMTTVSVPTRESLIEEIKETIKTKNVELLHLQFVDIEGILKHVTVTAEQIDSVVDGKIMFDGSSITGFTPINQSDLYLQPDLTTFAVLPWTEEEGYSEGRFLCSVKKPDGSDFEGDPRNILKKTVERAKEKGYSISVGPELEFFLFETDEYGLPTKQTQDIGGYFEPSPKDNGEKVRLEIYRTLKAMGFTIEASHHEVAEGQHEINFKYADALGSADAATTYKWVVKTVAKQFGLHATFMPKPLGGANGSGMHTNISLFDDEKQENAFYDESDKLGLSKTAYQFIAGLIENVKDFVAVTNPLVNSYKRLVPGYEAPCYIAWSASNRSALIRIPATRGAGTRVEIRCPDPAANPYLAFAVVASAGLDGVEQELTAPASVDADIFHMSAEEIAERGIENLPTSLEEAINRFEEGEIGKKTFGEHAFGEYVALKRGEWDEFRTTVHDWEVAAYQGKF

SEQ ID NO: 9536 - protein, 466 aa, Bacillus halodurans C-125
MTKDTVTYRFPEGFWWGSATSATQTEGATHRDGKGKNIWDHWYEVEPSRFFQGVGPQDTSQFYERYKEDIQLMKEVGHNSFRFSISWSRLIPDGRGEVNPKGVEFYNNVIDELLGQGIEPFVNLFHFDMPMELQKIGGWANREVVDAYEAYAKTCFERFGDRVKKWFTHNEPIVPVEGGYLYDFHYPNEVDFEKAIQVGYHTVLSSAKAIRAYKQLNQGGKIGIILNLTPSYPRSNHPADLKAAKIADAFFNRSFLDPSVKGEFPEELVQILKEEGFMPIIEEEDLEIIRQHTVDLLGVNYYQPRRVKAKETLPNPDAPFMPERYFDHYAMPGRKMNVHRGWEIYEKGIYDILINLKEHYGNIECFISENGMGVEGEEKFRDENGVIHDDYRIEFIQDHLKWVHRAIQEGSNVKGYHLWTFMDNWSWANAYKNRYGLVSVNLDKNGERTIKKSGKWYKTLSENNGF

SEQ ID NO: 9537 - protein, 305 aa, Bacillus halodurans C-125
MRTIKLGSSSLEVPVVAVGCMRINAISKKEAERFVQTALEQGANFFDHADIYGGGECEEIFADAIQMNEAVREKIILQSKCGIREGRFDFSKEYILQSVDGILQRLKTDYLDVLLLHRPDALVEPEEVAEAFDLLESSGKVRHFGVSNQNPMQIELLKKFVRQPIVANQLQLSITNATMISSGINVNMENESAINRDGSVLDYCRLHDVTIQPWSPFQYGFFEGVFLGNDLFPELNKKIDELAEKYEVSNTTIAIAWLLRHPANMQPVIGTMNLKRLKDCCKASEIRLTREEWYEIYRAAGNILP

SEQ ID NO: 9538 - protein, 400 aa, Bacillus halodurans C-125
MKMQSSTSAVIEKTEKYGAKNYHPLPIVISEAKGVWVKDPEGRKYLDMLSAYSAVNQGHCHPKIIQALKDQADKITLTSRAFHNDQLAPFYEKVSKLTGKNMLLPMNTGAEAVETAVKAARRWAYDVKGVPDNQAEIIVCEDNFHGRTMTAVSLSSNDEYKRGFGPMLPGIKVIPYGDLEALKAAITSHTAAFLVEPIQGEAGIRIPQEGFLKEAYALCKRENVLFIADEIQSGLGRSGKWFACDWEDVKPDMYILGKALGGGVFPISVVCADRDILGVFEPGSHGSTFGGNPLACAVSIAALEVLEEEKLVERSYEYGNYLLTKLKEIDNPIIKDVRGRGLFIGVELHEPARKYCEQLKEEGLLCKETHETVIRFAPPLVISKEDLDWAIEKIYYVLKP

SEQ ID NO: 9539 - protein, 301 aa, Bacillus halodurans C-125
MNKFQKVSIIGVPMDLGQKRRGVDMGPSAMRYAGLIEEIEALGFEVKDYGDIPINRPATSETQEGPLRNLDEVVKVSEELCKGVAAIEAEHSFPLILGGDHSISIGSIAGIRKSYNNLGVIWYDAHPDLNTEETSPSGNIHGMPLAVNLGIGHERLMNIGGITPKVKPEHIVIIGARSIDEGERQLIREQGIKVYTMHEVDRMGMTRVIEETIDYLSARTDGVHLSFDLDGIDPVDAPGVGTPVLGGISYRESHLALEMLAESELITSAEFVEINPILDNKNQTANVAVALVTSLLGKKLL

SEQ ID NO: 9540 - protein, 402 aa, Arabidopsis thaliana
MAEISGLPDDLLVKILAFLPTKVAISTSVLSKQWRFLWMWLPKLKYDDYDDITDGFNSVSAFQTYRDFIAKNLPLHRAPIIESLSLGFRCGTLQPEDLKSWVEVAVSRSVRELSILAYYRNNYALSSSSLYTCKSLVTLKGFNIRVDVPPTVCLLPSLRTLELKRVRYLNEDSLRMLLSFCPVLEYLSIERHDNDNLRGLVVDVPSLRRLSLTSYTGCSSDDYVIVTPSLKYFKAFDYRSEISSYKIEKIPELEEADISIERNPEKLFVYFKSIKCLSLQVDFNSKEEPGYDSGIVFNHLEELTPYINDANWSKLLFRLLNDSPKLRVLEISNSKSFYKEKIGEYLPVSWSKNQGSVPKCFLNSLETFRVKWYYSEEQEDRDFLSLIFKHARCLKSTSILHR

SEQ ID NO: 9541 - protein, 464 aa, Arabidopsis thaliana
MAVKKKSSWRSLMVLCFQDPDNIYSPKKTKKDDGERVITKQKSFLGLSILDISNPSSTTLSEDLSISLAGSDLHVFTQAELRVITQSFSSSNFLGEGGFGPVHKGFIDDKLRPGLKAQPVAVKLLDLDGLQGHREFMTEVMCLGKLKHPNLVKLIGYCCEEAHRLLVYEFMPRGSLESQLFRRCSLPLPWTTRLNIAYEAAKGLQFLHEAEKPIIYRDFKASNILLDSDYTAKLSDFGLAKDGPQGDDTHVSTRVMGTQGYAAPEYIMTGHLTAKSDVYSFGVVLLELLTGRKSVDIARSSRKETLVEWARPMLNDARKLGRIMDPRLEDQYSETGARKAATLAYQCLRYRPKTRPDISTVVSVLQDIKDYKDDIPIGIFTYTVPTKPRREVKETSLQNFDKPRRETKVTSLQNFDKTRREVKDTTTDNHQKFRSPAHTARNHRITLRNGYNSPMRNEAGGERY

SEQ ID NO: 9542 - protein, 410 aa, Arabidopsis thaliana
MDKINGLPDDLLVKILSYVPTDIAVSTSILSKRWEFLWMWLPNLDYTSRWCRKPGDVGLRDFIHKNLPLHRAPVIESLRFHSNSPDIKPEDIRRWIEIAVSRHVHDLDIDHFSENENIFLSSFFACKSLVTLKLRSVTLRDIPSMVCLPSLKTLLLDNVSFVEGKSLQELLSICPVLEDLSVYCDDYENTKELTIVVPSLLSLSLYIPDEWLLDGYWIDTPSLEYLKLEDWNSCDHLSLIKNMPKLREAYVDAKCFLPKSVIESITSVKHLTICSKDGYGDGFVFNQLEHLTLCVCRGDSPSLLGQLLKDSPNLRILEISVMEDHVDDVGISLDGWNQPSSVPECLLSSLQIFKWPQYLGRPEDRDIAVYILKNARHLKKTTILADRCERFVTQRRMIKELLQALPARIC

SEQ ID NO: 9543 - protein, 457 aa, Arabidopsis thaliana
MFSLILHGGRRSRELHQWRNLNLLLQNSSAFTESFSSVVTTTKDLSLEDERKRKTFTVSYLIDSLGLTTKLAESISMKANFDEKGNPDSVLKLLRSYGFKDSQISSIISTYPRFLIENPEKTLRAKLHFLKLNGASSSELTEIVSKVPKILGKRGGKWISHYYDYVKEILQDQDSSSSSSKRKQTNRNRNVSVLRKLGVPQRLLLNLLISRAKPVCGKERFEESVKKIVEMGFDPKSPKFVNALYVFYELSDKTIEEKVNAYIRLGLSVNEVWAVFKKWPFSLKYSEKNIIQKFETLKRVGLTKEEVCLVVKKYPECVGTSEEKIVKSVKTFLELGFTKDEVLMIIKRHPQCIGLAADSVKKKTEFLVKTMGWPLKVVASTPIVLGFSLEKFVLPRCNVIKALMSNGLIGEMPAISSVLTSPKLKFLKLFVEKHQDVLPELNSIFTGDSILINKIAL

SEQ ID NO: 9544 - protein, 346 aa, Arabidopsis thaliana
MGRFKNNKKSRVIGKPIAKKNQEDVSHVTGDKIPKSFVFSRMKLAGPVKQLQMDLRKLMLPYTALSLKEKKRNTLRDFLNVSGPMGVTHFLMLSKTASSLSLRVARTPQGPTLTFKIHQYSLASDIAQSQLRPRCPQDLFKSPPLIVLSGFGSQELHLKLATIMFQNIFPAIDINTVKLSTCQRLVLLNYNKDTKLIDFRHYSIRLQPVGVSRRIRKFVQNHQVPDLRNLQDVSDFVTKAGYGSESEGDEEAATVTLSSDLGRVNKGATKSAVKLQEIGPRMTMQLVKVEEGLCTGGIIFSEYEDVDGKKEKLKKKQDEEEEEDSEEEGEEGSEEDGEDMDEDFED

SEQ ID NO: 9545 - protein, 383 aa, Arabidopsis thaliana
MGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 9546 - protein, 510 aa, Arabidopsis thaliana
MSNIDIEGILKELPNDGRTPKTKIVCTLGPASRSVTMIEKLLKAGMNVARFNFSHGSHEYHQETLDNLRTAMQNTGILAAVMLDTKGPEIRTGFLKDGNPIQLKEGQEITITTDYDIKGDEKTISMSYKKLPVDVKPGNTILCADGSISLAVVSCDPNAGTVICRCENTAMLGERKNVNLPGVVVDLPTLTDKDVEDILKWGVPNNIDMIALSFVRKGSDLVNVRKVLGSHSKSIMLMSKVENQEGVLNFDEILRETDAFMVARGDLGMEIPIEKIFLAQKMMIYKCNLAGKPVVTATQMLESMIKSPRPTRAEATDVANAVLDGTDCVMLSGESAAGAYPEIAVKTMAKICIEAESSLDYNTIFKEMIRATPLPMSTLESLASSAVRTANKAKAKLIIVLTRGGTTAKLVAKYRPAVPILSVVVPVFTSDTFNWSCSDESPARHSLIYRGLIPVLGEGSAKATDSESTEEIIESALKSATEKGLCNHGDAVVALHRIGAASVIKICVVK

SEQ ID NO: 9547 - protein, 376 aa, Arabidopsis thaliana
MGRGSLRKLIGGGGEMASDSDRDVFSIFGPFHLTSIDWTNSYHRTSVASSLVNGVYTMERDKQEKRVGSESRAMPWWDFFNFSLVETLIDDYDSSIYGAVFEYKLSNLCQNTSHAKAPPRYVIAFRGTILESDTWMTDVKHNLKFSFNTLHEGGRSLQAIRAIRSMVDKHSEAAIWLAGHSLGAALVLLAGKTMTSFGFLLESYIFNPPISCIPLEQLPGGKKIKGVFQFTKTVVKATVAMVLTDLQVQEDDPKTASWIPYLYVNPADPICAGYIDYFRHKTFMSEIGASHIERIGAGKSVRSLLMGKSSSSDLSTEPLHLLPSADMIVNKNKPTKVMTAHGLHQWWERDSAMRENWESCCIRPYPDGKLEQLTIQ

SEQ ID NO: 9548 - protein, 311 aa, Arabidopsis thaliana
MEEEDDEVMVREGLMASQREIFSISGPIHLTSIDWNNSYHRTSVASCLVQAVYTLERDRQQNRIGLKSQANHWWEFFNFTLAETLIDDSDGSIYGAVFEYKHFFSYNYHHTPHSKPPPRHVIAFRGTILKPHSRSRDLKLDLRCIRDSLHDSTRFVHAIQVIQSAVAKTGNAAVWLAGHSLGAAVALLAGKIMTRSGFPLESYLFNPPFSSIPIEKLVKSEKLKHGVRFAGSLVKAGVAIAVKGRHHNKIQYAQNTLVTSSTETKCLRSEPVKSKELLRGTHLGVCCQEEEEEVHLQILLQSLFIFYHRHI

SEQ ID NO: 9549 - protein, 248 aa, Arabidopsis thaliana
MFGSGGYEVGSKRQRMMQSNPYLAVGTGPTSFPPFGYAGGFPVVRLRGLPFNCADIDIFEFFAGLNIVDVLLVSKNGKFSGEAFVVFAGPMQVEIALQRDRHNMGRRYVEVFRCSKQDYYNAVAAEEGAYEYEVRASPPPTGPSRAKRFSEKEKLEYTEVLKMRGLPYSVNKPQIIEFFSGYKVIQGRVQVVCRPDGKATGEAFVEFETGEEARRAMAKDKMSIGSRYVELFPTTREEARRAEARSRQ

SEQ ID NO: 9550 - protein, 419 aa, Arabidopsis thaliana
MDYKAPRRYYSHGVVARQQDFATDIVTRRRPYVPYDRPNKFSRSLVWTSKEYKSPEGNNMPRTNDVSPKPPVLGLARKNAACGPMRSSSLRKWVCKYWKDGKCKRGEQCQFLHSWSCFPGLAMVASLEGHNKELKGIALPEGSDKLFSVSIDGTLRVWDCNSGQCVHSINLDAEAGSLISEGPWVFLGLPNAIKAFNVQTSQDLHLQAAGVVGQVNAMTIANGMLFAGTSSGSILVWKATTDSESDPFKYLTSLEGHSGEVTCFAVGGQMLYSGSVDKTIKMWDLNTLQCIMTLKQHTGTVTSLLCWDKCLISSSLDGTIKVWAYSENGILKVVQTRRQEQSSVHALSGMHDAEAKPIIFCSYQNGTVGIFDLPSFQERGRMFSTHTIATLTIGPQGLLFSGDESGNLRVWTLAAGNKV

SEQ ID NO: 9551 - protein, 382 aa, Arabidopsis thaliana
MVSQKETVCVTGASGFIGSWLVMRLLERGYFVRATVRDPGNLKKVQHLLDLPNAKTLLTLWKADLSEEGSYDDAINGCDGVFHVATPMDFESKDPENEVIKPTVNGMLGIMKACVKAKTVRRFVFTSSAGTVNVEEHQKNVYDENDWSDLEFIMSKKMTGWMYFVSKTLAEKAAWDFAEEKGLDFISIIPTLVVGPFITTSMPPSLITALSPITRNEAHYSIIRQGQYVHLDDLCNAHIFLYEQAAAKGRYICSSHDATILTISKFLRPKYPEYNVPSTFEGVDENLKSIEFSSKKLTDMGFNFKYSLEEMFIESIETCRQKGFLPVSLSYQSISEIKTKNENIDVKTGDGLTDGMKPCNKTETGITGERTDAPMLAQQMCA

SEQ ID NO: 9552 - protein, 463 aa, Arabidopsis thaliana
MPNLDFDESFYFDPLMTCEERRKGSESFMLFVGSVLTLQAEANATLNRFYVKCEGVDQNSVLEWIPKVLKRGVLDIDLHIPSSRGFGSNSTFYPLPSEIFVSKTLVRLKIQFQDGVNVNVECDVSLPMLKTLHLDYVKMDTRMFQKLLSGCHMLKELLLMNLIWEESSEPEPCYVTVSVPTLKILKFSRFENFVKAKDFKPIVLWSFDIPNLVYLEYLDTIADKYQHVRFDSLVEARLGLCKTSKQIKNDNNNVTKLFMGICNVKILYLTEDALKVLGCCRETMPVFENLIQLTIKTGLHVGWKSLPPLLKNCPNLQTLVFEGLNHIYRKRRSCGDENRPCMCKNLDNMRVKKDIDACLSSSSVKVIKILNFGDTGDFCQFWEIEEDCEFWEIVEDVADHIKQVKQFLETMPDLEQVTLYYNTPQDEDVMKVFKKLKKLRRVASAKCEVQIISDNLNLSFTFR

SEQ ID NO: 9553 - protein, 502 aa, Arabidopsis thaliana
MAMIIGLLEIFIAFIFFFVYQCFSLHKKTPKHMVMNWPVLGMLPGVLFQIPRIYDFVTEALEAENMTGCFIGPWLSGTDILLTVDPVNIQYILSSNFVNYPKGKKFNKIFEFLGDGIFNVDSGLWEDMRNSSHAIFSHQDFQSFSVSTSVSKLSQGLVPILDNAVEKHILVDLQDLFQRFLFDTSSTLMAGYDPKSLSVEMPKVEFADAMDGVADAMFYRHLKPAFLWSIQSWIGVGIEKKMRRGLDVFDQMLGKIISAKREEIKNHGIHDSKGEAMDVLTYYMTIDTTKYKHLKPSNDKFIRDTILGLVIAARDTTSSALTWFFWLLSKNPEAMTKIRQEINKKMPKFDPADLDKLVYLDGAVCETLRLYPSVPFNHKSPAKPDVLPSGHKVDKNWRVVIPIYSLGRMKSVWGDDAEDFRPERWISDSGMLRQESSYKFLAFNAGPRTCLGKRLTFLQMKTVAVEIIRNYDIKVVEGHKPKPVPSVLLRMQHGLKVSVTKI

SEQ ID NO: 9554 - protein, 327 aa, Arabidopsis thaliana
MITDSITNASATSAPRDSGKKKRNNKSAKMKQNKLGLRREQWLSQVAVSNKEVKEERSVNRSQKPHHESSDKVRREEDNNGGNNLLHHESFMESPSNSSVGGTYSSTNFSGRSSRSSSSSSGFCSGNITEEENVDDDDDGCVDDWEAVADALAAEEEIEKKSRPLESVKEQVSVGQSASNVCDSSISDASDVVGVEDPKQECLRVSSRKQTSNRAWRLDDDLRPQGLPNLAKQLSFPELDKRFSSVAIPSSCPICYEDLDLTDSNFLPCPCGFRLCLFCHKTICDGDGRCPGCRKPYERNMVKAETSIQGGGLTIRLARSSSMFCKF

SEQ ID NO: 9555 - protein, 166 aa, Arabidopsis thaliana
MICGNENHLFLDVDVPIEFFRSKNSDFGASVKANAGALTNFEVLDFLNSRGASKDTTRVIAPIARSEYKVYDYLVETAASTQTRESINKFADKCKDFKLAKAEILNIINLRPSSIVELLPIIENLDDREIDTDGILELVKDLLPPLPTTASPKDDDEEETENGEQS

SEQ ID NO: 9556 - protein, 438 aa, Arabidopsis thaliana
MGRDRISELPDGLLNHILMYLHIEESIRTSVLSSRWRKLWLKVPGLDVNVHDFPADGNLFESLMDKFLEVNRGRLQNFKLNYESNLYYLMDRFVPWIATVVDRGIQHLDVTATDCPPWTIDFMPANICKSKTLVSLKLVNVGLDTPKFVVSLPCLKIMHLEDIFYSPLIAENLISGCPVLEDLTIVRNHEDFLNFLRVMSQTLKNFRLTFDWGMGSNDFSVEIDAPGLKYMSFRDSQSDRIVVKNLSSLVKIDLDTEFNLKFGLGSPLEPEDLTKRDIIRDFLTGISSVKHMIISHPTLEVLYRYSKIGQLPKFHNLYHLQAVFSSSLLQLLPAFLEICPNLKNLILDYSISAEPEQIDFTNLPRCLISTLEYVEIKQLTMREESGIKLVKYFLENSAVLKKLTLSFIDSPMTNQESEIYMQLLTSTKRSRGCHVLIL

SEQ ID NO: 9557 - protein, 159 aa, Arabidopsis thaliana
MGSSEKRSKDIMSDIPTFSAENLQNNLKVIQNSRTFLSIIAGVLAGIIGFNGLIGFVFYFVVMLITSVGLMAKAGFSADLYFDSWNRVLFDGFLGGLMNQVYAQLENSSLYSLFVSVGFLNNGVDLRMTWCTYSEGTSAPDEDGETAHKIEFGFCSLFI

SEQ ID NO: 9558 - protein, 411 aa, Arabidopsis thaliana
MESPSISDAVPLHAPEDATADFSQPQSPLHEVDSFPVTESSDDVVVNVSEIPNLSPSDDDFDHERNSGEDRDQDHGENPVETDGVVVPIDELNQKIIRQVEYYFSDENLPTDKFLLNAMKRNKKGFVPISTIATFHKMKKLTRDHALIVSALKESSFLVVSADEKKVKRLSPLPEIRDPKIFTVLVENLPEDHSNENIREIFGKAGSIKSVSICDPNAVEESEKGGKKENFIRTRLHAFVEYETVEAAEKAAATLNNEQDWRNGLRVKLLEQAAGKFAQRRPARREVDKEKDTTGRVHDQTGGEKNKKTREHQNHRLHHSDNPADDDGGNHQKDKNGNKGRVVGQGRRQNHQGGNGIGHGTASSSSHPNYHPVEVSKRPPGPRMPDGTRGFTMGRGKAIPPPTSTQTSHEV

SEQ ID NO: 9559 - protein, 443 aa, Arabidopsis thaliana
MANDGNGDNNDDPLRQYLMNPRINPPPPSLLTLPENNDVTIPMPITPLELKNRLIFGSFVRSRKESSLPIDALSQNPSTSSSATTSFSDSTDLLLPLTEPNKPVRKSKPTINFHRSKTAPAMAAINNISHPNDPKTDQQSDSKTIVNQAVALLVVYLSLGVLIYWLNRDSYNVKQTHPVVDALYFCIVTMCTIGYGDITPDSVVTKLFSIFFVLVGFGFMDILLSGMVTYVLDLQENYMLETARNESLNLNDRDKVRSYIIDVKKGRMRIRLKVGLALGVVVLCLGFGVLIMHFVEKIGWLDSFYFSVMSVTTVGYGDRAFNTLAGRLLAAMWLLVSTLAVARAILFLAESRVDKRNRERAKKVLGESMSISQFLDADIDCNGCVSKAEFVIYKLKKMDKITEKDINPIGFQFDKLDRTNSGRITLLDLLESSTKDLPTATSI

SEQ ID NO: 9560 - protein, 298 aa, Arabidopsis thaliana
MAAVNCHFFQLSRHLKPSRPSFSCSASQPSQNNIKVIINGAAKEIGRAAVVAVTKARGMELAGAVDNHFVGEDIGLLCDMEEPLEIPVVSDLTMVLGSISQGKEVGVVIDFTDPSTVYENVKQATAFGMKSVVYVPRIKPETVSALSALCDKATMGCLVAPTLSIGSILLQQAVIMASFHYNNVELVESRPNAADLPSPEAIQIANNISNLGQIYNREDSSTDVQARGQVIGEDGVRVHSMVLPGLPSSTQVYFSSPGDVYTVKHDIIDVRSLMPGLLLAIRKVVRLKNLVYGLEKFL

SEQ ID NO: 9561 - protein, 511 aa, Arabidopsis thaliana [sequence omitted]

SEQ ID NO: 9562 - protein, 185 aa, Arabidopsis thaliana
MQAWFMDDSNEDQRLPHHRNPKELVSLDYLAELGVLYWKLNPENYENDSELSKIREDRGYDYMDLLDLCPEKVSNYEEKLKNFFTEHIHKDEEIRYCLAGSGYFDVRDKDDRWIRIWMQPGDLIVLPAGIYHRFTLDASNYIKLMRLFVGEPVWTPYNRPQEEHPVRKKYIHGLTYKFGETVKAH

SEQ ID NO: 9563 - protein, 455 aa, Arabidopsis thaliana
MSKMKDFGGGRDIISDLPDALIGHILSFLPTIEAVATTVLAKRWKPLLSFVHSLDFDDSLCLHPAKTNEEKRTNATSFMRFVDGVLALQGNARINKFRLNGKHIINERWVLDWIQNVLKRDVSDIRLYVSSCSDGFDSSFYHLPPEIFVSQTLVTLIIMFEGDINISVGREVSLPKLKTLHLYHFKIKLSTFNKLISGCHALEELMMINWKWDESSEPEPCFVTIYLPNLKILEYCRFERYDEANDKVSLLFHNPKVVYLEFFDSIADRYQQVSFGSLVEARLGIRLTYDQVYNHLETEYYVSSKEKSNVTNLLTGICNVKILYLSDETLEVFGCCRDTIPVFSNLIELTIQTKPHIIWKPLPAMLNNCPNLITLIFEGMHHIYSDRCEDEDGCLCRYPTNFVGGVVARPCLSSSPVKVLKILNFGEICDVHEDDEDDDDDDDDEDEEFVYCLRE

SEQ ID NO: 9564 - protein, 438 aa, Streptomyces coelicolor A3(2)
MSELAYPYEAPASQALFDRAAAVTPGGVNSPVRAFRAVGGTPRFMVSGTGPYLTDADGREYVDLVCSWGPMILGHAHPEVIAAVQEAVARGTSFGTPAEGEVALAEAMVERVAPLEEVRLVSSGTEATMSAIRLARGFTRRTKVIKFAGCYHGHVDSLLAAAGSGVATFALPDTPGVTGAQASDTIVLPYNDLDAVHAAFAAHPGEIACVITEASPGNMGVVPPLPGFNQGLKDACAANGALFVSDEVMTGFRTSLAGWFGVEGVVPDLMTFGKVMGGGFPAAAFGGRADVMAHLAPAGPVYQAGTLSGNPVATAAGLAQLRLLDDAAYDTVDAVSAQIQALVTEALTKEGVAHTLQNASNMFSVFFTDRPVVNYEDAKAQESFRFTAFFHSLLANGVYLPPSSFESWFVSTAHDERAVQRIADALPAAARAAAEATA

SEQ ID NO: 9565 - protein, 470 aa, Sphagnum cuspidatum
ETKAGSGFKAGVKDYRLTYYTPEYGVKDTDILAAFRMTPQPGVPPEEAGAAVAAESSTGTWTTVWTDGLTSLDRYKGRCYDIEPVAGEENQYIAYVAYPSDLFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFLFVAGAIYKSQAETGEIKGHYLNATAGTCEEMMKRAAFARELGAPIIMHDYLTGGFTANTTLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLARQGNDIIREAAKWSPELAAACEVWKEIKFEFDTIDTV

SEQ ID NO: 9566 - protein, 468 aa, Sphagnum palustre
KAGSGFKAGVKDYRLTYYTPEYAVKDTDILAAFRMTPQPGVPPEEAGAAVAAESSTGTWTTVWTDGLTSLDRYKGRCYDIEPVAGEENQYIAYVAYPSDLFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAAFARELGAPIIMHDYLTGGFTANTTLAYYCRDNGLLLHIHRAMHAVIDRQKIHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLARQGNDIIREAAKWSPELAAACEVWKEIKFEFDTIDTV

SEQ ID NO: 9567 - protein, 190 aa, Candida rugosa
SIQTGIARTGKMLCFEHSGIKPDVVLLGKAISGGVMPVSAVLSSKEIMLTLEPGSHGSTYGGNPLACAVAIAALEVVREEGLVERAEKLGATLRAELEKLKAESNGVISEVRGVGLLSAVVIDDTKTNGRSAWDLCLLMRDHGVLAKPTHDHIIRLAPPLVISEEDLLKGVESIRASLKDLPNAPKGNGH

SEQ ID NO: 9568 - protein, 447 aa, Schizosaccharomyces pombe
MCLPTIRKIAIIGAGPSGLVTAKALLAEKAFDQVTLFERRGSPGGVWNYTSTLSNKLPVPSTNPILTTEPIVGPAALPVYPSPLYRDLQTNTPIELMGYCDQSFKPQTLQFPHRHTIQEYQRIYAQPLLPFIKLATDVLDIEKKDGSWVVTYKGTKAGSPISKDIFDAVSICNGHYEVPYIPNIKGLDEYAKAVPGSVLHSSLFREPELFVGESVLVVGGASSANDLVRHLTPVAKHPIYQSLLGGGDIQNESLQQVPEITKFDPTTREIYLKGGKVLSNIDRVIYCTGYLYSVPFPSLAKLKSPETKLIDDGSHVHNVYQHIFYIPDPTLAFVGLALHVVPFPTSQAQAAFLARVWSGRLKLPSKEEQLKWQDELMFSLSGANNMYHSLDYPKDATYINKLHDWCKQATPVLEEEFPSPYWGEKERSIRENMWSIRAKFFGIEPPK

SEQ ID NO: 9569 - protein, 401 aa, Nicotiana tabacum
MAIPKELLVLLLGIAILSKVAECAAFGSRRGLVETVFDVTRFGARPNTPADSTRGLMMAWRSACQSPGPAKVVIPPGTYTTGETIFQGPCTSPRPITIEIQGTLLSNTDMSLYTRAAWISIEHVDGIVITGGGTLNGQGKSSWQFADKSGSTPPLPSSLVFQTVRSSSIKNLNFVDAKGVHLKITDSSDISVSNIKITAPGDSPNTDGLHISDTINVNVTDSTIGTGDDCISIGDGNSNVYISNINCGPGHGISIGSLGKRLDETDVKGVTVRNCTFRGTTNGARIKTYMGSPSLQVSGVVYEDIILDNVKNPIVIDQHYHSKNRNEPSRVKLVDIHFRNIRGTTTSKIPVLLNCSEALPCEGVELVDIDLAPVGSIGPLLPATCQNAKTILNGKNNPPAC

SEQ ID NO: 9570 - protein, 107 aa, Tulipa gesneriana
MAVRKSSNLPQAAVIRHILKRCSSFGRKNGACSDKGHSLPLDVPKGHFAVYIGEKRSRFIVPISLLAHPEFQSLLRAAEEEFGFDNDMGLTIPCEEVVFRSLTAVLC

SEQ ID NO: 9571 - protein, 107 aa, Tulipa gesneriana
MAVKKSPKISEAAAIKQILKRCSSIGRKHGAYSEENYCLPLDVPKGHFAIYVSEKRSRFVVPISLLAHPEFQSLLRDAQEEFGFDHDMGLTIPCEEIVFKSLTAVLW

SEQ ID NO: 9572 - protein, 220 aa, Pseudomonas aeruginosa
EFVLTTTHGELRADKLLVATGRTPNTRSLALEAAGVAVNAQGAIVIDKGMRTSSPNIYAAGDCTDQPQFVYVAAAAGTRAAINMTGGDAALDLTAMPAVVFTDPQVATVGYSEAEAHHDGIETDSRLLTLDNVPRALANFDTRGFIKLVIEEGSGRLIGVQAVAPEAGELIQTAVLAIRNRMTVQELADQLFPYLTMVEGLKLAAQTFSKDVKQLSCCAG

SEQ ID NO: 9573 - protein, 450 aa, Thermoanaerobacter brockii
MIKLAKFPRDFVWGTATSSYQIEGAVNEDGRTPSIWDTFSKTEGKTYKGHTGDVACDHYHRYKEDVEILKEIGVKAYRFSIAWPRIFPEEGKYNPKGMDFYKKLIDELQKRDIVPAATIYHWDLPQWAYDKGGGWLNRESIKWYVEYATKLFEELGDAIPLWITHNEPWCSSILSYGIGEHAPGHKNYREALIAAHHILLSHGEAVKAFREMNIKGSKIGITLNLTPAYPASEKEEDKLAAQYADGFANRWFLDPIFKGNYPEDMMELYSKIIGEFDFIKEGDLETISVPIDFLGVNYYTRSIVKYDEDSMLKAENVPGPGKRTEMGWEISPESLYDLLKRLDREYTKLPMYITENGAAFKDEVTEDGRVHDDERIEYIKEHLKAAAKFIGEGGNLKGYFVWSLMDNFEWAHGYSKRFGIVYVDYTTQKRILKDSALWYKEVILDDGIED

SEQ ID NO: 9574 - protein, 231 aa, Arabidopsis thaliana
LQKELDYLVGAVSNPKRPFAAIVGGSKVSSKIGVIESLLEKCDILLLGGGMIFTFYKAQGLSVGSSLVEEDKLELATTLLAKAKARGVSLLLPTDVVIADKFAPDANSKIVPASAIPDGWMGLDIGPDSVKTFNEALDTTQTVIWNGPMGVFEFEKFAKGTEAVRNKLAELSKKGVTTIIGGGDSVAAVEKVGVAGVMSHISTGGGASLELLEGKVLPGVVALDEATPVTV

SEQ ID NO: 9575 - protein, 399 aa, Arabidopsis thaliana
GDLTSADLKGKKVFVRADLNVPLDDNQTITDDTRIRAAIPTIKYLIENGAKVILSTHLGRPKGVTPKFSLAPLVPRLSELLGIEVTKADDCIGPEVESLVASLPEGGVLLLENVRFYKEEEKNDPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATELLAKAKAKGVSLLLPTDVVVADKFAPDANSKIVPASGIEDGWMGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEAIPVTV

SEQ ID NO: 9576 - protein, 126 aa, Fagus sylvatica
YSGVPLLKSLKHSNIVKFYNSWIDDKNKTVNIITELFTSGNLRQYCKKHKKVDMKALKGWARQILTGLNYLHSHSPPIIHRDLKCDNIFINGNQGEVKIGDLGLATVMEQANAKSVIGTPEYYAPE

SEQ ID NO: 9577 - protein, 100 aa, Fagus sylvatica
VFTFWNLRQYCKEPKKVDLRALKGWARQILTGLNYLHSHSPPIIHRDLKCDNIFINGNQGEVKIGDLGLATVMEQANAKSVIGTPEYYAPDGVPREHSTL

SEQ ID NO: 9578 - protein, 107 aa, Oryza sativa (indica cultivar-group)
MAAAAAAATIGMMDSAYFVGRGEILSWINATLQLSLAKVEEVNFDAKTEYDMIQNYKILQDVFNKLRLSKMTKAVQKILYAADARDSPLPEANEIITRSPSMFPDEA

SEQ ID NO: 9579 - protein, 209 aa, Oryza sativa (indica cultivar-group)
MDGGVGEEGKQQPHLVLAHKLFLLSHPDVDDLAKVDLRADVLAAVKSDDMASLYESLGAGGVLETDAALLAEMRGRIEEEIRKLDEKIADAEENLAGLTEQIKLDRYLQPHFRYYMREVRTVVYSQFLESYKSVTMEAMASAFGVTVDFIDLELSRFIAAGKLHCKIDKVAGVLETNRPDARNAFYQATIKQGDFLLNRIQKLSRVIDL

SEQ ID NO: 9580 - protein, 193 aa, Oryza sativa (indica cultivar-group)
MIKQILGRLPRKPGKAGDSRDAAGPNGNEPSNSYSVARSVEQGNKRSGNGDYVVPAGLTPNPMMNGTVVYHSNEPLPAFKDVPASEKQNLFVKKVNLCCVVYDFADPTKNLKEKETKRQTLMELVDYVTSANGKFSEVVMSEITKMVSINLFRSSSPTPRENKAIEGVDLEEEEPLMDPAWSHLQIVYEVFLR

SEQ ID NO: 9581 - protein, 151 aa, Oryza sativa (indica cultivar-group)
MGSSTILFYCVALSVVAAAAAVVSSAAEEAEGPQDEAGRFLSAATLASSDSDAKTSRRALTSQEEIIAKPCPVEFEQVKGFGELGAKCNDKQTMKECCELFKKIACPYNHLLNDITNVCANEFFYLIHTKGKLQPGTILENCNEGPMGINC

SEQ ID NO: 9582 - protein, 149 aa, Oryza sativa (indica cultivar-group)
MGSSIGRATIFYCVALSMIAGAAATQVPPTEAESVKAAELASSAFKADTLPSASRKLMAVSDVPLAPVCPVRFDKMKGPAIELGKKCKTTGVKVCCEAFKTFACPHNKLINDVNNGCADEMFYTIHTYGQLPPGTIFKKCLEGPHGMKC

SEQ ID NO: 9583 - protein, 426 aa, Streptomyces coelicolor A3(2) [sequence omitted]

SEQ ID NO: 9584 - protein, 297 aa, Cochliobolus carbonum
MTFQKAIVTEAPHRARLVSDRLIPKLRDDYILVRTVSVALNPTDWKHILRLSPPGCLVGCDYAGIVEEVGRSVKKPFKKGDRVCGFAHGGNAVFSDDGTFAEVITVKGDIQAWIPENLSFQEAATLGVGIKTVGQGLYQSLKLSWPTTPIEHAVPILIYGGSTATGTLAIQLAKLSGYRVITTCSPHHFELMKSLGADLVFDYHEITSADHIRRCTQNKLKLVFDTISIDVSARFCDRAMSTEGGEYSALLDVSIARTNISSRWTLAYTVLGEGFTSEQIVFQPYPTTMSSGRNFGM

SEQ ID NO: 9585 - protein, 107 aa, Lilium longiflorum
RAAPAQASMVAPFVGLKSSSAFPVTQKPATGLPTLPSNGGRVQCMKVWPIVGKKKFETLSYLPTLPVEALLKQIEYLIRSGWVPCLEFSLVGFVSRDYHQSPGYYDG

SEQ ID NO: 9586 - protein, 356 aa, Eucalyptus saligna
MGSLEKERTTTGWAARDPSGVLSPYTYSLRNTGPEDLYIKVLSCGICHSDIHQIKNDLGMSHYPMVPGHEVVGEVLEVGSEVTKYRVGDRVGTGIVVGCCRSCGPCNSDQEQYCNKKIWNYNDVYTDGKPTQGGFAGEIVVGQRFVVKIPDGLESEQAAPLMCAGVTVYSPLVRFGLKQSGLRGGILGLGGVGHMGVKIAKAMGHHVTVISSSDKKRTEALEHLGRDAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVAGSKLD

SEQ ID NO: 9587 - protein, 479 aa, Streptomyces coelicolor A3(2)
MLESATPVTPVTFPPAFLWGAATSAYQIEGAVREDGRTPSIWDTFSHTPGKTAGGDTGDVAVDHYHRYRDDVALMKDLGLGAYRFSISWPRVQPTGRGPAVQRGLDFYRRLVDELLAAGIKPAVTLYHWDLPQELEDAGGWPERDTAYRFAEYAQIVGEALGDRVEQWITLNEPWCAAFLGYASGVHAPGRTDPAAALRAAHHLNLAHGLGTVALRSVMPARNSVAISLNTSVVRPLSQSPADLAAARKIDDLSGGIFHGPILHGAYPQTLLEATAPLTDWSFVQDGDLGQIRQPIDAICLNYYTPTVVSAADADSRAPRADGHGASDHSPWPAAEDVAFHQPPGERTEMGWTVDPTGLHELIMRYNREAPGMPLYISENGAAYDDKPGADGTVHDPDRVAYLNGHLTAVRQAIADGADVRGYYLWSLLDNFEWAYGYEKRFGAVYVDYASQQRTPKSSALWYGRAARTGTLPPVDAAE

SEQ ID NO: 9588 - protein, 495 aa, Neurospora crassa
MLTPTTLLLLSPLLYLLTLLFRTALYRLRARSLGCSPVAVYPHKDPILGLDLFRESLRAMNTHALLPLWDARFKRYGNTHYTLTLGKWVLMTNEPENVKVILGTKMAEWPIDGPRLHASVAVLGKKSIFTTNGAQWREARGMIRPSFVRDQVADLHCFAKHVGNFLNAIPKDGSTFDMQELLLSMTMDSSTDFLLGCSTNSLLQPSPEAKQFLEDFEYTSREAAKKSRLGTLLNWLPNGEFQATVTRVREYVRAYIRKSQAEKTDKKERDYVFLHEILKSGADEEHAIDQVLSVIIAGRDTTAAAMTACFYYLARNPEAVKKLRKEIFDMEDEMPTWEQLKNMKYLNMIIKEGLRLFPPASTNSRAPIKDTVLPRGGGPDGKQPILVPKGQVVRWSLYSLHRRKDIWGEDAHEFRPERWDENLRVGWEYIPFSGGPRICLGQQFALTQIEYALFKFFRAFKSIEPRDDNGPLLLRTNLTVTFAKGCLVSATPDSN

SEQ ID NO: 9589 - protein, 336 aa, Eucalyptus saligna
MPVDALPGSGQTVCVTGAGGFIASWIVKLLLERGYTVRGTVRNPDDPKNGHLRDLEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKARCAEAKERGVDLVVINPVLVLGPLLQSTINASIIHILKYLTGSAKTYANSVQAYVHVKDVALAHVLVLETPSASGRYLCDESVLHRGDVVEILAKFFPEYNVPTKCSDEVNPRVKPYKFSNQKLKDLGLEFTPVKQCLYETVKSLQEKGHLPVPPPPEDSVRIQG

SEQ ID NO: 9590 - protein, 244 aa, Cynodon dactylon
AMGDKPGPNITATYGDKWLDAKATFYGSDPRGAAPDDHGGACGYKDVDKAPFDGMTGCGNEPIFKDGLACGSCYEIKCKEPAECSGEPVLIKITDKNYEHIAAYHFDLSGKAFGAMAKKGEEDKLRKAGELMLQFRRVKCEYPSDTKIAFHVEKGSSPNYLALLVKYAAGDGNIVGVDIKPKGSDEFLPMKQSWGAIWRMDPPKPLKGPFTIRLTSESGGHVEQDDVIPEDWKPDTVYKSKIQF

SEQ ID NO: 9591 - protein, 377 aa, Solanum tuberosum
MDSSNPKVITCKAAVVGKEGEMIKIEEIQVDPPKSNEVRIKMLFASLCHTDILASNGYPYSLFPRVLGHEGVGMIESVGENVTNLKEGDIVMPLYLGECKECPNCKSGKSNLCHKYHLTFSGLMLDDTSRISIHGGQVLYHSFSCSTWSEYIVINANYVIKVDPQKIPLQHASLLCCGFTTGYGATWREVHVEKGSTVAVLGLGVVGLGAIEGARSQGASKIIGVDINESKQGKGELFGMTDFINPKESMTSVSEMIKDVTEGLGVDYVFECTGIPSMLNEAIEASKLGIGTIVVIGAGHGLTREFNLVPLLCGRTLKGSIYGGIRLHSDLPAILHRCATKEIQLNELITHQISLTEINQSFELLKDPHCVKIIIKF

SEQ ID NO: 9592 - protein, 396 aa, Neurospora crassa
MKGALLTAAMLLGSAQAGVHTMKLKKVPLADELESVPIDVQVQHLGQKYTGLRTESHTQAMFKATDAQVSGNHPVPITNFMNAQYFSEITIGTPPQTFKVVLDTGSSNLWVPSSQCGSIACYLHNKYESSESSTYKKNGTSFKIEYGSGSLSGFVSQDRMTIGDITINDQLFAEATSEPGLAFAFGRFDGILGLGYDRLAVPGITPPFYKMVEQKLVDEPVFSFYLADQDGESEVVFGGVNKDRYTGKITTIPLRRKAYWEVDFDAIGYGKDFAELEGHGVILDTGTSLIALPSQLAEMLNAQIGAKKSWNGQFTIDCGKKSSLEDVTFTLAGYNFTLGPEDYILEASGSCLSTFMGMDMPAPVGPLAILGDAFLRKYYSIYDLGADTVGIATAKR

SEQ ID NO: 9593 - protein, 440 aa, Alnus glutinosa
MAEITHIKARQIFDSRGNPTVEAEVTTANGVVSRAAVPSGASTGVYEALELRDGGSDYLGKGVLKAVDNVNKIIGPALIGKDATEQTAIDIDFMFQQLDGTVNEWGWCKQKLGANAILAVSLAVCKAGASVKKIPLYKHIANLAGNPKLVLPVPAFNVINGGSHAGNKLAMQEFMILPVGASSFKEAMKMGVEVYHHLKAVIKKKYGQDATNVGDEGGFAPNIQENKEGLELLKTAIAKAGYVVIGMDVAASEFYEKDKDITNFKEENNDGSQKISADQLKDLYKSFVDEYPIVSIEDPFDQDDWEHYSKLTAEIGEKVQIVGDDLLVTNPKRVEKAIKEKACNALLLKVNQIGSVTESIEAVKMSKRAGWGVMAHRSGETEDTFIADLSVGLATGQIKTGAPCRSERLAKYNQLLRIEEELGSEAVYAGANFRTPVEPY

SEQ ID NO: 9594 - protein, 456 aa, Piscirickettsia salmonis
MSKQKNQYVCSDCGGIAKKWLGQCPHCQQWNSLSEVKEVLPNRPGRSQRFAGFAGIDAPKVKCLSEITPEQISRQPVGICEFDRVLGGGLVHGAVILLGGDPGIGKSTLLLQTSVNCTQFGKVLYVTGEESLEQVTLRSKRLGLSQDVDLRLLAETQVERILKAAEIEQPKVLIVDSIQTIFTESLQSAPGGVAQVRESAAILTQFAKRTGTCLFLVGHVTKEGALAGPRVLEHMVDTVLYFEGEQDSRFRLLRAVKNRFGAANELGIFAMTETGLKTVSNPSAIFLSRYEDLQPGSVVMVAWEGTRPLLVEVQALVDESHSSNPRRIAVGLDQQRLAMLLAVLNRHGGIASYDQDVFINVVGGMKITETAADLALLLACVSSLRGKALSQELIVFGEIGLSGEIRPVQRGLERIKEAVKHGFTQAIVPLANCPKQKVDGIEIVGVKHLEDALATL

SEQ ID NO: 9595 - protein, 361 aa, Cryptococcus neoformans var. neoformans
MSTLSNFTIPKTQTAAVVKTTGAELAIEKEHPVKQASELGPGQCLVKISHTGVCHTDLHAKSGDWPVPPSHPLIGGHEGVGIIVAIGDHTAASPVKLGDRVGIKWLADSCLSCEYCRRGYEMNCPNVKLSGYTTDGTFSEYVVSFVNHVTPIPESLDSAGAASILCAGVTTYKALKVSNTKVGDWVALPGAGGGLGHLAVQYAKAMGLKVIAIDSGAAKEKLVKSLGADAWVDFKTSKDIVADIKAATGGDGPAAAVVTAANKTGYAQAIEYLKPSGTLVAVGMPDAEMGANVFWTVFKSIRIQGSYVGNRQDAIEALDIAASGQVKVVFEEKGLDSLKGVFEDLEAGKIAGRVVLKVSDE

SEQ ID NO: 9596 - protein, 486 aa, Comamonas sp. JS765
MLAKQILNFINGEFVATGKWFDNRTPISNAVIGQVAEAGQAEVDAAVAAARAALKGPWGSMTLAQRVELLEALVAEITRRFDEFLEAECADTGKPRSLASHIDIPRGAANFKVFADVVKNVPTEFFEMATPDGRGAINYGYRKPVGVVGVICPWNLPLLLMTWKVGPALACGNTVVVKPSEETPRTAALLGEVMNHVGIPKGVYNVVHGFGPGSAGEFVTSHPGIDAITFTGETRTGEVIMKAAAKGARPVSLEMGGKNAAIVFADCDFDAAIEGTLRSAFVNCGQVCLGTERVYVERPIFDKFVAALKQQVEGWKIGVPEGADTQLGPLISKEHQAKVLSYYQLAVQEGATVVTGGGVPDMPGELKDGCWVQPTIWTGLPETARVIKEEIFGPCCHIAPFDTEDEVLAKANDNEYGLATAIWTRDLSRAHRVAQRMEVGISWVNSWFLRDLRTPFGGSKQSGIGREGGVHSLEFYTELKNVCIKL

SEQ ID NO: 9597 - protein, 500 aa, Pseudonocardia sp. K1
MTVIAKPDHLLRDDVQKFIDRPKKLFINGQWHDSIKGETLEVYDPAVGTKICTVAAGDAEDVDRAVAAARHAFDEGPWSKLNPSERGRLVWRLADLLEEHADEFAQIDALDNGKPVTDARAVDVAFSIELLRYMAGWSNKIYGETIPLTNPADFHAYTLREPVGVVGQIVPWNFPLMMAVWKVAPALAAGCTVILKPAEQTPLSALRLAELTEEAGFPPGVFNVITGFGETAGAAIAAHDNIDKVAFTGSTEVGRLIAQAASGNLKKVSLELGGKSPVIVFGDSDIEQAVAGASSAIFYNNGQTCTAGSRLYVHRKVYDKVVEGIASEASALPIGHGLDPATRIGPLISAEQRDRVTGYIAQGREAGAEVIVGGDTVGDGGYFIQPTILTKTDPSMSVVREEIFGPVLCAMAFDEDTIDSVVREANNSVYGLAASIYTRDISVAHRVAKRLKAGTIGINTHHVVDVALPFGGFKQSGYGRDMGRDAIDQYTEVKSIGIAL

SEQ ID NO: 9598 - protein, 441 aa, Oryza sativa (indica cultivar-group)
MDVEGEVPAAAAEAVANGLGGAEPSPAPVSAEQLDVEAYAAQYTGRTRLARLLFIAERCGVEAVELEALRMAYDEIKRGEDTMFHREVTNKINGRLGPKYALDQAWTDSVNRRAEQRKEKLESELNGYRTNLIKESIRMGYNDIGDFFYAHGHLSDAFKSYIRTRVYCTTSKHIVQMCMNVILVSIELGQFPHVSNYVSKAEQTPDTLDPIIVAKLRAAAGLAYLATKKYKLAARNFVETGHELGNNYSEVIAPQDVAVYGALCALASFDRSDLKSKVIDNSNFRNFLELVPEVRELVNDFYSSRYGSCLEHLEKLKTNLLLDIHLHDHVETLYMDIRHKAIIQYTLPFISVDLNTMAAAFMTSVSMLEKEVAALITENKIQARIDSHNKILYARHADQRNATFQRVLQTGNEFERDVKSLLLRANLIKHDFNQRAGQRKM

SEQ ID NO: 9599 - protein, 504 aa, Solanum tuberosum
MAISTLARRKATTFLSSRLLYSTSKYSFSLTRGFASGSDENDVVVIGGGPGGYVAAIKAAQLGLKTTCIEKRGTLGGTCLNVGCIPSKALLHSSHMFHEAQHSFANHGVKFSSVEVDLPAMMGQKDKAVSNLTRGIEGLFKKNKVNYVKGYGKFLSPSEISVDTVEGGNSVVKGKNIIIATGSDVKGLPGITIDEKKIVSSTGALALTEIPKRLVVIGAGYIGLEMGSVWGRLGSEVTVVEFASDIVPTMDGEVRKQFQRALEKQKMKFMLNTKVVSVDATGDGVKLTLEPSAGGDQTILEADVVLVSAGRVPFTSGLGLDTIGVETDKAGRILVNERFATNVPGVHAIGDVIPGPMLAHKAEEDGVACVEFIAGKEGHVDYDMVPGVVYTHPEVAYVGKTEEQVKSLGVDYRVGKFPFLANSRAKAIDDAEGIVKVIAEKESDKILGVHIMSPNAGELIHEAVLALQYGASSEDIARTCHAHPTMSEALKEAAMATYDKPIHM

SEQ ID NO: 9600 - protein, 170 aa, Helicobacter pylori
GSGMHTHVSVWKNNENLFSGKTYKGLSELALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIREKGIKQMPHTLRRSLEEMLADKQYLKEGQ

SEQ ID NO: 9601 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGMDGVKNKMDPGEAMDINLFKLTLDEIREKGIKQMPHTLRSSLEEMLADKQYLKEGQ

SEQ ID NO: 9602 - protein, 170 aa, Helicobacter pylori
GSGMHTHVSVWKNNENLFSGEIYKGLSELALHFLGGVLHHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 9603 - protein, 170 aa, Helicobacter pylori
GSGMHTHVSIWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGMDGVKNKMDPGEAMDINLFKLTLDEIREKGIKQMPHTLRRSLEEMLADKQYLKEGQ

SEQ ID NO: 9604 - protein, 170 aa, Helicobacter pylori
GSGMHTHVSIWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 9605 - protein, 170 aa, Helicobacter pylori
GSGMHTHVSVWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 9606 - protein, 170 aa, Helicobacter pylori
GSGMHTHVSIWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 9607 - protein, 170 aa, Helicobacter pylori
GSGMHTHVSVWKNNENLFSGETYKGLSELALHFLGGVLCHARGLAAFTNASTNSYKRLIPGYEAPSILTYSANNRSASVRIPYGISKNSTRFEFRFPDSSSNPYLAFAAILMAGMDGVKNKIDPGEAMDINLFKLTLDEIREKGIKQMPHTLRRSLEEMLADKQYLKEGQ

SEQ ID NO: 9608 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKHDLKEGQ

SEQ ID NO: 9609 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIREKGIKQMPHTLRRSLEEMLADKQYLKEDQ

SEQ ID NO: 9610 - protein, 170 aa, Helicobacter pylori
GSGMHTHVSIWKNNENLFGGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 9611 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLNEIREKGIKQMPHTLRRSLEEMLADKQYLKEGQ

SEQ ID NO: 9612 - protein, 170 aa, Helicobacter pylori
GSGMHTHVSIWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 9613 - protein, 170 aa, Helicobacter pylori
GSGMHTHVSVWKNNENLFSGETYKGLSGFALHFLGGVLHHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 9614 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 9615 - protein, 170 aa, Helicobacter pylori
GSGMHTHVSIWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 9616 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSTRFEFRFPDSSSNPYLAFAAILMAGMDGVKNKMDPGEAMDINLFKLTLDEIREKGIKQMPHTLRRSLEEMLADKQYLKEGQ

SEQ ID NO: 9617 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEDQ

SEQ ID NO: 9618 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGIDGIKNKMDPGEAMDINLFKLTLDEIREKGIKQMPHTLRRSLEEMLADKQYLKEDQ

SEQ ID NO: 9619 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEDQ

SEQ ID NO: 9620 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 9621 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGIDGVKNKMDPGEAMDINLFKLTLDEIREKGIKQMPHTLRRSLEEMLADKQYLKEGQ

SEQ ID NO: 9622 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKEGQ

SEQ ID NO: 9623 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKESQ

SEQ ID NO: 9624 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSTRFEFRFPDSSSNPYLAFAAILMAGMDGVKNKMDPSEAMDINLFKLTLDEIREKGIKQMPHTLRRSLEEMLADKQYLKEGQ

SEQ ID NO: 9625 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 9626 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGIDGVKNKIDPGEAMDINLFKLTLDEIREKGIKQMPHTLRRSLEEMLADKQYLKEGQ

SEQ ID NO: 9627 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKEGQ

SEQ ID NO: 9628 - protein, 170 aa, Helicobacter pylori
GSGMHTHVSIWKNNENLFSGETYKGLSELALHFLGGVLHHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 9629 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGMDGVKNKIDPGEAMDINLFKLTLDEIREKGIKQMPHTLRRSLEEMLADKQYLKEGQ

SEQ ID NO: 9630 - protein, 170 aa, Helicobacter pylori
GSGMHTHVSVWKNNENLFSGETYKGLSELALHFLGGVLCHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 9631 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGH

SEQ ID NO: 9632 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 9633 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGQ

SEQ ID NO: 9634 - protein, 170 aa, Helicobacter pylori
GSGMHTHVSMWKNNENLFSGEAYKGLSELALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIREKGIKQMPHTLRRSLEEMLADKQYLKEGH

SEQ ID NO: 9635 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFGAILMAGIDGVKNKMDPGEAMDINLFKLTLDEIREKGIKQMPHTLRRSLEEMLADKQYLKEGQ

SEQ ID NO: 9636 - protein, 170 aa, Helicobacter pylori
GSGMHTHVSVWKNNENLFGGETYKGLSELALHFLGGVLRHARGLAAFTNASTNSYKRLIPGYEAPSILTYSANNRSASVRIPYGISKNGARFEFRFPDSSSNPYLAFAAILMAGMDGVKNKIDPGEAMDINLFKLTLDEIREKGIKQMPHTLRRSLEEMLADKQYLKEGQ

SEQ ID NO: 9637 - protein, 170 aa, Helicobacter pylori
GSGMHTHVSVWKNKENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 9638 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 9639 - protein, 170 aa, Helicobacter pylori
GSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKESQ

SEQ ID NO: 9640 - protein, 170 aa, Helicobacter pylori
GSGMHTHVSVWKNNENLFSGETYKGLSGLALHFLGGVLHHARGLAAFTNASTNSYKRLIPGYEAPSILTYSANNRSASVRIPYGISKNSARFEFRFPDSSSNPYLAFGAILMAGIDGVKNKIDPGEAMDINLFKLTLDEIREKGIKQMPHTLRRSLEEMLADKQYLKEGQ

SEQ ID NO: 9641 - protein, 170 aa, Helicobacter pylori
GSGMHTHVSVWKNNENLFSGETYKGLSEFALHFLGGVLCHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 9642 - protein, 170 aa, Helicobacter pylori
GSGMHTHVSVWENNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGQ

SEQ ID NO: 9643 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSTRFEFRFPDSSSNPYLAFAAILMAGMDGVKNKMDPGEAMDINLFKLTLDEIREKGIKQMPHTLRRSLEEMLADKQYLKEGQ

SEQ ID NO: 9644 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSTRFEFRFPDSSSNPYLAFAAILMAGMDGVKNKIDPGEAMDINLFKLTLDEIREKGIKQMPHTLRRSLEEMLADKQYLKEGQ

SEQ ID NO: 9645 - protein, 170 aa, Helicobacter pylori
GSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFAAILMAGMDGVKNKMDPGEAMDINLFKLTLDEIREKGIKQMPHTLRRSLEEMLADKQYLKEGH

SEQ ID NO: 9646 - protein, 170 aa, Helicobacter pylori
GSGMHTHVSIWKNNENLFGGETYKGLSEFALHFLGGVLRHARGLAAFTNASTNSYKRLIPGYEAPSILTYSASNRSASVRIPYGISKNSARFEFRFPDSSSNPYLAFGAILMAGIDGIKNKMDPGEAMDINLFKLTLDEIREKGIKQMPHTLRRSLEEMLADKQYLKEGQ

SEQ ID NO: 9647 - protein, 170 aa, Helicobacter pylori
GSGMHTHVSIWKNNENLFGGETYKGLSEFALHFLGGVLRHARGLAAFTNASTNSYKRLIPGYEAPSILTYSASNRSASVRIPYGISKNSARFEFRFPDSSSNPYLAFGAILMAGIDGVKNKMDPGEAMDINLFKLTLDEIREKGIKQMPHTLRRSLEEMLADKQYLKEGQ

SEQ ID NO: 9648 - protein, 170 aa, Helicobacter pylori
GSGMHTHVSVWKNNENLFSGETYKGLSELALHFLGGVLHHARGLAAFTNASTNSYKRLIPGYEAPSILTYSANNRSASVRIPYGISKNSARFEFRFPDSSSNPYLAFSAILMAGMDGVKNKIDPGEAMDINLFKLTLDEIREKGIKQMPHTLRRSLEEMLADKRYLKEGH

SEQ ID NO: 9649 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFSAILMAGMDGVKNKIDPGEAMDINLFKLTLDEIREKGIKQMPHTLRRSLEEMLADKQYLKEGH

SEQ ID NO: 9650 - protein, 170 aa, Helicobacter pylori
GSGMHTHVSIWKNNENLFSGEAYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQ

SEQ ID NO: 9651 - protein, 170 aa, Helicobacter pylori
GSGMHTHVSVWKNNENLFSGETYKGLSELALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKEGH

SEQ ID NO: 9652 - protein, 170 aa, Helicobacter pylori
GSGMHTHVSIWKNNENLFGGETYKGLSEFALHFLGGVLCHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESH

SEQ ID NO: 9653 - protein, 314 aa, Saccharomyces cerevisiae
MSYNPYAYATSEQNGVNDRFSHTPQQQRPMQIPRNTPVNGQGNANMNANVNGSGGGFPFQDPRGSMAFQLGQSAFSNFIGQDNFNQFQETVNKATANAAGSQQISTYFQVSTRYVINKLKLILVPFLNGTKNWQRIMDSGNFLPPRDDVNSPDMYMPIMGLVTYILIWNTQQGLKGSFNPEDLYYKLSSTLAFVCLDLLILKLGLYLLIDSKIPSFSLVELLCYVGYKFVPLILAQLLTNVTMPFNLNILIKFYLFIAFGVFLLRSVKFNLLSRSGAEDDDIHVSISKSTVKKCNYFLFVYGFIWQNVLMWLMG

SEQ ID NO: 9654 - protein, 498 aa, Botryotinia fuckeliana
ISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRPW

SEQ ID NO: 9655 - protein, 500 aa, Botryotinia fuckeliana
QEISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFARPR

SEQ ID NO: 9656 - protein, 501 aa, Botryotinia fuckeliana
AQEISQRSTGVVVAAGVAAFIVLSVVLNVLNQVLFANPNEPPMVFHWLPVIGSTITYGMDPYKFFFDCRAKYGDIFTFVLLGKKTTVYLGRKGNDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRPW

SEQ ID NO: 9657 - protein, 501 aa, Botryotinia fuckeliana
LAQEFSQRSTGVVVAAGVAAFIVLSVVLNVLNQVLFANPNEPPMVFHWLPVIGSTITYGMDPYKFFFDCRAKYGDIFTFVLLGKKTTVYLGRKGSDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRP

SEQ ID NO: 9658 - protein, 503 aa, Botryotinia fuckeliana
PLAQEFSQRSTGVVVAAGVAAFIVLSVVLNVLNQVLFANPNEPPMVFHWLPVIGSTITYGMDPYKFFFDCRAKYGDIFTFVLLGKKTTVYLGRKGSDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMLRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLFTRPR

SEQ ID NO: 9659 - protein, 498 aa, Botryotinia fuckeliana
LAQEFSQRSTGVVVAAGVAAFIVLSVVLNVLNQVLFANPNEPPMVFHWLPVIGSTITYGMDPYKFFFDCRAKYGDIFTFVLLGKKTTVYLGRKGSDFILNGKLKDLNAEEIYTVLTTPVFGKDVVYDCPNAKLMEQKKFMKIGLSTEAFRSYVPIIQMEVENFMKRSSAFKGPKGTADIGPAMAEITIYTASHTLQGKEVRDRFDTSFASLYHDLDMGFSPINFMLHWAPLPHNRARDHAQRTVAKTYMDIIQNRRAQATEAEFKSDIMWQLMRSSYKDGTPVPDKEIANMMIALLMAGQHSSSSSISWIMIRLASRPDIMEELYQEQIQVLGADLPALKYEDLSKLPLHQNVLKETLRLHTPIHSIMRKVTTPMPISGTKYVIPTSHTLMASPGCTSRDDEFFPEALEWDPHRWDLGSGRVVGNDQDEEFQDYGYGMISKGASSPYLPFGAGRHRCIGEQFATVQLVTIMATVVRLFKFKNIDGSKDVIGTDYASLF
